United States Patent 7,745,391 (HUMAN THROMBOSPONDIN POLYPEPTIDE) - sequence listing, part 220

SEQ ID NO: 562381 - DNA, 431 bp, Homo sapiens
gagccggtacctgttgagcctgctgagcaaggaaagccagtccaagtcccaaaactgaagagcttggagtccgatgtttgaggggaggaagagtccagcacaagagaaagatgtaggctgggaggctaggccagtctagtcttttcacgtttttctgcctcttgccatgctggcagctgattagatggtgcccacccagattaagggtggctctgcctttcccagcccactgactcaaatgttaatctcctttggcaacaccctcacagacatgtgcaggatgagtgttttgcattcttcaatccaattaagttgatactcagtattaaccatcacaattacccaggctggaattcagtggccattcacagggctgatgtcactacagccttgacctcctggcctcaatcagtccacctgcctcagcagcc

SEQ ID NO: 562382 - DNA, 415 bp, Homo sapiens
  misc_feature (397)..(398): n is a, c, g, or t
ttaaatagatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagcnntggatgtgtaccagaag

SEQ ID NO: 562383 - DNA, 276 bp, Homo sapiens
ctaatgtgattattaacgccccatatttagactattatgagcgtttaaattattatttcaagaattatgtttcgtaggcagagaaaatcctgaaggagcaagagcggctggcctacataaaccccgacctggctttggaggagaagaacaaaggcaacgagtgttttcagaaaggtactggctgcagctgggggattgggggagcagtgctgggtgtgcctcccgtgcctggctgtggggtaaatggccggctacacattgagggagccgacatgg

SEQ ID NO: 562384 - DNA, 607 bp, Homo sapiens
ctagaggatccccatctcgatgggttagggtcctgggtatggctcagccggatccagcagggggagggtctaggtatgggccctcaatcagaacccaggagggaaaatataacctatttaaaacaaaataatctcggtaccaaaaacagcataaagggtcaaaaaacaccacacgggaaaaagattggcaaggattatcacagccaaatagtaaattcctaatttccaaaaaatagctcctacaaatcgaagagaaaaatcctagggtctcaagggaaaaatgagcaagggattggacggggggtagactacagaaaaggactttaaaatagctcctaaagatagggaaccataattcaggatagcggaagtatcattggacaaaataactcagatgggtaccaaacttaaggggggaaagcattaccatgcatggcggtaaatgggtacatctcctacggagaccaatcgggcagtagttaccaaattggtgatggcatatatctcttcctctagaaatacctctttggggaataaatcctacttatattttcaaccaggtgtgaaatactcctatccaggtgatggactaccacttaatccctaa

SEQ ID NO: 562385 - DNA, 122 bp, Homo sapiens
ctaacttaggctcttattacataggaactgcatgagtagttcatgcgactcatccgaggtcactatgaggcaacgcaaggtgggttcctgccagggggagggatgtctacacagcacaatga

SEQ ID NO: 562386 - DNA, 332 bp, Homo sapiens
atggcgtgtacatacgaagggctatgtggactgaatgacgagtatgcaatgagcgctactaggtctgtatgtcgtaggcagatggagctagtaatccttatgcctcatagggatagtacacggaaggggtcagctatgtgtaaagtcagggggtagagcatgagtgtgaggagtataataccatagccgactagtaaaaagagtactgcggcaagtactattgacccagcgaagggggctacgacatgggctaaagaggaagacataagtgaagtccgaaaagaggtatctttactataaaagctattgagtgagctagtcatattaagttg

SEQ ID NO: 562387 - DNA, 1154 bp, Homo sapiens
gtagatgcgttgcccggaggtctcttctctcctgtcatatgtctcactcatgtgtttcctcgatccttcctttgactgtgccgctctatcgcgagcgtgtcccagggggcgtgcacctaaggttcccaccgcacgctggtattggaccgcctcatcggccttctccgctgcatacctgtggtgactaggggtaccccatcatagcctctcctggttacgccccagtgacgggggagccccatttgagggccctcgttactttttgtccagagcgctcccccgtattgcgtcccgctatattttctccctgtctcctcagcctctccctctgtgttgccccgcttgctctctgtgtttccttcggggtatatacttatgtagggggggccctttcaattggatgggctctgctccagcttgctcgggtctcctagcgcgccgcttttctcctcgcgcggtggacatttgcgtgcgcacgcgtgccgtccgggggctctcgggtctgtggtctgtggcctcggcgcacgcggagggaaggtgttcctacggcgtagggatacgggggtgtgtgtgtattgagcgtgtgtgggagggtcgtttttggttggtccctttcggatagtctttttgcgtgggcctctcttgcggggcgtgttgggagcgcgccctggcccgcccacaccccacataattgagggatatgtgagcccctctctctccacactcccgcacacttggcgagaagcgcacggtttgtatgctgtttggcgccgaacttttccactctgtgttttggtgcccaaaactcccacaggatgttgttgaaagagaacaatgagagtgcgccaagcgccacagggcccacaggccacatgtggcgcgtgcccaagcctcacaatgtgcaccttggccgcaggggtggggttgggggtggcgcaacgcaagcaatcccacgccttgagaatgcttcacctcttcctttctctgtgaaccacgagctttgaaaaattgtgtcgctgtttactacacggcttctgttcctccacatggccctttgctaacgtgcctccccgagaaatttgtctttttgtataaatgaccaagttttgtaaaatgtatttcctgaaataaatgtttccaatgcaggaacccca

SEQ ID NO: 562388 - DNA, 373 bp, Homo sapiens
gctggaaaaagaaggaagggcgggtcccagaagtcaggaaggagcacgtgaggagggtgtgtgggaagaatggaggtactgaggcagggttcagtggctcacacctgtaatcccagcactttggaggctgaggcaggagaatcacttaaacctgggaggcagaggctgcaacgagccgaaattgcaccactgcactccagccgtgactccgtctcaaaaaaaaaaaaaaaaaaaaggggttttcagtctccgaatatgggaagggtatcactctttttttttctttttcttttttctcttttttttttctttttttattcttttcttttctttcttttcttttcttttcctcttttcttttcttttcttttct

SEQ ID NO: 562389 - DNA, 876 bp, Homo sapiens
  misc_feature (874)..(874): n is a, c, g, or t
  misc_feature (876)..(876): n is a, c, g, or t
ggaaacctggcgcaatagatatagtaccgcaagggaacgatgaaaaattataaccaagcataatatagcaaggactaacccctataccttctgcataatgaattaactagaaataattgggcaaggagagccaaagttaagacccctgaaaccagaggagctaacttaagaacagttaaaagagcacacccggtctatgtagcaaaatagtgggaagatttataggtagaggcgaaaactaccgagctggtgatagctggtgtgtccaagatagaatcttagttcactttaaattgtgcccaaagaacctctaaatcccttgtgtaaatttaatgttagtccaaaagaggacacagctcttgggacacctaggaaaaaacctgtgtaagagagaagtaccaaactttaacacccatagtaggcctaaaagcagccaccatttacgaaagcgtcacgctcaaaaccagtacctaaaaaatcccaaaatataactgaatcctcacaccaatttggaccaatctatcaccctatagaagactaatgtagtataagtacatgaaaacattctcctcgataagcttggtcaaattacaacatgactgacaattaaagcaaatatctaaatcacaaaagtctaattaccctcatgaccaaacaggatgtcatagaagtacaaagtaagactcggaatctacccctgttacaaaatactctagtacagttaaggacgttgcagggaatgtagggggacaacggagaacaacagctaaaggacgtaggcagacggcacataaagaagccgaggggacagaagacagggtataagagaacaaccataacgagtgggaccgcgcaactcccctcacaactaaanan

SEQ ID NO: 562390 - DNA, 684 bp, Homo sapiens
  misc_feature (40)..(40): n is a, c, g, or t
  misc_feature (51)..(51): n is a, c, g, or t
  misc_feature (55)..(55): n is a, c, g, or t
  misc_feature (71)..(71): n is a, c, g, or t
  misc_feature (82)..(82): n is a, c, g, or t
  misc_feature (91)..(91): n is a, c, g, or t
  misc_feature (95)..(95): n is a, c, g, or t
  misc_feature (100)..(100): n is a, c, g, or t
  misc_feature (107)..(107): n is a, c, g, or t
  misc_feature (124)..(124): n is a, c, g, or t
  misc_feature (142)..(142): n is a, c, g, or t
  misc_feature (148)..(148): n is a, c, g, or t
  misc_feature (158)..(158): n is a, c, g, or t
  misc_feature (185)..(185): n is a, c, g, or t
  misc_feature (191)..(191): n is a, c, g, or t
  misc_feature (201)..(201): n is a, c, g, or t
  misc_feature (205)..(205): n is a, c, g, or t
  misc_feature (207)..(207): n is a, c, g, or t
  misc_feature (220)..(220): n is a, c, g, or t
  misc_feature (234)..(234): n is a, c, g, or t
  misc_feature (256)..(256): n is a, c, g, or t
  misc_feature (301)..(301): n is a, c, g, or t
  misc_feature (305)..(305): n is a, c, g, or t
  misc_feature (310)..(310): n is a, c, g, or t
  misc_feature (333)..(333): n is a, c, g, or t
  misc_feature (339)..(339): n is a, c, g, or t
  misc_feature (343)..(343): n is a, c, g, or t
  misc_feature (356)..(356): n is a, c, g, or t
  misc_feature (359)..(359): n is a, c, g, or t
  misc_feature (376)..(376): n is a, c, g, or t
  misc_feature (380)..(380): n is a, c, g, or t
  misc_feature (385)..(385): n is a, c, g, or t
  misc_feature (485)..(485): n is a, c, g, or t
  misc_feature (592)..(592): n is a, c, g, or t
  misc_feature (598)..(598): n is a, c, g, or t
  misc_feature (609)..(609): n is a, c, g, or t
  misc_feature (664)..(664): n is a, c, g, or t
tgggtttccggcgcgatttttgatccggcgtgatttttgnagcagcttccntttnatcacagcagccactntttcctggttnttcgttgtnggcncccantagatgntctccccgcgtcggaanttttttttcagccgtgtncaaatnttggccaggntgatcagcaccagcaggaaggtcaggnccatgntagcccaggnggcntnttcagttcgtggngtggggccccgggntgcccgtggaggcgctgctgcnaaggtgccggggaagcctgatttgaacagacaaagccccctgggntgcnttgcncgttgggacctgagctttttttntggagntggnattgtttcaaggngcncccggaagcagggaganagtnggcanagatggggcattactctccctaccagggattcccgccatggactgcttggccttcaagctccctggggaagcagagggaaacctcagggctgagcgagtnggctggggaccaagggcagcccgcagcctccgcctcttggcaccactagaagagggctgcctgggcccttgagatgtcacctctgtgccaggggggcgccagctccncagagnaaaggccaganccagggcctgcacacaccctcttcggcacaccttccgtctaccgggagttggctnggaggagcaggccctaaagg

SEQ ID NO: 562391 - DNA, 120 bp, Homo sapiens
cacgtcggtaccactgacagtgctagtgagcaggttaggaagcccattatctgtgttttctcagtcaacattttgtcaggtggaatgtgctaggctcaggactctcagagcttcccttcg

SEQ ID NO: 562392 - DNA, 103 bp, Homo sapiens
aagggaattcgtgctggtgctaagggaattcgtgctggtgctaagggaattcgtgggtgctgtgctgtgtgctaagtggaattcgtgcgtggtgctaagtgga

SEQ ID NO: 562393 - DNA, 1036 bp, Homo sapiens
  misc_feature (388)..(388): n is a, c, g, or t
  misc_feature (394)..(394): n is a, c, g, or t
  misc_feature (413)..(413): n is a, c, g, or t
  misc_feature (420)..(420): n is a, c, g, or t
  misc_feature (441)..(441): n is a, c, g, or t
  misc_feature (446)..(446): n is a, c, g, or t
  misc_feature (456)..(456): n is a, c, g, or t
  misc_feature (772)..(772): n is a, c, g, or t
  misc_feature (775)..(775): n is a, c, g, or t
  misc_feature (1017)..(1017): n is a, c, g, or t
ggaactagtctcgagtttttttttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtgccagtcctggtgggacgagatcgcgcgggtacaaatgcacttatgaatatcgtctctagaggtccacgttaagagtacaagcttatacagtgcaagggctctgaaggcactggaattggccaaacattcagaccctgtcttccaagagaaaccaagatcctggctacatcccagcctgtggntacagngcagacaggccatgtgagncacacgntgccagcacagagcgtccttnccccntgtagactantgccgtagggagtacctgctgccccaagctgactgtggccccctccgtaatccatccatctccagggagcaagacagagacccaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctttgatcttgtgctcagcatgattctttaatagaagttttattttttcgngcnctctgctaatcatgtgggtgagccagtggaacagcgggagacctgtgctagttttacagattgcctcctaatgacgcggctcaaaaggaaaccaagtggtcaggagttgtttttgaccccctgatttctactaccccaaggaaaatagtttaggagaaaccagcttttactgtttttgaaaaattacagcttccccctgtcaagttaacaaggaatgcctgtgccaataaaaggtttttccnacttgaagtctaaaaaaaa

SEQ ID NO: 562394 - DNA, 734 bp, Homo sapiens
  misc_feature (470)..(470): n is a, c, g, or t
  misc_feature (473)..(473): n is a, c, g, or t
  misc_feature (715)..(715): n is a, c, g, or t
ttaaaggggtccagcggggttataaggtacaaatggcgcattcaacactcttgtttccaaggaggccgaggtttggtaatatacacaccatgaggtgcaggtcaaacggtccatttatcctcaaatggcattataatggttctttccccaaaagaaaaataaataagaggtgcctccccccccattgaatagggcaccctcgttgatcaaccatctcaaggtacacaccatagactctgccatgcaaagagaagtccttaccaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctttgatcttgtgctcagcatgattctttaatagaagttttattttttcgngcnctctgctaatcatgtgggtgagccagtggaacagcgggagacctgtgctagttttacagattgcctcctaatgacgcggctcaaaaggaaaccaagtggtcaggagttgtttttgaccccctgatttctactaccccaaggaaaatagtttaggagaaaccagcttttactgtttttgaaaaattacagcttccccctgtcaagttaacaaggaatgcctgtgccaataaaaggtttttccnacttgaagtctaaaaaaaa

SEQ ID NO: 562395 - DNA, 802 bp, Homo sapiens
gggagaggagtgtgtgtgtgtgtgtgtgtgtgtgtgtgttgctctgtgtgtgcgtttatcttatcttgctcttttggtggtggctggtgcgaagggcgtggagtgctgctagcggcgcccaggcgcttgagactcggctgcgtacacgtacgtctacgatggatcctactgtggcgccgtaggaatggtgcccgtcgtgcatgcaaatgtggaagcacacgaccacgcaggaagggggttagcctgacgtgacacaacctccgatgctcccagaaatcatgtctcatgtgtgggtactgcgtcttccgaagagtgctccctcaggaaaaaggtgcaagtcgttctcctaatgtcggacgtcttccccacacccgcctggcggcagtccttctgggtgaacgtggctgcgcaggaggcccacaccccgtgggaggtccctgggtcggcgtccggacgccgttcctgctagccaacgttggctacgtgccctagcattgtcagtacgacctggtccagacggcccttccaaggcctcaggggggacgcacgccatgggtgagaggtgggacgccaccatcgttggcagacagtagtcagcgcaccctttgaggacgcatatatcataggggaccccctgaagctggtgggcagctttcagagcagatatacttcgaggaggagaaaaaaagcttgtgatggaaacaggtgccgcacttgccaagtgccttcccaggtggaagcccgtaagaactcaggttaaaacaggcttgcggaggctgaagcacgagtaggggaaccacct

SEQ ID NO: 562396 - DNA, 429 bp, Homo sapiens
aagggggacgtgtacctctccctcattcccggtaccaccgcgagggggagtggggggctacaaggggacggagagaagagtccagacgtcccacatcctgagggcgagtttcagcctcgtagagggcagcgaaagtaagtgcatggatcaggaaaatcttgcaatcggaaaacagcagcgtccccgtaatttcaatataggtacatttacctgaactcatcaccttcccacccccatcccatcgactctgtgctgtatcctgaaccggctgacagaacaatgatgtagacttgacttgttttcgccaacctggaatgaagcaaagctcttgtgcacccaagatctgctctctgttgtaaatcctgttcagacctggtctaattggtttgaataaataaagaaccggaatctttctcatccaaaaaaaaa

SEQ ID NO: 562397 - DNA, 266 bp, Homo sapiens
  misc_feature (247)..(247): n is a, c, g, or t
cccccccccccaaaaaggggggggggcccgagagaaagggggagccctttttttttttataagttcccccccaaaggcgcgggccaaaaaggaacccagggggtcggggttttttttccccccccctcttctctccccccaaagggaaaatagtttaggagaaaccagcttttactgtttttgaaaaattacagcttccccctgtcaagttaacaaggaatgcctgtgccaataaaaggtttttccnacttgaagtctaaaaaaaa

SEQ ID NO: 562398 - DNA, 316 bp, Homo sapiens
gagacggagttttgctcttgtcgcccaggagtgcagtggcgcaatctcagctcactgcaacctccacctcctgggttcaagcagtattcctgcctcagcctcccaaatagctgggattacagtcatgcaccactatgcttggctaatttttgtatttttagtagaggcggggtttcgccatgttggccaggatggtcttgaactcctggcctcaaatgatcagcatcctcggcctcccaaagtgctgggattacaggcatgaaaaaaaaaaaagctggcacgggcgcggtgagctcacgactgtaaaccatagcac

SEQ ID NO: 562399 - DNA, 337 bp, Homo sapiens
agcaaacccaggcacaagttggaggaggttgtggacatcatagctgtgtgaacgtgggacaaggtcctgtgagagggaccagaagctgtcagagctggatgaccgagctgatgccttcaggcagggagcatcacaatttgagagcagtctgccaagctaaagaggagtatttgttggaaaactgcaagatgatgatcatgctgggagccatctttgccatcatcgtggtagttattgtaagcagtatcgctgaagttgctggtgggtaagagtggaaggtcctggagtctttcctcctcctcctcctgggagtgggctgctctactaggatgagccc

SEQ ID NO: 562400 - DNA, 418 bp, Homo sapiens
  misc_feature (417)..(418): n is a, c, g, or t
gggggattgcttgagtccaggattgtgagaccagcctgggcaacatagcaggatcccatctcaatttaaaaaaaggagtaattcagaatatgaaaaaaaagtatgggaaaaggtcaataaagaaatagaagtatggccaggcatgttgcctgacacctgtgatcccagcactttgggaggctgaggtgggtggattacctgaggccaggagttcgagaccagcctggccaacatggtgaaaccctgtctctactaaaaatacaaaaaattagccaggcatggtgtgggtgcctgtaatcccagctactcgggaggctgagacgggagaggcacttgaacctgggaggcggaggttgcagtgagctgagactgcgccactgcactacagcctgggccacatagtgagactccatctcnn

SEQ ID NO: 562401 - DNA, 190 bp, Homo sapiens
acgactcctgaggatgcaccactgaccaccggaagcttaagtttgcttaaaccaaacccagcaacgcaaattcttagcatactcctcaactacccacatgggggggatcattacagctttaccgtccaaccctaacataaccattcttaattaaactatttatattatcctaactactaccgcattccta

SEQ ID NO: 562402 - DNA, 258 bp, Homo sapiens
aagggggacgtgtacctctccctcattcggtacatttacctgaactcatcaccttcccacccccatcccatcgactctgtgctgtatcctgaaccggctgacagaacaatgatgtagacttgacttgttttcgccaacctggaatgaagcaaagctcttgtgcacccaagatctgctctctgttgtaaatcctgttcagacctggtctaattggtttgaataaataaagaaccggaatctttctcatccaaaaaaaaa

SEQ ID NO: 562403 - DNA, 183 bp, Homo sapiens
cccctcctcggtcacttcactccacggacggccttttaggggtggataggaattccttccggcagcggtggtggccccttcccccagccccacccgggcctaattattagcatcatccctctactattttttaaccaaatcaacaacaacctatttagctgttcccagctggctcagaggggt

SEQ ID NO: 562404 - DNA, 993 bp, Homo sapiens
tgatgcgtgcgttgactttcggggtaatgattcagtgtctggcttgcgtacgatagtgggacgatcgggcggacgcgggggatcatcgcctgtaagcgtcagggccggtgggggagggcgaggtgggtggataacaagaaggtaaggagatggagaccatgctggctaacagggtgaaatcctgtctctactaaaaatacaaaaaaaaaaaaaaaagcaacagaaagaagtaagccggggcgctggatgagggggcgcagcccaattagcgcggccaggctacgccggagggatgggcggctgagacccctgggggggacacccagggaggtagaagccgatgaatgggacccgagattcgggacccctgggagcatgcagccgggggacaccggagagaagactccagccctcaaagggcggaacaatacacgggggggagaacaagcgagcgggtgaagattgccgagaccatgtgggtgtcccaatatggtcccaagaacatgaagggccctgacacgaggacacgtggggggggcagggcgcccataggaagaaggggccaccacaagattggcggcacacccactatattccacaaggggcccgatcatccccgaggggcacaaacccccaccgagatttgagacaacacaagaggaatggcccccgaaagaggaacaacggatgaacaagcgcaaccaggggggagcaacccactcatgtgtgcggggaacgccgcaagggggggtggcacaccaaaggcgcggggaggacacgtgggacaacgcgcgcgcggtgggattacccgcccggcgattgtttgtgccacaaccacacaggtgggtcccccagggcggaatagagattaggcccgcacaggtgaatatgccctatgggtggcccagcgacatggtgttgaccgacgacctaaggagagtgtggtcaacagcatgatgtccccgtgaataaagagacccttgagcgggcaac

SEQ ID NO: 562405 - DNA, 986 bp, Homo sapiens
taagtttggagggggaatgcgggaaatggtaaggggtatggaaacttgtcatataagtaaggctagggtgaggggtaggaagttttccataggaggtgtttgattgggccgaaccggaatcgggggtatgctgtcgaatcataaaaacagcgcggttacaagcggcgtctgggcgacacacatctgtgctgtcagagtccaggggagagtgcgtcatatgtggtctcctaggaagatggtcacgggtgaggctgtcattcatactacgcgtcggtgtctccggctatgaagaatagggcgaaggggcctgcgggtatccgatgtggaagcctgaaactagtcggatccccttccgcagggccaaagggcgtcccggtgggcctcggctaggtgtggggatacccctcatattcatgccccaaagggtccatgagggcacggagcactcagagggagtctggcgtccgccgataaggggggaaagcgtcacaaggcgccaaactcactaaccctgccgcgcatggcacaactgaagggcagggaggactgccacatgcacattgccgggggtagagcacccacatgccgcgacacagggaccaaacacacccgcgaccggaccacacgtacacaaaagcggtttgaagaaacggccacggccaaaaggcgccaaaaaagcacccggagcccaaagttggcgggtaccaggcggtagcaaactagaaacggactctaacaacaacacagcgaagtggtaaaacaacgcagtggggcaaaaaacagcgagcaacacacagcacgcggtaccgaagaactgcaagtacaacacgcagcggtcttacccccaccaccccactccccccccttacagagaagcaaacacagaacaacacagcgccacaaccaacaacaaaacagcgcgtgagaaacacaaacacgtataaaacaggacgacactacaaaagggctcaacagacccaataccc

SEQ ID NO: 562406 - DNA, 1098 bp, Homo sapiens
  misc_feature (552)..(552): n is a, c, g, or t
  misc_feature (563)..(563): n is a, c, g, or t
  misc_feature (591)..(591): n is a, c, g, or t
  misc_feature (1027)..(1027): n is a, c, g, or t
gcgtggggcaccgatgggagtgcacagtatctcgacgtaactgaggacacgttagtctgctgtgtgggatctctcgggactagagactgaaatgattgtaatcatagctcgggcgtatgctgcggttggaagattcggcgtactctgccagttagatgtcgcgacggttagatcgacccatagagataaagatcaattagtctatactccacgcagtaaccacagcacactgctctcatgtgtggtcgagagagcggtacgtagagcgcatccgggcgcaactccgcacgtgctctgctacagttcgagcacatcagtgtttgtgcgtgggtttacacgagcagcggcgccgaaaatgctgaccggaaggcatgtgtcagtcgcattgtatacagatgtgtgtgttgccactatacggacgctgatccctgggtcggtagctcaaagtatgcagcacgacgccggcggcagaggatcggtcgtgggagtctccagagacacgtcgaagtagaagaaagggagtggtggcgcgttggtggcttcgccattagngactccttggncgtactccggcggtcgcttttgtccatnggggccgggggcatctaaggtactacctgcggttatgccatgcttgcgcggccgtgcccgagacaacggcgaacatggcggtcacgcggttccgcctgttggttggttggctccgtttcgcgagaacccccttcctgcaagggaaatggaccgtaggtgctgctcatagacgttcctcctattcgcagcacgatttctcggtcgggaatttggcgggtctttgaagtcgaaacttctccagccagcgcggggagagggacccccctggattaacaactaaagcttaccggtattcgaaacagcggtggacttgctagagcgggcagcaatcaagttggttttggcgttccacaacaacccgagcgccggattagtttgcctttggagttggctagtaacacactgtggttgaatacagaataccacgtgcgctgancccaccctttgcgtgtgaaccccacaactactttggcgtaaaaacggaattcggagtccccataaaggaaa

SEQ ID NO: 562407 - DNA, 1545 bp, Homo sapiens
  misc_feature (1545)..(1545): n is a, c, g, or t
gaaaacaccaaatggcggatgacgccggtgcagcgggggggcccgggggccctggtaggccctgggatgggtaatcgcggtaggcttccgcggatgtatcggcagtaggcatccggggcctgggtgtacgctatcctgtaggacgagtgcctggaggccgaagctcacggagcttcgcggagggcgaaggcctgaggagtattggagctgggattgcccgtcagccaagtttgtggtccgcgatagtgtcaagagacatatggaagattcaaatgtactcctaggagtatgagtctaattcttctaagctaccctagctcccatttagatgggaacgtcgatattcgaacatatgtgattgggctgatccgaagggttgggcccttccttctacgatattgacgaagatcggttatttgggtcgtatatttgtaagcgcaagggtatgcggggataatgcgatagaagcccggatgcccaggccaaggcggccagccgaggggtttcaacagtgggcatttttttgtgtttgggctgttgtttctgcggcggcgatctgatagccatatttggggcgccaaccggttacggtaggtctatagtgggtttgtatttcacgtgtgtagggccatccctaggtggcgcagtggtatggggcccgagccgcggttccagttcgctggttggggtggcccctagtttctatttcccgctatgggtcgcaaaatggcttacgtatcccaatatcggttctcccccgtcatgctgcgaataggtttgtgaatgctagggggtttgatgtgcgaggaggcatcatcgtgttcagagggcgcccctgatcatcgattgaccccctaagaggctggggagaggaccacagatgccggccagtttgagccaaacaatgagggcgagttgaagccgcttccactggagcacccaagtccttgcccaaaggaaattcaaccattgggctgggaactggaccatgccttggctcacccggaaaaatctcaaggttaaggtcgaggcggttctgaggagtaggtgctatttagacagctaggaggggccgaggcgagatcgggccgaacaggtctcgccttgtggcaatccgggttaggttccagtgcgccgaagagtgagggcaggatctcttgtagcttttcggctagagagtcgcccggtctctgaatgaggagtaggagtcgtcggtatggtctagatctgaagtcgcataatagatgggtaaatgccatagagagcccccatgaacgctgaccaagcgaatggaagcacctagtgatgtatccagccccaaaaggtgacaccccctatatacaggtgaatgttatcactatgggacccagcccttccggttcagaaggagaccccagtagccaagggaaggttcttcccggtctggcagcgcggggaacttcaggggggcttcccaggcgcttgagtggggctaccgcggcttacgggcttctttgtatttcgctggaatactgcttatgtggtgtggctttctacggctgtggn

SEQ ID NO: 562408 - DNA, 496 bp, Homo sapiens
  misc_feature (28)..(28): n is a, c, g, or t
  misc_feature (65)..(65): n is a, c, g, or t
gaggatcccaggcgaccaggtctgagcncaagagataaatcatcatgttctctttccccaggttnttagtgtttaactggggagacaggcaagtaaacaaataattatcatccaggaagataaactctatactagagttgggcacaatatactacagggaagaatttctgaaagaggtggtattttttagctcagtcttgaagaccaaatgaaaactaattgggtgaagaaggtctggaatgagacaggattcccagagagtaaaatagcatgtagaaaggagtgatgagtatcagggagttagattgttttgttttacaactttcattttttccttttatgtcattgattgcaatctaaaaagatatatactgtttagtctgtttgtttacttcagtgttttaggagttggcaaaatacagctttcaggctgaatctggcttggttttgtatggctttagggttaaagacgggttttacattttttttttttttg

SEQ ID NO: 562409 - DNA, 301 bp, Homo sapiens
caagctcagctaagctttggggtaccaacgtcatcttcaggtgacctgaatctttcccttaaccgtacagtttctcgatggaattgtgtgatcagaaggtggaattctagtgataggcgacctcagacccagcattaatattctgtgtgacacttctattgcacatacaatgattattaagcattgtcaattactatttttactaaacccattgtaaataaatatataaaatcattaaaatacttgatgccttttttttttcatgatacacatttaaataaaataaaccttaacctgaaaa

SEQ ID NO: 562410 - DNA, 689 bp, Homo sapiens
  misc_feature (51)..(51): n is a, c, g, or t
  misc_feature (93)..(94): n is a, c, g, or t
  misc_feature (147)..(148): n is a, c, g, or t
  misc_feature (181)..(181): n is a, c, g, or t
  misc_feature (196)..(196): n is a, c, g, or t
  misc_feature (208)..(209): n is a, c, g, or t
  misc_feature (223)..(223): n is a, c, g, or t
  misc_feature (262)..(264): n is a, c, g, or t
  misc_feature (315)..(315): n is a, c, g, or t
  misc_feature (329)..(329): n is a, c, g, or t
  misc_feature (360)..(360): n is a, c, g, or t
  misc_feature (378)..(378): n is a, c, g, or t
  misc_feature (390)..(390): n is a, c, g, or t
  misc_feature (417)..(417): n is a, c, g, or t
  misc_feature (444)..(444): n is a, c, g, or t
  misc_feature (471)..(471): n is a, c, g, or t
  misc_feature (480)..(480): n is a, c, g, or t
  misc_feature (513)..(513): n is a, c, g, or t
  misc_feature (538)..(538): n is a, c, g, or t
  misc_feature (550)..(550): n is a, c, g, or t
  misc_feature (584)..(585): n is a, c, g, or t
  misc_feature (665)..(665): n is a, c, g, or t
cctggaccccccaatagtgaagggcagtatggtagtgggctaccccctggnggtaggttatgggaggtcctgcccctggagggccttatggannaccagctggtggagggccctatggacaccccaatcctgggatattcccctctnnaactccagaaggaccatatggcggtgcagctcncggggagcccctatngtcagccacctnnaagttcctacggtncccaacagcctgggctttatggacagggtggcgcccctnnnaatgtggatcctgaagcctactcctgattccaatcgatggactcagatcanaatggctatatctncataaagaaactaaaacaagccctggtcaantgcaattggtcttcattnaatgatgaaacntgcctcatgataataaacatgtttganaaaaccaaatcaggccacatcaatgtntacggcttctcagccctgtggaaattnatccagcantggaagaacctcttccagcagtatgaccgggancgctcgggctccattagctacacanagctgcagcaanctctgtcccaaatgggctacaacctgagcccccnnttcacccagcttctggtctcccgctactgcccacgctctgccaatcctgccatgcagcttgaccgcttcatccaggtgtncacccagctgcaggtgctgacaga

SEQ ID NO: 562411 - DNA, 227 bp, Homo sapiens
  misc_feature (141)..(141): n is a, c, g, or t
gctgctgaatagtttatatagagtctggtgaacttgaactagagaaagctgctaaaagtgatttggagagcatggcagggccttggaagaagggctaatagaagcaggtcccttgcccagaccctcagtgagccctttggntggatagcggacacctgaggcaggagtgtggcagggcccaagtccaggcaggcagcagcagggctgcaattgagagctgaggctgg

SEQ ID NO: 562412 - DNA, 128 bp, Homo sapiens
ccagtctcggcttccaaagtgctgggattacaagttgagcaacacacccagcaaaataaccacagtggagagatctggaaaatcaccttaaacaagtgatccaactttgcattatgagccaccttggt

SEQ ID NO: 562413 - DNA, 407 bp, Homo sapiens
  misc_feature (13)..(13): n is a, c, g, or t
  misc_feature (23)..(23): n is a, c, g, or t
  misc_feature (25)..(25): n is a, c, g, or t
  misc_feature (69)..(69): n is a, c, g, or t
  misc_feature (80)..(80): n is a, c, g, or t
  misc_feature (89)..(89): n is a, c, g, or t
  misc_feature (297)..(297): n is a, c, g, or t
  misc_feature (340)..(340): n is a, c, g, or t
  misc_feature (358)..(358): n is a, c, g, or t
gaggggtgtgggncctgcgggantnttttccttctggccttctgggagctggtggggagatcactgtcntgtgtgcaggnctcagagcntgctttctgatgacgaggtgcccctcgggaatagggggacagttcttaaaacaccaggcagaggctcagcagaggatctgtccctggaggaagaggctcgattctccagccagcagcccccagcccagctgagccacaggcacagaggggcccgctgttgtggccagagagaggccctccagctccccggcatcaggagatggcgtcntcggcccttcctttcggcctggtcccaggtgcccgtgaacttngaggacgtggctgtatanctttcttggggaggagccaagatgcattggacccagctcagcggggacg

SEQ ID NO: 562414 - DNA, 307 bp, Homo sapiens
cccccgattttgagaacctccatatggtatcaaaagggagtttaaagcgcttgaatttctatcaggggaggagatggggcgggaccgagacccggctcccggctgtgtgtggagctgatggcttctgcatccctcctccccacgcctagattctgtgaggagttggaactcctctctgcttaagcataaccctgtcgtttaaaggtgagatcaacctacccaaagactactgcagcactgacttggatctggacactgagtttgagatcctcttgccacgccgacggggcctgggcacggaagatca

SEQ ID NO: 562415 - DNA, 322 bp, Homo sapiens
tacattaaagtgcggtctgggggggtcctgtcctggaagtcacagacaacgcagtttttaaacgcccaggagctgctcagcccctccccatcaagaggaggcccagtggccaggggctatggcagtcacaggcacagactctgaggcttggaagtcactgaggatatggaaactaccagttaggcagatgaagaggatgctcctaagtaaagatttttatttaatatgttagttgatggtcagcaagcacacaaacgaagactcacgactccaattatgcaaattcatgactattgtttctaatctgatctgaaaagagaca

SEQ ID NO: 562416 - DNA, 187 bp, Homo sapiens
ttcattagaggatcccccagcactgatctttcagccccagtattgcgaggccacatacagaagggggagagcgcagaggacaatggagcactgatggcgggtcgtggactcgtgaggatggtggccaatggtgttggctcgctctgaatgaccctgcactgacagctgtactgggagtggtccctga

SEQ ID NO: 562417 - DNA, 902 bp, Homo sapiens
tgttggtgataatattgccggcgggcgttctgaatagtttcttcgtagtaattcgtgtattacgtattgcgcccttttatagagacctttggaggaaaccgtttcgccattaacgagtgttggaagacaacaattgttggggaaaactcttggtggaaacttccgattgtaggacgttatctcttgtccgcaaagaaaacacttttctgggcagacaagacataacccattggggactcatggactatactcctgcgtccccgactttgtcattattttttccccacacttggggtcacgacagtttattggccctttaggtcctccacgggtcaaaataagtggttgcagtccaggtatgtcattttgtgacgccgcaaattcttgtgttgttggcccccttggagcccccatgtgcaaatagtcgactgttgtcgtgccgctctcatcgtgtatgatcactatccgggagatgttatcaaatgtgcacggaataattgtcggataatgttctcccacatgatagaatatattccctcggtctgcggagtgtgttaacaacataccatttgacctattgggcgggagggattgaaaaacactccgtagattagcaaaggagaaaaagttaatccaaagggatatgagtggttctcgacaatgtaccaagccgtgccgagcgcctaatattatcctcacgccaaaaagatttccgtgcccgaaccgcgccggtgcccaacccccggaggggcccttcacatcagattagtggagtgcccacagactggcatatttatagggagagatgactctcttttctcccaacggtcggaagaaaaacgggcaccacccccttacaccatgagacaccgttaccggaaaaggggaaccccagaggggga

SEQ ID NO: 562418 - DNA, 402 bp, Homo sapiens
  misc_feature (394)..(394): n is a, c, g, or t
  misc_feature (396)..(396): n is a, c, g, or t
atgcctaaaaaatagataatagaatattaacgattttatgcccagtaaacttttaagtttaatggacagatttccttgaaagctcactcaacaaaaaataggcaaccctggcccaggcgtggtagcctcacatctgtaatccccagcacttttgggaggccgaagcaggtggatcacctgagatcagcagttcaagaccagcctggccaacatggtgaaaccccagctctactaaaaaaaatacaaaaattagctgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctnancaaaaa

SEQ ID NO: 562419 - DNA, 150 bp, Homo sapiens
gactctccaggatctttgtcatccccttcgtgaggaggtgatgtgggtgatgctggagctcagatctgaagggaagaaggagcagcacatatagaagtgagggagggggcttagggcaaagggaaacaggaaggggagaaggccctgaag

SEQ ID NO: 562420 - DNA, 2128 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtgagcagcatttccagttcctcctgcacctgccgtgagccgtggccctggtgggcaccgacggcccctccgcccggctgtctgtgttcacagatggtctcgtttcccatggtggtgtcggggaaatgacgaaaaatcaggtttcccggcagcacagagaacccttccacaaaagtagaagggaaagcaaatagttttactaaagaagcagcttcaaaccagaccgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 562421 - DNA, 945 bp, Homo sapiens
atgaagagagcaaacaaatcaagtaccaacctagaggctttatttttgaattgattcatggtgtgtgtgtgtgtgtgtgtgtgtgtgtgtgtgtgtcgacacagaaacagatcacaaaataggggagattgagtgatgaagaaagtatatatcaccatataggataaaaatagcaaagaagagtgtgtctcctattatcgcacatatatgtgatcgtgagtagaaaacaaacagagatatcagtcgtgcgaagtagagtataataagagagagaatagtgtgtgcgcacagggtgctatgagtttttttctcaaatagacataatattatttgatagtaagaaatatatatatgagtctcctctcagggtcgtgcgacaatgttcacatgatatttctcagtggggagaggtgtacaaacaaccattatgccctcttctctcctcttgttgatgactctaatatatcccacaagtcaattctgtgagtctatagtatttcttacacttctatgaagagaatgtggggtccacagaggagtgaacaatatttgagagagatgtgtacgatttgtcagcgagagggcgtcacactatgaagcaaacgctcctggtgagacacaaactactgagaggggggatatcgggaaaatgagagagtactaccggagagacccgcaattctcccaagtcgaacaacctatctctgatcttacaacagcgctggaaggggtccccaagaggggccaggagggaaaccccccatcattgtttagaggatccaagccggcatatcgaaaaagggttgaacaagatcaagaacagaaagagaagtcacagagtaggcacaaccgcggatgggatccagatctaccaaaacaaaacaaactcgcccacaaatcaaggggcacagaagaagcacagcaagcacagaaagaaaggtaaac

SEQ ID NO: 562422 - DNA, 328 bp, Homo sapiens
  misc_feature (38)..(38): n is a, c, g, or t
  misc_feature (261)..(261): n is a, c, g, or t
  misc_feature (300)..(300): n is a, c, g, or t
  misc_feature (306)..(306): n is a, c, g, or t
ccggccaacacagcgaaaccccgtctccaccaaaaaantacgaaaaccagtcaggcatggtggcgcgcgcctgcaatcgcaggcactcggcaggctgaggcaggagaatcaggcagggaggctgcagtgagccgagatggcagcagtacagtccagcttcggctcggcatcagtgggagaccgtggaaagagagggagagggagaccgtggggagagggagaccgtggggagagggagagggagagggagagggctttttnaccatttttaaacagggttattttgttttcttactattnaagttnagttcctttttataatttttag

SEQ ID NO: 562423 - DNA, 1442 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccacagttcaggaggtggacgtgatccctgaggacggggcggccgacgtgagggtcatcatcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttactt

SEQ ID NO: 562424 - DNA, 137 bp, Homo sapiens
acagagcctgctactcctctgtcagggtctgctgcattaaaactagacagtcagagaagtcagacgtgttgaggggctcgggctctgggcccaccacctcatcgatcagagggaggcccagtccttgcctgggccca

SEQ ID NO: 562425 - DNA, 291 bp, Homo sapiens
atgcgacttctgacaaccaagattttgttcctgctgactttgtctgcactatggaccattgtcctctcgcccactcaataagtcttgagtcatacaaaataatgaaaatctttgaaacatttaatatatattttttaacattttaaagattaacagattgtattcctttcaaggtgctatacttgcttaagcaatcttgatttgagtggggggcctcgattcgcgctattatgctctgttaggtgggacatgaatatactaaagctttttttttttttttaccacctcttt

SEQ ID NO: 562426 - DNA, 1484 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggccacgcgggacgctgcctcagcattgacgtcctgtcgtggaaccatgggttctttccagttgcgaaggccactcggtctttcgcaccggaagtggccctcggctctccctttgccgttagggagctaggccaccccaggggggacccagcaaatacgcgcaggcacagcgcatgacggaaatgccgccgccctggcaacgcaggcgaggcaacaacgggaccgacgtgcgggataaccccgagagaagcggcacatcgtcagagcaccaaccaaagaccgacggcgagagggaacacacatgtagcccgctgagagacagtgaaaaggagacaacaacagagtcgggtcgttggtgcccgctcgcggtcatagccaa

SEQ ID NO: 562427 - DNA, 1582 bp, Homo sapiens
  misc_feature (96)..(96): n is a, c, g, or t
  misc_feature (1480)..(1480): n is a, c, g, or t
  misc_feature (1486)..(1486): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggtgagcacgcgcccaggggaggggccttccgcggtctccgtgtcaccggtgaggactcgcccgggggagggcagggggtccctgtcgtctcagtggtgccgtacgacagctgcggtgagcacgtgcccaggagagggggttcccatggtcgccgtgtggggtacaccagctgctgtgagagctcacccaggagacgggtttcctgtggtctctgtgtggggtacagcagccaaggtgaggatgtcatctaccccatcctcccatccagagctttaccaccctgtctataccacaacctcccctccatctacaccatcctcctgtctagaccatccccactgccctatctataccaccaccctgtctacacaatccacccatctacaccatcacctctcctctgtctataccatcctcctgtctacaccagcaccactaccccatctataccaccacnccgtcnacataatccacccgtgtacaccacaatgtccccttcgtctgcaccgtcctcctgtctacactgcaccacatgccccatctataccacacccacccc

SEQ ID NO: 562428 - DNA, 1416 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtgagcagcatttccagttcctcctgcacctgccgtgagccgtggccctggtgggcaccgacggcccctccgcccggctgtctgtgttcacagatggtctcgtttcccatggtggtgtcggggaaatgacgaaaaatcaggtttcccggcagcacagagaacccttccacaaaagtagaagggaaagcaaatagttttactaaagaagcagcttcaaaccagaccgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 562429 - DNA, 642 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttactt

SEQ ID NO: 562430 - DNA, 403 bp, Homo sapiens
  misc_feature (4)..(4): n is a, c, g, or t
  misc_feature (359)..(359): n is a, c, g, or t
tgangtataaagaaaaagaggtttaatggactcacagttccacatggctggggaggcctcacaaacatggcagaagacaaaaggcacatcttacatggcagcagacaagagagaatgagggaacccagtgaaaagggtttccccttataaaaccatcagatctctcaggaggacttattcactaacagaaaagtattggggaaactgccgccatgattcaattaactacccccaggtccctctcacaacacatgagaatcatgtgaactacagttcaatatgagatttgggtggggaaacagccaaatcatatcattccaactctggcccctcccaaatcttatgtcctcacatttcanaaccccacatgccttcccaacagtcccttaaagtcttaacttat

SEQ ID NO: 562431 - DNA, 629 bp, Homo sapiens
  misc_feature (96)..(96): n is a, c, g, or t
  misc_feature (554)..(554): n is a, c, g, or t
  misc_feature (589)..(589): n is a, c, g, or t
  misc_feature (618)..(618): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgaggtgaccgcggcagggctttcgggggagaaacaggagctggagacctgggggcggggctctgaggggagggggctcataggtggagattcaggggcggngctctgaagggacgatctcataggtggagattcangggcggggttctgtggggagaactcatangtggaggcgca

SEQ ID NO: 562432 - DNA, 123 bp, Homo sapiens
cacattggtgtcttatgggacgaggctggatcctgcgttgtcatggctgtggcataggccagcagctacagctccaattggacccctagcctgggaacctccatatgccacggatgtggccct

SEQ ID NO: 562433 - DNA, 172 bp, Homo sapiens
tgagcccgggatgttttatttggaatgtgaaaagtctgccagtttctgagcaaaaacttcaatttcaaaataaaggcatccagggctcaatggcatccagaggctcaatgcatagagccccttgatgtggggaggggtgtttaaggggttggctagggtataattgtctggg

SEQ ID NO: 562434 - DNA, 632 bp, Homo sapiens
  misc_feature (132)..(132): n is a, c, g, or t
  misc_feature (310)..(310): n is a, c, g, or t
cttcctgaaggacatgtgggctgtgtgtctagtaagggatgcacatgcagtggtcagtgtgccaggtgtatggttggtgtctgggaagagcctagctggttgtggcctcttcctcggtatctaggtcttcanacatcttggatcccgtctcgtatggctgtgatggaatctgaaatgaaggtttgacaaggaccagtgatggactcattgaggaagtggagggctatgcggaccagacctagtgagtggatgggtgacccgagaggccccgaggttaagcggggtaggggtttgccaggagggctgaggntgagaatactgggaaacataggtgatcgtcagggctcaggatagagaatgacgtcattgtctattgagcacggcgatttgggagcagtttggagcctgccagctcttgaaccaccgctaagagcgccatggtctccgtgaatcaaggtggcattaacgtgtggaggggcttgtggcgttggcagtcttgatggaggtttgatcgaataggggtaacaatggatttgagagttgcattctgatagtcgtggtgaacatgggatatatccaagtggaattaaagggttaatttcaatatcgtaatttcttccaagtacctggtg

SEQ ID NO: 562435 - DNA, 316 bp, Homo sapiens
  misc_feature (3)..(3): n is a, c, g, or t
  misc_feature (48)..(48): n is a, c, g, or t
  misc_feature (225)..(225): n is a, c, g, or t
  misc_feature (273)..(273): n is a, c, g, or t
tanacactgtctttaggactgtggatagaaggagcttaggaatatttnttccaagctctccattttatttattgagacaggtcggacatgtcacctaggctggagtacagtggtgcgaacacggctcactgcagcctcgatctcctaggctcaagccatcccctcacctcagctccccaagcagctgggactacaggtgtgcgccaccacagcaggctaattttngtatttttttttggtagagctggggtttcaccatgttgcccaggctgntctcaaactcctgagctcaagagatcctcccagcccgtgccgg

SEQ ID NO: 562436 - DNA, 928 bp, Homo sapiens
gagcggggggtcgggccggggcgggacgatgcaggtgacgtgagggcgcaaggtgacgaggacatggggcccgtcagccccgctgttcgcggtctaagtcgccgacccgtggctctatgcctgtccgtctgcctcgcctgttgcgtgcgcggatgtattgctgggtgcattctgtcgcgcagcatgcccgggcctgttcggagacgtcctgtggccggtgaggagctcccggtcggcggacggagggccccgggtgtcggcgccatgtggctggagctatgatggtgcgcgctaaccacgcgttcatccgaggaactcttgcgctgcgcgtgctcggtctgggatacccaggatcctcgatcgaatggaagcttcctccgagcggcatgatctcgcgcgtgatccactgcattgagcgttgcctagtgaagtatcctgggcaagtagcaagactgtaacacactggtaggctttgacagacttgctactgttgtggtgagcaggcatactggcagtgccgatccacccatggcgagctgcttgggtggctgggcggttctcgcggaggagcgcgtgggctagcggcacgcgacccgccgaacgacctagggttcgtcgcccattcctgcattcgctttgccctgtgtgagttatcgtagaatgtggatggccccttggctttggtttggcgtagaacacgtgtctggcacggttttctgttggctatcgcaaagagaacgctggccattgggaacctaagtgggttagcacagaagtttccaaacgccccgcgaagggctattctaagaggatgcgccactatggatgcgtccattgccaaagcctcctcacgaaggggccgcgttcgatccgtggccaatggcgtcttggagtcatttgcttctattaccctttgtatgggctcacg

SEQ ID NO: 562437 - DNA, 152 bp, Homo sapiens
ctaccacgaacacgtttgatgttaggtccgcttggcatttcgggcaattccttgcctctagaacggccggggtcgggcttccaatccgtcctagtccactcaagtgcggcattccacgaggattcatcaaggtccagagcttcatcctgagg

SEQ ID NO: 562438 - DNA, 429 bp, Homo sapiens
  misc_feature (288)..(288): n is a, c, g, or t
gcccaccttcttgtcatgaaggccatgcagtctttcaagtcccgaggctcgtgaaggaccggtttgccgggagacatttctactgggcccttaccaatgagggtatccggtatctccgtgattaccttcatctgcccccggagattgggcctgcccccctacgccgtagccgtccagagactggcaggcctcggcctaaaggtttggagggtgagcgccctgcgagactcccaagaggggaagctgacagagatacctccagacggagtgctgtcccccctggtgccnccaaaaaaaccaaggctggggctgggtcagcacccgaattccagtttagaggcggatttggtcgtggacggggtcaccccccccggtaaaattggaggggattcttttgcattgaataaacttccagcccaaaacccttta

SEQ ID NO: 562439 - DNA, 1571 bp, Homo sapiens
  misc_feature (975)..(976): n is a, c, g, or t
  misc_feature (1274)..(1274): n is a, c, g, or t
tagcacgctggtgccgaaatgagctggcggagatgaatgacttgtactggagcgagatgaacaccacaacaacgagagtggtgtgtcatacacccgccagcagagagtggtcctcggctggggtgggcctccgcgagacagcacgcccgacggtggttgcgcaggagagcgacatataattcccctgggggagaaagtggtggtgtggcaaagacacaccaaacagcaaccatcccccggggcttcgccggggggagtgagtggaccccgcccgcccgactaataggtggaaacaccagagtaggacccttctttttgcgggtgcgggtggggcatctcctcttcttggacgaacgcgcgcgttgttgggccaccaagggctcacaactcaaggagagaaacacacaccaggggcccctgtgggtggagaaatagtgtggtttcgcgcggtcgtgatgaacacaaactgtgtgcgggcacgacccacaaagagtgggtgcccaactgttgtgtccccaacgatgccaacccttggagcgcggggggagccaacggaattagccttctgtccgttgtgggggaggagacccacggagaaggtgggggtgtgcctaaaaccaaaaaaaggggggtttaattcccggctcccctcggccaagacatttacagacggtttggggttccttgtcttatgtgcataaattctttccctgcttgttctcggggaagatccccggcccttgcgcccaacaaaaacacacgagggcgctaatttgaataagccacagtgttatgaccacggggtgaccccacaggtaaaaggcgtgtggagaaatttgggggctctcaaggtaatactgtgtgagagggtgtttgcctttgcctcttattgccccccacagcttttccgggttttctcagagactctctcggagctatgtctgggcacacactcttcacacacaacaactcttnntagagagtatctgttggccgcgtgtgcctgtttctacaacgtgagagttttcgcctgaggaggacacaaagggacgcacccggaatatttcttctccacatgggcgctatattgagaagagaccacacagatgggcgctcggttaatctataatcgcgggggtgttaaaggggggaatatatctcttagaatagaacacctgtgagagcccacgcacaacgagattaacaagaagattttgagagaaaatgcgtttctttgttctcacatgttccgtcacagccacgcacccacaagncctttgtgtgggcgacacataatacacaggggctagagatggagaaagagatttctagaaccaatccagatagccaaagactgaaagaaagattagtcacaccaaatattcttaggcgtggatattagaagcgttaaacatcctgtggagtatcacacataccaaataacaccagttccagttgttcgtgccattgtttcttatgtataaattagttccacatttgtaaaaaggttatctttcataactccttatgtacagaaatcacatgtaccacccaaggttccataaatgcca

SEQ ID NO: 562440 - DNA, 102 bp, Homo sapiens
taaggatccctcatgtatggggcggtacctcacagcataatcagcagacacatgactagtctgagagactctcggcgatggcatacgactatctgaagcagc

SEQ ID NO: 562441 - DNA, 537 bp, Homo sapiens
tggactaatacagtgagctaatacctaaatgaccttcatgaattttgttgaaagaaacggcttggaaactatctgatcagcatgagatttgtcactcagtcatctcagtcactttcctggatcaatatttgtattttgaatttgctgttagtgtgcagaggctgcacctccatcccaagtgcatctgaaggcagttccctctgaccaacgaacacatgtggaagttgagaatctagaaaatgactcccttaaaactattcatgtccctggaaggtcttcccatatccccaacaacatgcattctcatttgaagaccactgactattccacagcataaatcagccaacatgatttgttgagtgatcatgaagtgatgtagatttcagatatcaccagccccacccactgggattcaagctgaccactcattaaatgtcctctttgattcactttacctttccctgtggaagaacttgtttaggcccgtttactaaatcctgatgtaagtcaacaccaaattagagaaaatcacacttt

SEQ ID NO: 562442 - DNA, 170 bp, Homo sapiens
  misc_feature (2)..(2): n is a, c, g, or t
anggtatatgcaggctcctgtgatcccccatgtcctcaccaacatggggtcttgacacgtcattttattcttcgctactttgataggtgataaatgagtctctctgatgtctcttgatgcattcccttggggtattattgaggttatcatcatgtattcgttggctggaa

SEQ ID NO: 562443 - DNA, 134 bp, Homo sapiens
tggtgacccgctacttcgaccagcacccggacatcctgccatgccatgtgctgaccgtgcaggccaagggcatcgcgtgggtggtggcttgaactgacattacggaatgaacaatggaacccgcttgcggcact

SEQ ID NO: 562444 - DNA, 883 bp, Homo sapiens
  misc_feature (36)..(36): n is a, c, g, or t
  misc_feature (95)..(95): n is a, c, g, or t
  misc_feature (153)..(153): n is a, c, g, or t
  misc_feature (176)..(176): n is a, c, g, or t
  misc_feature (185)..(185): n is a, c, g, or t
  misc_feature (187)..(188): n is a, c, g, or t
  misc_feature (200)..(200): n is a, c, g, or t
  misc_feature (232)..(232): n is a, c, g, or t
  misc_feature (236)..(237): n is a, c, g, or t
  misc_feature (243)..(244): n is a, c, g, or t
  misc_feature (252)..(252): n is a, c, g, or t
  misc_feature (255)..(255): n is a, c, g, or t
  misc_feature (264)..(265): n is a, c, g, or t
  misc_feature (273)..(274): n is a, c, g, or t
  misc_feature (292)..(292): n is a, c, g, or t
  misc_feature (295)..(295): n is a, c, g, or t
  misc_feature (306)..(306): n is a, c, g, or t
  misc_feature (326)..(326): n is a, c, g, or t
  misc_feature (330)..(330): n is a, c, g, or t
  misc_feature (332)..(334): n is a, c, g, or t
  misc_feature (339)..(339): n is a, c, g, or t
  misc_feature (379)..(379): n is a, c, g, or t
  misc_feature (384)..(384): n is a, c, g, or t
  misc_feature (394)..(394): n is a, c, g, or t
  misc_feature (399)..(400): n is a, c, g, or t
  misc_feature (403)..(403): n is a, c, g, or t
  misc_feature (407)..(407): n is a, c, g, or t
  misc_feature (412)..(412): n is a, c, g, or t
  misc_feature (414)..(414): n is a, c, g, or t
  misc_feature (421)..(421): n is a, c, g, or t
  misc_feature (429)..(429): n is a, c, g, or t
  misc_feature (438)..(439): n is a, c, g, or t
  misc_feature (446)..(448): n is a, c, g, or t
  misc_feature (456)..(456): n is a, c, g, or t
  misc_feature (459)..(459): n is a, c, g, or t
  misc_feature (466)..(469): n is a, c, g, or t
  misc_feature (487)..(487): n is a, c, g, or t
  misc_feature (489)..(492): n is a, c, g, or t
  misc_feature (495)..(496): n is a, c, g, or t
  misc_feature (510)..(511): n is a, c, g, or t
  misc_feature (515)..(515): n is a, c, g, or t
  misc_feature (518)..(518): n is a, c, g, or t
  misc_feature (520)..(520): n is a, c, g, or t
  misc_feature (567)..(567): n is a, c, g, or t
  misc_feature (589)..(589): n is a, c, g, or t
  misc_feature (594)..(594): n is a, c, g, or t
  misc_feature (607)..(607): n is a, c, g, or t
  misc_feature (615)..(615): n is a, c, g, or t
  misc_feature (697)..(697): n is a, c, g, or t
  misc_feature (719)..(719): n is a, c, g, or t
  misc_feature (731)..(732): n is a, c, g, or t
  misc_feature (754)..(754): n is a, c, g, or t
  misc_feature (817)..(817): n is a, c, g, or t
  misc_feature (866)..(866): n is a, c, g, or t
ccaggaaaaaggacggaggggaaaaacgaagaacgnaaaacggccacacgcaaaaaagaaaaccaaagggggccacaaaacaggcgccgggccgncggaaggggggacgaggcagggggagcaggaaccaggcggggacgacgaaacggaaanggccaagggaaacaaacagggcngagaccggncnnccaccacggagnaagagggggggggcagggaggagggagaagangcanngagccnncggagcgngcngggcagacnngggggccnngccagcgccagcagccgncgnggccacggcgnggaggacacccaccgcaacnggcngnnncagancacgaacagcaaagcgacccaaagggggggaggcggagangcgcncaacacacangggcnngcnaggnaccanancaacaanggcagcancaccagacnncaagaannnagggccancgnccagcgnnnnaccagaacggcgggcaancnnnnccnncagcgcagcaaacnngcangcnangggagcgggggggcaagccaagacaggggcagagccggcgcggaggnggccgggagggggcaggagaancaccngagcagtgaagcnagcggcgnccagtggtgggtcatttttgctgtcaccagcaacgttgccacgacgaacatccttgacagacacattcttgacattgaagcncacattgtccccaggaagagcntcactcaaagcnncatggtgcatttcgacagattntacttccgttgtaacgttgactggagcgaaggtgacaccataccgggtttgagaacaccagtntccactcggccaacaggaacagtaccaataccaccaattttgtagacancctggagaggcaggcgc

SEQ ID NO: 562445 - DNA, 2074 bp, Homo sapiens
  misc_feature (1309)..(1309): n is a, c, g, or t
ggcaagcgttgtcgtgcggagcttagcacaccgtccgagtcctaacaatggcgtgcagatatgcgtacctatacggactcaatattagacgacttcgtacgctccctttggtacccatagattgcgcggcaaggtgcagcgcagcgtacgtgggcctagtcatgaatcgtaagtagagagttgcgagtggacgactccgaggacaaggaagccagttagacataacatttggacgaatagggagggctagctgtggactgagaaccgggctcgcttcatacgtactagccttgggatcattctgcgtaaattgacttgcactaagcgttgaagccgctcgaagcgataggtttactcgtaacgcaagtattgcagtaattcttcacgtctagatcgccagacaataaatcggagggagcgccagggctacagggtaccgtagttggtcggaactttaattccactatgtaatagccgaccacaaatgcgggagggacttacgaaagcaccattaaaatatttctatacgcaaatagcttatttgtaattttgagccattgggagagaaggaaatatttctaaggtgtgcgttggaaagcatagggtaaacgttgagtacaccagtggagctatcggttttgggcatagatggtgggattggcgttaagggttggaaaatttttaagcaaaagacggtagggagttatgtcttacacgggatcggaatataggggtgtgcgcaaccgccacgcgccgttcaacgccaatgccgaagttgaccaccacgctaggcttttgtgtgctgggtctgaagtcagcaggacatatgggcgggtttgtttgtaagcaaacgggaagcccaatagagcattttggggtcacggacgtgattggttttgcaaacttggacacgaccagatggtggcaataatctcctgacacaggtggtgaagaaccggaacaccgcacgtaaagtgaggggccgcagtgggaaaaagacacaacgaacttatcttagtaatcgcgcgacgccacaggttgtggattctggacccttggtcggcagatccgaattcccccggttccaagtgtggttcaaccaccaatgtacaaaccggaaacaaacgcagtatttggtgggtctataaacacaacccctctgcggtataaactcccaccgccataaaggacaccaatgtataaaggggtatgatccgcaaggcagtttcaacgataggggcattagtggtaaacaatgtgcggatgtaacataaacacaatataacggataggaagtgcccccatatgngatgagacctatataggcgagactgaggcccaatcgggggggtgtcccaccaggggagccgagctgggcaacataagatgtttaacctggccattatgaaagtgtgactgtgtgagctacaagtgtggtcccaagcagagcttaccctccagcgcttgtgctactgataaaggtgctcgatcgtagcaacacgtagaagattgctctattaacagaccatgagtactcattcgcgacatagtgttagcaaccagcgatctcgatgatgggcccgtcgagtgatatatgacacgaggagaaagtggctcagcccacaacaacagagagcaggcgcgagatcatgagcgacacggtgctccacagagagagaggccacgccagtggtcgaaccgaggcggatgtctacacaagaccacacggagacacggggcgtgacaccgcatctcaagcagcgaggcaccgacacccacccagccggagcctagcaaccagcggtgtcggccgacacgagacacaaaacaccgcggcgcacgtagcaagcgcctacactgcgggagagagagcagagatgtagacagcaaaagacagactagatgagacagagcagagagcaaccgacagcaggagacacaccgcgacagcaagagagcagacggagcactaaccggcacgctacaccagcagaaaccgacagacaaggagaggagagcagaagcgagagaaggaagaaacgaagcaggagcacacgcgcagcgaagagagcac

SEQ ID NO: 562446 - DNA, 279 bp, Homo sapiens
ctcatagtccctgggacatccattcaattaccaagacaagatggcacaatttcaaacactattactccaagttcaaaatatgatatttagaaaagaaattgtaggctatgtcaaaacggcaacagtctttagaaaaactccgtcttctaaagagattctatccaaacaaaaaggtagtaactgaatcatattttctcatccattaaaccccaagccagagaacttgccctactaatttattcatattgctggaattttctccaacagtataaatgctgg

SEQ ID NO: 562447 - DNA, 152 bp, Homo sapiens
  misc_feature (122)..(122): n is a, c, g, or t
tctggtcctcctaggagcggccgcctgcgcgcgccgccccgtggtcggatcctgggcggcagagaggccgaggcgcacggcggccctacatggcgtcggtgcagcacgtgctcttgccagtnctggaccgcgccacctgcaaccggcgcacg

SEQ ID NO: 562448 - DNA, 241 bp, Homo sapiens
  misc_feature (39)..(39): n is a, c, g, or t
ccacgcatggccagccaatgccgcatgcaggtcccagcntttcccggcagcaagcaggtccatcgcatccttcatggtggccagtccctcccttgcaagcaggttgctgcatgcatgttgctgcccgagggcaacccaattgttcttgagcactgcggtggtcaaagcagtcagtgtgctggagccacagcagtcaagcgtctcgtggcacaggtcttcaccacagccttggcgttgttgg

SEQ ID NO: 562449 - DNA, 436 bp, Homo sapiens
agaggatccccagattgtgaaataggtaggtatatatgaggtaaatgaaatattctgatacagacatgcaatgagttaacaatcacatcagggtaaatggcatatgcatccccttaagcatttattctttgtattacaaacaatccaattatactctattagttatttttaatgtacaataaattattgttgactgtagtcaccttgtgctatcaaatattagatcttattcattccatctaattatacttttgtacccattaaccatccccacttctgccctgtccttaccccctctgccactattcttctcagcctctgataaccatctttctactctgtatctccatgagctcaattgttttaatttcgagctcccacaaacaagtaagaacatgcaaaatttgtctttctgtacctacctatttcacaatcg

SEQ ID NO: 562450 - DNA, 491 bp, Homo sapiens
caatccgaatcagaagagctgacaattgctggaatgaccttaataactttgatgtttggagcggaacgagaaagacagtcgcgtttgaaaatatatctcccagcatttagtgggattgtatttatggtggactgtgcagatcattctcgactcgtggaatacaaagttgagcttaatgctttatcgactgatgaaaaatataccaatgtgcaaatacttatcttgggtaacaaaattgacagaacagatgcaatcagtgaagaaaaaaatccgtgagatatttgggctttatggacagaccaaaggaaaggggaatgtgacactgaaggagctgaatgctcgcaacatggaagtgttcatgtgaagtgtgctaaagaggcaaggttacggcgagggtttacgctggatatacaagtatattgactgatgtttggacggtgaaaataaaagagttttacttctctggactgatcctaaaaataataaaatta

SEQ ID NO: 562451 - DNA, 670 bp, Homo sapiens
tgagcgggccggagctgcggctgctgtatttgtcctagccggtgctggggcggcggggtggcggagcggcgggcgggcgggagggctggcggggcgaacgtctgggagacgtctgaatggaccaacgagactttgtgagaccatgagactgcgcgctggggggacctggcggctatggcgtgcgtgctgagatttcccttgcgattcggctgggagctcggcgcacgggatcgtcccagtggccgtgggctcggagaccgcgtacccttggcggggctctccgggattttgctaccgtttttggctccctgctcgatcgaaactgcctcttctcacgtggctgtcggcattcaatctggagcgtcgactgggtgccttggcgcagaggaggggcgcagccatggcttgccctctgtcgcgcgttctcgtgtgtgccgctgtcacgcgtgcagtttcgccatgccccgagaccccgaggatgctgtgctgactggtgaggtgctccctcaggctccttggctcttccttgggcagcaggcgaatccggactgtgaggcctcttcgcgttgcccattgacgcctggaggacgactgacctgctacagcagtgggacatcgacacagggacgctgatatgcaaacgcgaaagcaaggagaaccagtggttgag

SEQ ID NO: 562452 - DNA, 281 bp, Homo sapiens
tctcttggtgaaacggcggtcctttgccaggggggttttttttcttagatttttactgttgggaaaccccttcaaaagggcaaaaacttccttggggccctccaaatgttttttcccccgggggggaataaaaaaaaaaccccccccttttttaaagggggggattttggcccccgggggggccccatcccccggcttttttaaaaaaataaataagggggttccccccatttttttttttaacggggtgggttattaaccggccccgctttcccatttta

SEQ ID NO: 562453 - DNA, 161 bp, Homo sapiens
cctcactgccaccacctgacatcagcaccagtgacaggctggtcagagggcggggctggtagggtttgtcctaagaggaccaccgccagctctgtccctttagtcacctcccgttggcggaggatcctttccctgggttaagaactcccagcccgttttat

SEQ ID NO: 562454 - DNA, 405 bp, Homo sapiens
  misc_feature (112)..(112): n is a, c, g, or t
  misc_feature (155)..(155): n is a, c, g, or t
  misc_feature (172)..(172): n is a, c, g, or t
  misc_feature (174)..(174): n is a, c, g, or t
  misc_feature (195)..(198): n is a, c, g, or t
  misc_feature (205)..(207): n is a, c, g, or t
  misc_feature (241)..(241): n is a, c, g, or t
  misc_feature (277)..(277): n is a, c, g, or t
  misc_feature (286)..(286): n is a, c, g, or t
  misc_feature (288)..(288): n is a, c, g, or t
  misc_feature (294)..(294): n is a, c, g, or t
  misc_feature (338)..(338): n is a, c, g, or t
  misc_feature (349)..(349): n is a, c, g, or t
  misc_feature (366)..(366): n is a, c, g, or t
  misc_feature (386)..(386): n is a, c, g, or t
agagggacactttgccaccatcaccttgaccttcatcgcaagacggagagactgagctgtgcatggaaggtcgaggcatccctgctcctgaggaagagcggacacgacaggnctggcagcggtactactttgagggcattaaacagacctttggntatggcgcacgcttatntnagggccagcgcaggggactcnnnnctgctgnnnacttcagtccagctctctcctgactggggcttgngactcacaggattgcatcgtcccagctgctaacttngggccgggncnccaccnttccacatataccttgggtttttgcatgtttttctgcttgggtngggtttcagangggcaatttctcttttnatgtgttacatatggttaantaaacataattttaaaaaa

SEQ ID NO: 562455 - DNA, 579 bp, Homo sapiens
  misc_feature (551)..(551): n is a, c, g, or t
aggaagatgccccagactcactgctcccactctgggcaccaggaacccagataacaaaacctaggccgagtccccgagagcacaaaagaatggaagatatagaattgtgggtaagagacagaggaaacagtgagagaggctaagactcatataattgggattcccgagtaagatgtgagaaatgaaggcaaaggaatatttaaagacgtctaagcacttactaaaactgattcaaagacacgccacaaacttgaaaagtcctacaaaccaaaggagatgactaaaaagaaaaccatatttaggcacaaaaaaagaagggagggatagaggaaacagcaacaacaacaaaaaagttttttttaacatgaaactatttttttctaatttttttccccgtggtacagccccaggcaatcctgagaacgtgtgccacaaaagcattttttctttcttttcaatttcaacttttattttagatacaggggctacatgtgcaggttacatgggtatactgcacccaggcagggagaacagtacccagtaggtagttnttcaacccacgtcctcccccatctagtc

SEQ ID NO: 562456 - DNA, 657 bp, Homo sapiens
gggcattaccgctgcctttctgcagaaaacggatagactacggctcagcaagaaccagcgcccagccagagccaaggtcacagagcacgtccgtggcacgcgtccaaaggctcctcgcacctaccccagcaactcaaattcagcacgctcaggacttccgtgcgacgcgcgatcaaaagacgaatatcacggtactgcaatgctcgagtaccacagcctcaacgctcgaattgtgacaatgtgggccatgtgagaagtcgagagatgccgcgtcacgtatgtgatgtactacgagatgtcctacggcttgaattcatcgagatgcacaatacaggctgagatcgtcgagaagaggctgaacgggattatgtgccgcaggtcctgccctacctctcccgatgagcaccagcagcaggtcttgggagccattgagagggccaagcaggtcaccgttcccgagctgaactctatcatccgacagcatgctccaatgtccatcctagctgtctccgagctcgcgtggccctggccctgtccccttgtacctccactacccgtggggcttgcagcctgccttcgctgccggcggttcagcgctaggctcgcggtctccatctcgacttgtccgcgtctgggttcccaggcccagctctccag

SEQ ID NO: 562457 - DNA, 182 bp, Homo sapiens
tctcctcgtgactatctacagcgcgtcccactcgtccaccgtttgacgcttgggcccgcttgccctcaacgcccactttgtcccgctcctttcctggtatgacaccgcatttggctccagcaccagggtggtggacctcattgcccacatggcctccaaggagtaagaaccctaaagcacca

SEQ ID NO: 562458 - DNA, 102 bp, Homo sapiens
tgtaaaccaccctattcctccccacactcattgcttaccacgctactcctacctatctccccatatctaacaacgtaaaaataaaatgacagtttgaacata

SEQ ID NO: 562459 - DNA, 383 bp, Homo sapiens
ccaaaagaaagttctttcttgataacctcaccaacgcaggtgtggcaccctgccttttccgagcctgatatcttgctttcagccaaggtctctccgcccaccctggcatatagttctcagctgtgtgtcttgtgaacccagtcttgaatgaaggtccctttcacaaacaccccatattaacccacagcatagttgttatcaaagtataagatcccgttggcatccgaggtctcttcttccagtttgtgaacggcaaactcttcgcccgattcacaatagcaggtgtcttgttggtatttacacatgagagcacaaaatgtgtgctcattcagtctggtgtgcccccacacaggactctgcggtgtattcttctccgctggccc

SEQ ID NO: 562460 - DNA, 577 bp, Homo sapiens
  misc_feature (147)..(147): n is a, c, g, or t
gacaaggtgagatttaattatatgttttggattatgtgctgggtgtttacattatatgggtttttgttggtgatgtttgttgaaaaaaactaccaggtcctgttcttggaatatgagggaaaacttgtaaaacacataagtgagctngacagaacacccactaatattgttttgcccatttcaaagtctttcacagttttttctcacaatgggcgataccagctattctgtaacatgttggcagtattacatgttgatcgtatttttaaaattacttctgttattctaatttccttgcttggcatcagaattatttttccccatttttatagtctgtgaaatcaggtgtttttggacccactggaccaggtcacctttaaaatcacttccagttttgagatcctatagttctgtgaagtctgtcctgtgtcttactaatcctagtatactgtacaagtaaccttcttagccctgatactagaaattataaatgcatacaccttaacatacatgttcacacacagatatgtatgtctatatgcagtgccctcttggtcatcttggctcaattaggcgg

SEQ ID NO: 562461 - DNA, 345 bp, Homo sapiens
ggagagacagaactagtctcgaggtgtccccgtgtcttgtatcatgcttattgtatatggcagatgctatatgcaaacaatctctaatgatggggcgccgagggggctgaaacttcttgatgtagtccatcctgcagcagaagacattgggtagacattgaccaaatcccaagatgctgaggtgggtgatggcagcccaccgtcatgtgaccttgctggactgcagagtttctgaagcaggtgaaaccctatgtggaggaaggttacacccccagatcaatcatcgcactttaacggcaggcacccacgctggcagttaacaccgatcaaagagattgctggacc

SEQ ID NO: 562462 - DNA, 553 bp, Homo sapiens
  misc_feature (251)..(251): n is a, c, g, or t
caagtaatcagcaatgctggaggcagacccaccagtgcgacccacctccagagtactagtgggggaggtgaagcagatagtgtctccactgctgggggaccattatgtgcagctgccagcaacctacatgaacttgggccccagcacctcgcatgaaatgaatgtgcgtccagaacagccgcagttttcacccatgccagggaatgtacgccggccccggccactttcaaagcctcctcggcccacttganttagtttttgggctggacctgtttagctcccttgagctaaccccaagctgcctttgggccatgccaggccaaagggcagtggccctcccccttgttcctgccctttaactttcaaaggcaataggtaaatggggcccattaggtccctccctccccaaagtgagccagtaagggcagtcctccaacatgtatttatggagtgcctcctgtggacccttttttttgggcccagtggactcaccagtgccccccccacccctgccccttgaaccaataaaggaacaaatgtcttttaaagccca

SEQ ID NO: 562463 - DNA, 1719 bp, Homo sapiens
  misc_feature (275)..(275): n is a, c, g, or t
  misc_feature (486)..(486): n is a, c, g, or t
  misc_feature (934)..(934): n is a, c, g, or t
  misc_feature (1718)..(1718): n is a, c, g, or t
tggggctctctgaccagcaccatgggcgggttgggcaaagaacaaggccgcctttacagaaagggcgggcaaaaaggggacgccaaagaaagaaaggtggtgtgactccattttctcataaagaaaagattgggtattgattgtgaaacgccaccgtgcatagtgtccaattataagaaacatttgtgtggaaagacacgcctcgtctccaccgaggacacccgagaggagacacccaaaaagtgtgcccttcctgagagtggctcctcagaggngtctcaggtgtgtgtttgagaaaaggtggagtctctgtggcgtgaaaattgtgcgagaaagtggagtgaacagtgtgtgccttatttgagacacaatatctccagagccgtgatattcacgtgaaaagatatgtctctcgacgggtctaaaacacacacgtggcgcgtgaaacttaaaacttctcccagagtgagccgtgtgggatatctntttcaaccgcgtgtgacacaaaagtgtggtgtctctcccgagggggctcacaacacaatggtggacacgaacacacactgtgcatgtgtagagagcgctctccacgcgtgttgagaatgtgttcttcagagagacactataccgcggagtgtgggatacacacgtgtgcagctctccgactctgtgatcacggtggggagtgggaggtttctcaccataacaaaaaacgcggcaaccaacttcagagatatgacgcggaaaaggaaaccctcttttgaagtcgttccgagaacaaccccaaaagcgagggttccccggacccaaaaattcgcggggaaagagaaaacgtatcgtcacgtggggaaccaactccatgtggcaacccgccgaaagaagaggtgggtgcgcgcacgcacaccacaacgacgttgacatctttctgctaacnacaacacagtggtgggtcttccacaaactaacatgttgcgggagttctcctccaggaaacacgacgtcttgtgcgtggcaaacaccaagcactcttttagaacagcggggggttgtgccccaaattcctatttttatatccccttcttcccaagatagaaagtgctcgttccggtgtgacaacacagagcgtttcaaaacattctgctatgataagaaaggcacccaagttttgcgcacattggtgggaaacggtctcaatgtgagaacctaccaatggggataaaagcggccacgatatctctcggtgggaagcaaggccgcctctgtgctggcggcacaacaacggtgcgtccctgatcgttgtggaccacgacagtctgtgttggtgttattgacatccccgcccagtctccaaagattgttcgtgctctaataggttcagcacaccttcgaacatgtggtggcgccaatgacaaggtcgtctcttcttgttggtaacacacaaaacaacaaaccctacggacgctctatttcggggcgggaacaacaggtgctttaagtggccatggtctactagtgttctcacaccaacttttcatcagggaggaaaccggcgcccatgggaggactaatacagtccagcaactcatctacagtaacgactaacttcgctagtcaggcacagcttgttgactcgtctaaatgactaggagtagagacagctcacctacgtctcatgactcaactgtatactcatcgactactactcctgctatcgagtna

SEQ ID NO: 562464 - DNA, 119 bp, Homo sapiens
tgcatggcagaagactctacgtggcgacgaggccagagcaagcgtggatcctgcacctgaagtagccattgagcatggcatcgtcaccaactgtgacgacatgggcagtgagccagggt

SEQ ID NO: 562465 - DNA, 341 bp, Homo sapiens
gtacatggaagatggtgggggtagattttctattaatgctgcctggctggagtcatagcctgggccccagggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagt

SEQ ID NO: 562466 - DNA, 512 bp, Homo sapiens
ccgcatactccagaggctgagatctgagtatcgaccatgtcaagatgcagtgtgccagcctgtacgctgccattgctgactgctgatcacgtccgtggggacgatggcactcatggatgctatagaacaagctggtcaagggctggcaggatgcccctgtgataagggcacagcaggactctggtccggcttgcttgaaggagataccatggagcttgatgaatgtcaagctgggccttggcatgtggagatcggcagctactcgcaagctgctggagggctaggagtgcaggctgaatggcgaacgcgttggacaagtcaacgtcatctgtagctacatgtccacgcatcgtccagtggctatagcggtgccagcggtgtcggcagtggcattaggcctgggtggaggaagcaggtactcctatggcagatggatctaaggccacttggagggttggctttcaggtatccagctatgttgtgcagagcccattgggagagttggcctccaa

SEQ ID NO: 562467 - DNA, 235 bp, Homo sapiens
cggagacttgtccctcagcgtcacgtgccgtctatatgctcaaaggtggactgtctaggcagacgaagctctatgacggtagtcagtatgtcactgggctcccaagcctgattcaaacaggactgtcggtctcctctcaccccttaatactgtgcagaccaaactcctaggactcttgaaccatctgcaccagtttagtgctttgcagccacttttagacaaaaatggctccatt

SEQ ID NO: 562468 - DNA, 1129 bp, Homo sapiens
  misc_feature (59)..(59): n is a, c, g, or t
ggcccgggctgtttcggcgtctgcaggcgccaccgctgcctctttccggactgtgaccnctcctcgaccgccagccgcttcagctgctgtccttccgaactcccctgcgcctgcctgagaccatgtgcatccctgctccggttgcggccgcacctgcccatccgctggctgcccccatggggatccagcagagcgcaggtcgtccatatggtggaaagcgaagccagatgacaccttggcaatcattcaccactcccacaattcccgatttattccaacaattccattatgggggcaacccaattccattggcttggaaacccgcgccattggccccattataccccaagttcgtagacattcacccaaactttcagagatcccattcgattgaatcttacgttccggaacggaggaacaaccctttacgggaggccccgatattcccagcccaagaataaaagcccgacaaaaggccaccactatggctagcatacagcgctgcgcaacaaagtttttccacccaaaatctggcgagggcgttacctcaatgcgtaccccagagaaaacagatttcccgaaacgcggacaacctttcatgcgagcttcgcaaaaacagatgggattctccctcgcacacgcagggccccccagtatcccgaaactttgtggaaaccagtatgacagcttgcaatttccctacgggataaggcacaatatccggtacctgatttacgaccaccacccagaaatttacgaggacgaccacatttttagcggcccaagaatttcaccatgagtgggaattcaccaccccatatcggcacgacgcgtccgcgacaacttttacggaccccgttaagtttccccgaaaacggcgccagcaccactaatttggaacgaccaacgacaacgaacgacagatgcagcgaaagcccggagccacaccccacacaggaggagcgcgagacaaacccacacgggaaggtcgcaccacccccaactactgagcccggcgcacacaaagcgccgacacccacataaagataccaaacccggggcagcaacaaacaagacaacagtggcggccccaccaaaaagcgaggcgcacgcccagatctacccccac

SEQ ID NO: 562469 - DNA, 187 bp, Homo sapiens
  misc_feature (5)..(5): n is a, c, g, or t
  misc_feature (13)..(13): n is a, c, g, or t
aaccngagtcctnctcctgtcccgtggcagaaggtgctctgaagaggcggctgatgccagaagtcagcatgcctctctgagagaggtggaggccttagagttagcatccccctcagcggaagtctgtggagagctttagttagatccgaggctgcttcagattgatctccgaggtgaggtgagagga

SEQ ID NO: 562470 - DNA, 492 bp, Homo sapiens
tttggtgcacatgtgcaaaactaaagttgtgtcatgagaatgtaagtcttttttctactttaaacatttagtaggttcactgagtaactacaatttagcaaacctgtgtttgcatattttatggagtgcagaatattgtcattactgtcataagtgatttggagctttggtcaacaagggcaccagcagcagcacaggcagtccacctggcagtctatataagtattttttcaacatcactctcagcaacttagccactatagtgttcattgattcagtgcaggagccagtacgaaaccatctgggtataacggaaacaagtggtcattgttacattcatctgctgaacttaacaaaactgttcatcctgaaacaggcacaggtgatgcatactcctgctgttgcttctcagtgctctctttccaatatagatgtggtcatgtttgacttgtacagaatgttcatcatacagagaatccttgatggcattcg

SEQ ID NO: 562471 - DNA, 144 bp, Homo sapiens
ctctacctgctggatattaattaccctgggaaagtacagagtagcttaggaaagcaggggttttttttttttcggactttataaaacttaatttgacttcttcttcacaaggcgggagctttagttgctgttttttttttgaga

SEQ ID NO: 562472 - DNA, 429 bp, Homo sapiens
catttcttgtcttacttacttcttactactatctaactagttactaacgtttctattcgtttctctctctctctctttctttcttctttctctctctccctttctttctttccttctctctctctctctctctgtctctctctaaatcagagcatggggtctcactactgttgaccaggctgaagtgcagtggctagatctgggttcactgcagtctccacctcacaggcccaagcaatcctcccatctcagactcctgagtagctgaaactaccggcacatgtcaccacgctcagctacatattggattgcgcggtcgagacagggactcgctatattgcccaggctggtctagaactcctgggctcaagcaattcacgtgcctcggtctcccagagtgctgggattacaggcgtgagcaaacacacc

SEQ ID NO: 562473 - DNA, 889 bp, Homo sapiens
  misc_feature (40)..(40): n is a, c, g, or t
  misc_feature (105)..(107): n is a, c, g, or t
  misc_feature (165)..(165): n is a, c, g, or t
  misc_feature (177)..(177): n is a, c, g, or t
  misc_feature (180)..(180): n is a, c, g, or t
  misc_feature (189)..(189): n is a, c, g, or t
  misc_feature (226)..(226): n is a, c, g, or t
  misc_feature (275)..(275): n is a, c, g, or t
  misc_feature (378)..(380): n is a, c, g, or t
  misc_feature (415)..(415): n is a, c, g, or t
  misc_feature (454)..(454): n is a, c, g, or t
  misc_feature (469)..(469): n is a, c, g, or t
  misc_feature (476)..(476): n is a, c, g, or t
  misc_feature (533)..(533): n is a, c, g, or t
  misc_feature (595)..(595): n is a, c, g, or t
  misc_feature (611)..(613): n is a, c, g, or t
  misc_feature (615)..(615): n is a, c, g, or t
  misc_feature (622)..(622): n is a, c, g, or t
  misc_feature (627)..(627): n is a, c, g, or t
  misc_feature (631)..(631): n is a, c, g, or t
  misc_feature (633)..(633): n is a, c, g, or t
  misc_feature (644)..(644): n is a, c, g, or t
  misc_feature (648)..(648): n is a, c, g, or t
  misc_feature (650)..(651): n is a, c, g, or t
  misc_feature (653)..(653): n is a, c, g, or t
  misc_feature (665)..(665): n is a, c, g, or t
  misc_feature (691)..(691): n is a, c, g, or t
  misc_feature (695)..(695): n is a, c, g, or t
  misc_feature (698)..(698): n is a, c, g, or t
  misc_feature (708)..(708): n is a, c, g, or t
  misc_feature (710)..(710): n is a, c, g, or t
  misc_feature (720)..(720): n is a, c, g, or t
  misc_feature (722)..(722): n is a, c, g, or t
  misc_feature (724)..(724): n is a, c, g, or t
  misc_feature (732)..(732): n is a, c, g, or t
  misc_feature (742)..(742): n is a, c, g, or t
  misc_feature (744)..(744): n is a, c, g, or t
  misc_feature (791)..(791): n is a, c, g, or t
  misc_feature (887)..(887): n is a, c, g, or t
gcccagagcttggttttccaccggatccaccacgtgaganaaaaagagtctgtcacttcttcttgccagggttgagggccttttctagaccttggatgtgttttnnngggagctgatactcttcaagcaatagccagccgaggtggtggacctggtttccctggntctgcacctganggntgtaccttngccccaggggcaggattgacggtggtgctagcctggnatcgctgctgaaggatggcagccactgagtatgggtccagaccatatgnctccaagttccggaccacggtcacctttttattagacagctctttgtgctagggtgatgtcaattggacagattctccctattcttcacaatgggctcttgtnnnggaagggtcacttgataggcaggctgtaatttttncaaacacctggtcagaagactgtcccatggaagcttcangaatgtatgctgttnatttttntctccgatgccgtcacctcggctgggctcacctctcccccgctttttgttgtttggntccccccggttatttttcttggagtcgttaatgagctagttcggaacatcactgacctcagnacgctccccttcttgnnnanagcctcntggcngagnanggacatgctgnctgngnncngtcgaggggttntatatctggagggtgatcgggctgtncccngcncccctcctgnanagtctgggcngncngggcgggntcgggtctgncnaccgatgtcctcctcgggtgtttcccgtcccccgcccccctgctctncacacctttgctcagctccttcacctgtataatctgctcctgctgcatttgctgcaggaacttagagagctttttgtagcttgacttctttatgtnca

SEQ ID NO: 562474 - DNA, 390 bp, Homo sapiens
gcgtggatggaggagccctatctgcaaggaatccactacgaggatgggtgctcccctcaaactcaattgtgagctctgtggccgggtggacttcgcgctatagttcaagcagttctcaagcgcattctgattccgagtggattgctgcagataggacggtacaagagtgggatgctacctagaacgggtgggacgtttatccatatcatgaccggagcaagagcttgcaagaagcgcatggacgcatggaacctcataaacgacgttcgagtcaagcaagagcagtctgcatgcacttgcgaaggatagccaatgagcagacaacatgcactgtgccccttccggttagtgcatgttttgcgagctaacactacatgtcacgggaagact

SEQ ID NO: 562475 - DNA, 278 bp, Homo sapiens
aggtcggcgagaaatccacctgctactagatacagtatatactgttcgtgtattaaaaacattggacaatacctttctagtatatccttactatccctctctaataatgaactaatccctatctctgcaaatttccccaacaacattttggtcaagtgtgatgggctacattgtcttggttaactacaacgtttcattgaccttacatacgtctcttgggaagttggactactgggacgtgcttccactgacgctacccttttgtggccctgacattt

SEQ ID NO: 562476 - DNA, 683 bp, Homo sapiens
ctgttgtcccccagtatcagtgccctcaattccaaccaagaagagggttgaagatccatggcacttccctttcccgaagggtaaagggctcaagaataaggcgcaaataaatttgtggcctccacgtcccatcttctcttggacttgatcacctttttgacgaagtatcatagtggtcatatgactagagcttctgatatcattgagcgcttaaagtgggtgcccctgaacagggaaagtgtggaagagagagtggtgctttcaagaaatttcagtaatgaaatcaggcgcaacctttcacaagtgcttcttgccaccatgaacatcttgttcacacagtttaagaggctcaaggggacaagtccatcctcgtcatccaggccccagcgagtcatcgaggaccgcgactctcaactcggaagtcaagcccgcactctgattacctttgttggaatgatacccataccgaaccgttttgggccccccaattccaaggttggtgcagatggaggtcctcatgaattaagtgccatgctttgtgggagtctgggtcggcacactgtcagtacatcaggcacatgggcccactaggctgcgtctcctggcctcgtttctgttgatgttttgccgtggtttctgtataatgttcttttgtcaaccccctttgatttgtttgatttgta

SEQ ID NO: 562477 - DNA, 131 bp, Homo sapiens
gggtggactaatttcctcgcttaacgagaacttgtgtccagccgactagacccattctaactcttccccctctgactctcctgcgcagggtctgttcctggtttcccagtatgcataacaggaagacatat

SEQ ID NO: 562478 - DNA, 262 bp, Homo sapiens
agatctttcctttgcactccagcccgggcaacaagagcaactccacctcaaaaacaacagaatggctgggattacaggtgtgagccacagggccaatcctaaaattttttgtataggtggggatctcactatgttgcccaggctggtcttgaactcaggatttgaaattacaggcacacgtgactcacgcccagctaattgctggtattacagacataaggggttgcaccatgtcggaaaggctggtctcaaattcccgacc

SEQ ID NO: 562479 - DNA, 1007 bp, Homo sapiens
  misc_feature (205)..(205): n is a, c, g, or t
  misc_feature (531)..(531): n is a, c, g, or t
ccccactcactacttttacgtcgctccgtccgtctaagtattgtttgcggtcgccgctcctctggtgctcctcctcgtgtgttgcgccgtatagccgtgtgttatctcctggacgacacgaggactgtagtattggcgccacactgtcacttagctgttgcgagagggcggggtggcccccgtggtttttgacggggggcccccnttgccacacgcagcccgttccttgtagtgcttttctgcctgcggtcgcgcctccctgtccgcccagtgtaggcgcgggctggttgcttccgccgaaccaaccacggggagtagtgcctgcgccgcttttcgtggggccgaaacaatcaatagtttgtcgtgatacaatgaattctctctggcagttagtttttgttctctcgcgcggcgagtgacactccaccaggaatgggtgcgggtctccttgccactatattaagtggttttcctcgcaacagagggttgtgggggtgctacccaggtatgcccgggttctctttgcttatntttttaaagagagttaattgttcgggggcccctccgccgcccccccccaaaaagacgaggggttttcccaaaaaggttgatttggatatataattagcttgcgaggagaaatacagcgagagatctttggtggcagcactcctcctgaggtcgtcctgagtcgcccgctcctctagaaaagcgggtcatattgttcagttagaattttctccgaacgcatctgggagcatctataataaatacttgataaacaatgggtacacacccccccgtacttatcagggagttctgtcagcgacccaaacggccgctgcccatcggaagatagatggctatgactctattctgaggggcgccccccgccgcggctcttttgtaggctccgcccaagaacatgatgtggcccaccgctgtaacaccgtaacccccccgtcaatcaaactttttcccgcaacccaattttaaaaaacaaaaca

SEQ ID NO: 562480 - DNA, 864 bp, Homo sapiens
  misc_feature (602)..(602): n is a, c, g, or t
  misc_feature (668)..(668): n is a, c, g, or t
  misc_feature (706)..(706): n is a, c, g, or t
  misc_feature (752)..(752): n is a, c, g, or t
ctgcaacgccgagcggaggaggcaggaacctggagcgcgagcagtagctgggtgggcaccagtggctggtgatctaccacctatctgagtgcggtgaagccgcaagatccgaggttcgtgcagcgagcagggcaagatgatgcgagagtgagctgagcctgacgcgcactccgagcgcacgaagcttgagcggcagacaagtgcgtggccgcggtgaagcagtgcttgagcgctgacgtgtgtgcctaccttgaaacctgtaaggcatccatgcatgggttgacacgacagacgcgtggagcctgtgcatcatgtgatgctgccttgtgccacttggcccgtgtcaaaaaggcttggcacagaaacggcttgacagacaaggcttggcttgaactgacggacgcttgaggacagaacgggtagctgacaccgcgccttagcttgacacaaaccctgggagccctttacacacacgcacttgacacggacacgcagacttgtgagacctcgcaagggacagagtcacagaacgtccaagtaggacaacgctttacatggcagccatttttggccgaggcaccagcacaggtgcgaggcacttnatgtgccacacgcttactgtgcacacggcaacgggttgtagccttccgcgtaaacggttatggcgntcgcacctccgacttttggcacacgggcacagcacctnttggggaaaatcttgccaagcacaggaaggcggaaatctcggaagnacattgcaacagccttgggcccaacggcacggtatcgcccagggtatttgaccccaggaaggagacggaacttggggacgttgcaaggccaaggaatgttaaacgaaacggt

SEQ ID NO: 562481 - DNA, 420 bp, Homo sapiens
tttccgcgaagaaagatgggttcccccaagagcccaagatttcgcgggacacagagctcccaatataaacctagatttcttgtttgacccacagctatacctattgagtataaacttctgtataaggaaaggtttcccccacctatataaacttatgaacaccccacgcctcgtggttcttctgaagaagacctcgaaagaatttcgaaggctcccctcgggccacagggcagccctttacggagctccttatgtataaggagcttatccaaactggtttccaagcaccacgaagctcacagtatatttacaccccgagaatacccaagggtggagagaatgctccacagctgctggtgaagaagcatgaataggtcccacccgctgtacatttgggaaaattaaactttatttaatcca

SEQ ID NO: 562482 - DNA, 820 bp, Homo sapiens
agcctgttgttgagctcagtatgtcagtgggaatccggggctgggccaggtctagtgttcccaggtgatgtgatctcgtgtgtgatgtgcgtggtacggaaaggtgcgttaaagtggaaagggtcgttgccactctcgtgccacggcatctgtggtcgcctgtgctcagcagtggccgagtgggaccagtgtgacggtttatcttgttcttgtgacgaccataagtttgcatgcggtacgcgcttaaccgcatcactggtgtggaggagcaggtcaggcaacgaactccctctggcagtggcttctacttgctgacctgatacgctgtaagctctttgtgattgtaacttgggtgggcttggggcactgatgaacttagactgctctatggcaatggcatttggtcagggtttgtgaatcttaatctcagagaggaagacaaagttatgccaaggtcccccatcaagtgtctgggctcaaagaggttaatattccgggatttggatttgttgaccttcgccatgaagtttgacccacaagaaaatgccccatataaatgactgcgcaaaggctgctacttgtcctggaattggctccagaagacctattgtgtgctgcaattggagaaagctgggaatagacgggagttgggggagtgcaggaagggatgaggagaggtcagaggagataagacttggtgtgatgcttacagaaagaactaagcttgtgttgtgaagcgggcgattaggcgtggaagcaggggaaagggttctgaaggcggtaaaattaagcgatggttaagagtgtggatgttagagga

SEQ ID NO: 562483 - DNA, 130 bp, Homo sapiens
  misc_feature (71)..(71): n is a, c, g, or t
tcttcaagttcagtgtgacattttcccataatcaaactcacttcacagcagacgctttggtccagaatggncatgacacatcgcaaaaaacaaaacaaaaaacattacttgccttatcaaaaaccaacta

SEQ ID NO: 562484 - DNA, 780 bp, Homo sapiens
  misc_feature (219)..(219): n is a, c, g, or t
tttgcagaggtgctcggagggagcctcccacttctaggattgggccggtggatcccgccctctgtcgttgttcgccccccccccggtgggtggccaaacaccaattgggaggttcgttcaatggaccctcgcccccctcccggggcgtgtccgctttgctgacacatctcttcgttcgggggtcgaacccacaggcgtgggccatagttgtctgttgcncccgccaccttccaaggcttcctccgcttgaccttgtggcccgccttgccctctgcccccccccccctctctgttctcgtctgccagggagccgctcgcgcgggaagttctcttcatttagggttcgccccgcgctcccttcggtcctgctcttgtccccactcgcgcgcttgtcattcactcacgctccatcgctcgcgtgggctcgcccacgacgcctccctctctgttggcgtgttgtgtactcatacaagcctcggtcacactctcgcctcgccgcgtatgtagcatccaagacacctcgctccgctcgctctctcttgtgtccatgttgggatgaggactctcaccccccccccccccaccccgacgatgtgtattgttctcctgtcccgtgagacaataagagatgatcatatggactcacccttctttcatctcccccccccccccctcttcttttttctttccaccttcagccacctctgccccacctcttcttgtcacgcaaccactgacttcattccaccctccttcttgttgaccctccgtcagtgcgga

SEQ ID NO: 562485 - DNA, 300 bp, Homo sapiens
  misc_feature (78)..(78): n is a, c, g, or t
agtctaaggccaaggcgcagacgcacagtgcccaagcagccgttgacgccggcagcggctgagggggctgcggcgganccgggcccacgaggcgacgaaggaggcgggacggccttcacccagccccggacgcccgagacagggaagctgaggacaaggcaggagcgcgagacatagacccggaccagccagaggacgcgggctccgaggacgagccggaggaggggggccagcccaaggaaggcaacgcccacggggcagcccgcccgccggcacccgcccccgcccaccggcgagaaa

SEQ ID NO: 562486 - DNA, 278 bp, Homo sapiens
tggacaacacgcaccggacgctgcacggcgccttgatggacgcggagctgctggccgaggtctacatcaacatgacccgcggccaggacgcttgctgatcgacagcgacgcgtccgagagcggcgaagggcagggcacgcaggaagtcgtggcaatcgatttcagcgccttcgacctgcccgtgatcaagcccacggacgacgagaccgaggcgttcgagaaatcgctggaagccatcgacaaagccagtggcggaaaaactttgtggaaatcgattg

SEQ ID NO: 562487 - DNA, 339 bp, Homo sapiens
ctactagaggatccccgcaagctcactttcttggcacatgtatatgaaatgtttgagttattttttaccaccagcatgtattataattgtagtcagggaagaaaaaaggttttaaaaatgtctccacagctgggcgcagtggcttacatctgtaatctcagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggccag

SEQ ID NO: 562488 - DNA, 445 bp, Homo sapiens
  misc_feature (15)..(15): n is a, c, g, or t
  misc_feature (62)..(62): n is a, c, g, or t
  misc_feature (64)..(64): n is a, c, g, or t
  misc_feature (67)..(67): n is a, c, g, or t
  misc_feature (69)..(69): n is a, c, g, or t
  misc_feature (78)..(78): n is a, c, g, or t
  misc_feature (80)..(80): n is a, c, g, or t
  misc_feature (83)..(83): n is a, c, g, or t
  misc_feature (95)..(95): n is a, c, g, or t
  misc_feature (112)..(113): n is a, c, g, or t
  misc_feature (126)..(126): n is a, c, g, or t
  misc_feature (143)..(143): n is a, c, g, or t
  misc_feature (155)..(155): n is a, c, g, or t
  misc_feature (166)..(166): n is a, c, g, or t
  misc_feature (175)..(175): n is a, c, g, or t
  misc_feature (190)..(190): n is a, c, g, or t
  misc_feature (196)..(196): n is a, c, g, or t
  misc_feature (210)..(211): n is a, c, g, or t
  misc_feature (222)..(222): n is a, c, g, or t
  misc_feature (225)..(225): n is a, c, g, or t
  misc_feature (232)..(232): n is a, c, g, or t
  misc_feature (235)..(235): n is a, c, g, or t
  misc_feature (239)..(239): n is a, c, g, or t
  misc_feature (279)..(279): n is a, c, g, or t
  misc_feature (316)..(316): n is a, c, g, or t
  misc_feature (321)..(321): n is a, c, g, or t
  misc_feature (325)..(325): n is a, c, g, or t
  misc_feature (354)..(354): n is a, c, g, or t
  misc_feature (360)..(360): n is a, c, g, or t
  misc_feature (371)..(371): n is a, c, g, or t
  misc_feature (375)..(375): n is a, c, g, or t
  misc_feature (382)..(382): n is a, c, g, or t
  misc_feature (398)..(398): n is a, c, g, or t
  misc_feature (410)..(411): n is a, c, g, or t
  misc_feature (421)..(421): n is a, c, g, or t
  misc_feature (433)..(433): n is a, c, g, or t
tggagggaacaaaanctaggacctaccaacactagcccctccatgggggctcccaagttctnanaananaaccaaatntngtntgcccacgttanggttatccatgtttctnnaagtaacataaangaaacaactgcagcctnagcatgggctgnaaggggtgggnaagacttangaggggagggcaggnctgaanaggggcggggaccnncactccctgcnagnagctcancanctgntttttttattttggcaaaaataaaaataaaacctggaagnttcaagataatgaagtaaactttaggaaatggaaaanacagnaggntgtgcccaaagcctctcttagcctccaancaagtncttctcaaganctgntggtgantctcttagggttatantggcaagttttnntcacagtagntccaaccctagnccagctgaagaa

SEQ ID NO: 562489 - DNA, 1429 bp, Homo sapiens
gagcagccgtgtaccccgcagagccgccagccccgtgtgcatgttcctgatgacttctgtgtgtgaaccctgtgctccgagctcctgtggaactgtgctgtgctgtgtgtactgtgctgtgcccctgctgcatgcccctgtgcctgcagctgcatgtgcatgcccacgcatgacacgttccacgctggttgccaatgcactcaacaccactgatgtggcacgtcccggcatgcttgcagctggacttgcgctaccagccctcacttctccctggtgcgtccctagtccatgcttacgcctcagcgcccatcatgcaccctaccccctccagcttaccagcctcgcctcatcacaccccctgtgcccaggcacgctcacttccctgggggacacccatagcgccggcccccagctccttccccatcgtcgtgctgcgcttccgtgatacccgacactgtcggccccgttctggcgtctcgacacccccggcactttccaagtgcccccccgtggacgtgctggcacccccgcaaccgcgcacgcccgcgcccccggcccccggcacccgctaccccgctgccctagaccggcacaggcccgcggcacccccaacctgcgcctcaggcgcgcctataggcccggcggccccacaacaccgcctcggcccaccacggcaacaacgtccagcgcaagctggcaccaccacgtggggacatacccatttgtcacctcctgtgacgcccgtttttccgcccattgggcccgcacgcgggtcccctccggcaacgccaccccccttgtgcactcgtaccaccacccccttcggcgcgccccacactcgccaacctattgtacccgcacacccagccattccgcttgcgcggcagccccctatgtacccactctctcatggcgtatgctcaaccggcacacctctctgggccaacgcccggtcacacggcccccttttgctagctccactgcccactctgctgtccctagccgatcaaagaccgcggtcagccgctccggttacctctcctgttcagcccatacagtccgcccattgcggcgcctcagccacgccctagaagggcgatagaacgattctccctccaccacccgcgccaccccctgctcacccccctctcccccaccattccatttcgcccacacactcaccccaccaccttctcccaccctcctcgggcacacctcactccggtccaagcctcgccgccccacaccacctgcgcgccccacctatcgccggcctggctggggaaccccacgaacccatcacctccgcgccccctcaccgcggtagctacccccccccaccacggcctagtagtccgggcccctagactcacccctccccacgcaccgtcaccagtgcccgcacctactacatcccccccaccctcaa

SEQ ID NO: 562490 - DNA, 400 bp, Homo sapiens
ggaggggcagagggagactgagcccccggggttgcgggtgatggtcctcaggcagtgcctgattcagccgggagcaggcaggggaaagccacggggctcagcacagggcagggctggagggagaggagcctgaaattgacacgcgcagcctggtaagggggaggggcatggggcgggtcggggcctgagacagcgggggatcgggggtgtggccgaggctgtctgggttcagagtcaatcttgcaacagggcccccttggcaagggtcacagtgcgacgccgcgctccccttcaccaccccagcttggcccagcgagaggtgcagcacgtgcaggccgagggcggggccggcgcggagagggtggccctgcatcgtagtaggtccctcccccgcagtgct

SEQ ID NO: 562491 - DNA, 290 bp, Homo sapiens
ctggtcactctacaggatccctctgctgtactccagatgatctctggtccccagtgccccattatgacaaacgtagatcagataggacacagtataactgaaatccatgctgtctattagcatttagcattcctatatactgagaactcctactttttacctgtatcccagacacctcctttgaggagtcatactgccaactgtctgtttgcgtttctcactttactagcacacatccttcacaaacttttccatgtccttaactgctctgaattcgtcttccccagacc

SEQ ID NO: 562492 - DNA, 674 bp, Homo sapiens
ttaaaggagaccattttgaattgcagaggtggtatgacttggtgagattggaacagggcttatacttgctttgcctctgacctgggataaattactttgctcagtttaccttatctgtaaaatggaggcattttaatacttgccccccattagatgccttagaaatgtgaacaagcattttgaattcttatgaagaaggcagtgtggaaattcacagtgtgataaataaattcctaaaatgcatcatacaaccatacttgtgtttgggagactggaaccattttaaagaaaaaagtatccaaagtatcccattcttgttcaagtcaaatgctgaattgtgtagtgcacagcctatgctaccagggtaggactacatagctttacctccagggcatgggaaggtgggcagctcagtgtgatcagaggcgcagaacctgccgcatgatggccaggctcagaggagcatctttttacccatatcttgttgattccagctttccttgattagtcatttgcatgctcatttttgttctgttcctctctggcggggtctgttaattactaaacatgggagacttaacaacccaaaaaaaaccaaccaaaaaaaaaattagccaagtgtggttgtgtctacctgtagtcccaccaattgggctgaggcacggaggatgctt

SEQ ID NO: 562493 - DNA, 236 bp, Homo sapiens
tcgcagctgctgcttgcaggtcgtacgtctagcaggatcccttgatgtttgaagcaaaggagtgagagaaatctatgcagatcctggtataagagtaagtagtccggagcatgcatctcactggtgacaaatactatcagagttcaatgtagctagagtagtgagcaagccaggaggtcataggagataaggtctcagggataggaaaccactccgggaggtggggaatcattaga

SEQ ID NO: 562494 - DNA, 844 bp, Homo sapiens
ttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttatattttggtctatctagcaggtatagtttgaacatatccatgaaggctctttctaacgagtcctctcttgtatttacaattaccaccagaagttcgggtatgactaattgaaataccatcatcgggccaggcattgggggctaacagcctgtaatcctagcacttggggaggccaagacgggcggatcacctgaggtgaggagtccaagaccagcctgcccaacatagtgaaactccgtatctaccaatattacaaaaattagccgggcatgattggtggggcgccggtaatcccagctactggggaggctgagacaggagaatcgcttgaacccaggagacgggggttcgcagtagagcgaagatcgagccatgtggactcaagccgggcgcagcctgaccaagagtcggacgtcaaaaaaaaacacacaacaacaagagagggcgagacgaaaaaatacacaccacgggaggaccaagaataagcgtgacacaagaatacctgcaccaagtggtgcctactagagacgcaaaaaaaac

SEQ ID NO: 562495 - DNA, 211 bp, Homo sapiens
  misc_feature (110)..(110): n is a, c, g, or t
  misc_feature (188)..(188): n is a, c, g, or t
  misc_feature (200)..(200): n is a, c, g, or t
gtctgcaggggcctctgctggcctgggctggggtgtgaagtctcgggctgtcctgggactgccgggcaccccagggccctgtccgtgctgcggcctgcacagggaacccntcccagctggtgttccggctcctgctccggccacagctgcatttgggctgagctgggaagctagaaaggccatttttnctgttcagaaangcctttctggg

SEQ ID NO: 562496 - DNA, 281 bp, Homo sapiens
gattacaatttgaaaacatcttgaatcattagcgagttcgagtctatgtcctgagtctttctttccctacccccactagactagaagggacaccttgtgtatctgttttcaccaatatatctgtccctgcggtactaattatagaatagcaccataaataaaaggagagggggaggggagtaagagcacaaacggtatgtggaaatatcaggtgccaaaaaattaggttggtgttacaatttttagtatttcttttaacagtttcaagaagcaggaactgg

SEQ ID NO: 562497 - DNA, 288 bp, Homo sapiens
  misc_feature (54)..(54): n is a, c, g, or t
  misc_feature (62)..(62): n is a, c, g, or t
  misc_feature (74)..(74): n is a, c, g, or t
  misc_feature (88)..(88): n is a, c, g, or t
  misc_feature (248)..(248): n is a, c, g, or t
gccctcagccctccctgagtagctgggaactacaggtgtgccacccacccacgncccagtcnaaattttgtaantttagtagagatgnggttgcaccctgttggcccaggatgctctcaatctcttgacctcgtgatctacccacctcaccctcccaaagtgctgggattacaggcaggagccaccactcccggatacaacactattattatatataacaaacttaagtttaagtttaacatgtaatnctgaatttatatttaagttttccagattggcaaaaaaaaa

SEQ ID NO: 562498 - DNA, 487 bp, Homo sapiens
caaaatgaaggtattctataccacaaaacgtaaaactacatgctgcaacaaagttactgacttaggtaacaaatacaatgtcagaaaactggtagagtaagaccagctaatgaactacgtcattaaactaaacaattacacagaactagaaaacttgactcacgacgtaacactactaccacacactctaccacttactacacactactacaacttttggtccatggagacccctacgggccgtactttacacatacacgtaccccacgacttactttctacctttacgagtgacctacctgcacgttgtaacacactgttgaactactctactggaccgacgtgttttactttaccaccggctacctgtacttacaacacgttactactttctacgcaacacccttgactaactaggctaccaaactaccacgctcacaaacttttgaccacccacaacaaccaaaccactttttcttgtacgttt

SEQ ID NO: 562499 - DNA, 358 bp, Homo sapiens
ctggccgcctcggggcaactcctctcctagcgccaaatacatcaagaaaatactagacagcgtgggcatcgaagcggacgatgatcggctcaacaaggtcatcagtgagctgaatggaaagaacattgaggatgtcatcgctcagggtgttggcaagctggccagtgtgcctgctggtggggctgtggctgtttctgctgccccaggctcctcagcacctgctgctggttctgcccccgctgcagcagaggagaagaaagatgagaagaaggaggagtccgaggagtcggatgacgacatgggatttggcttgtttgattaaattcctgctcccctgcaaataaagtctttttatgta

SEQ ID NO: 562500 - DNA, 395 bp, Homo sapiens
gctcgacaaaaaagtataggaatttgggagttggtaatgagtaaatgggattaaaaaaatagactatattttagagcagttttaggttcacagcaaaattgagcagaaagtacagagttctggctgggcacagtggtttatgcctgtaatcccagcactttgggaggctgaggtggaaggattgcttgagcccaggagtttgagaccagcctggacaccattgcaagaccctgtctctacaaaagataaaacaaattagctggggtagggggtggcttgcacctgtagtcctagctacttgggaggctgaggtgggaggatcgcatgagcccaggagtttgaggctacagtgagccatgattatgccactgcatggcagcttgggtcacagggtc

SEQ ID NO: 562501 - DNA, 122 bp, Homo sapiens
tagctggaccgagatcgctctgagtctccagcatgtctcacatgctcatgccacccgctctccacaagcctagtcatcctgcctgagctccagcccccagcccgcactgtgcccagacatgt

SEQ ID NO: 562502 - DNA, 375 bp, Homo sapiens
  misc_feature (101)..(101): n is a, c, g, or t
ttgcagtggggagttggagggagccaaactgggaagcagaggagtctgggaggccagtcacctggctctgtgatcaagaggtgaaattgggttgggtgcangcgtaacgcctgtaatcccagcactttgggaggccgaggtgggtgggtcacttgaggccaggagttcgagaccagcctggccaacatggtgaaactccccctctgttaaaaatgcaaaaattagctgggcgtagtggcgcacacttgtagtcccagctacttgggaggctgaggcacgagaattgcttgaacacaggaagcagaggtagcagtgaaccaagatcatgccactgcaccacagtctggacaatagagtgagaatctgaaaaaaaaa

SEQ ID NO: 562503 - DNA, 395 bp, Homo sapiens
  misc_feature (82)..(82): n is a, c, g, or t
gtgatatagacaaccactgcggggggggtttcaaaccaggggcaaaagggtgtggaggggggcaggttcccagtttgccccnaaagccgagagggtttattgattttttccctatatccccgccccccacttttttaaaggtggggagaacgggttcaaaccgtgttggttccattgggccctttaggtttggaggaaaagggggggttatggaaaccaaggctgggtaaaccctccaaagggaagggggatggtttgtgggcccccttgggttttttttttggggggggggggttttaggtatttggtttttaaaacggggcttttttaaggggaccccctggcccaaaatttgggcccgggtttttgggcccctttaaaaaggttaatgggga

SEQ ID NO: 562504 - DNA, 759 bp, Homo sapiens
agcggcggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacatttccccttaaaaattggttgttccccaggcgtcgaaggcgggaggggcgggcgtggggcgggacggggagggggcggcagcgggcttctgttccggacccggggtgcaggcgggtgagtcgcggatatcctcatggcgccgcggagcccgtgagccgagagagaagattgtgacaactgaaagtcccacaaacctccacttgttactcttatgatgtgttggccaatgaaaatgtcataggcttgggtgaaactgactttgctccatctgcacatttatagctctagtcccgacgttcgagtcctagcctagatttaatgtgaaatctccctggccgctcctatgtatggtatagatcgtgggtgcttgacatttgtcctgtagatagagatcagggtgagtggaggtattgtgatgggagtggcatgtggttattgcaggagaatcggatagacgaagataagagtcttcgagccactgacgaaaaaccacgcacagccttgtgat

SEQ ID NO: 562505 - DNA, 367 bp, Homo sapiens
aactgtaccatgatcactctctaacagaaataaattgacaagaaaaattactcaagaataggctgggtatggtggctcatgcctgtaatcccagcactttgggtgttcgaggcaggcggattgcctgaggtgaggagttcgagaccaggctgaccaacatgctaaaaccccgtctctactaaaaatacaaaaattagccaggcatggtggcgggtgcctgtaatcccagctactcaggaggctgaggcaggagaatcgcttcaacctcggaggtggaggttgcagtgagctgagactgggccattgcactccagcctgggcaacaagagcgaaactacgtctgaaaaaaataaaaaaagttggaatt

SEQ ID NO: 562506 - DNA, 1473 bp, Homo sapiens
ctgtagtcggccagagtcttgtaggtgcgcatgataattgcggtcgacgaggggggggtcccctggtgggtggataagactgtttttgttcggctgcgcacagaggtgtgcgggcgcacagagttgtggtgccccacgtttgtgattaaccgctgtggcgtgggatggtggccagagggggggagtatgagtcgcgtgctccacggggtatgtatccttggtgcccatcacgagggggggcgtgggttggggctgggtgaaaggtttgttggtacgttgctgtgggtgcgcacttcggtgggggggacgcgaacgcgggctgcccccggtgttggtgctggggggccaccgcccttgtgtcacgacgtggcggctggggggagcgccgctgtgcgtccgtttagtccgcctcggattttcccctggtggtctctggcgcgccttgtgccccgcgggtggatgctccatctggggggcgtttgctcttggtgtggggggttgttattcctgggtagtgctctccccctcagtggggtccgtgtggaggcgcccgctaccgcctggccgggaggtttgttcgcgcgcggggaggggcgccgatttctgtgtatatggggtgttgcgacccgggtttcccctggtgagccccccggttgtggcgcgcgttgtggggtggttgttcaccccacgccgagggggttgtgtctcgtcccttctggtgtcgcgcggttattgtgtggttgggggcccagtggcgcgcactgtcgccctacgttggctcgcttctcacccaccagagggggaggtcgtggcgacgctcgccacagtgggggggtgttgtgagatatgttttgggttgtgagatattctctgggtctctctgggagagatagtgttgcttgggccccaactatggcgcgtgggcggcccgcacctgtgtggccccctgtgagaccacactcgcacttggagagagggtatcactttgccctgttatgtctcgtatgactcttcgttcccacagagagagtcccctcggagagagagagagttttgtaaatataagagaagaggccacgggctcgcctcgcctcgaagagatgccacagtgggtcacacaagtgagggagatatgtctcacgcggtggtaaattggagcttgtcttccccctctcctgcgaagtttcctctcgctatactccacgcctctcgagggtgtgccacagacactgtggtgtctcgaagaggtggacacacggtgcccttctgtgcctatgtcacccacagttcgcctactgtaagacctggaagcgcctcacgcctgccaccgcgaagactggttctccacgctccccctggctctcacggcccctgaatgggtaggacccacccctgactggttttaacctgctttttgcataggcttttaagccgcctggaaaaatggttgatggaaaattaacccccgtttct

SEQ ID NO: 562507 - DNA, 545 bp, Homo sapiens
  misc_feature (4)..(4): n is a, c, g, or t
cggncatcaaaagacagatcactgaggtaatatcatttaattgctatgattcgactattcctttttttttgaaaaggacagattctcactctgtaacccaggcggaagtgcagtggcatgatctcgggtaactgcaaccttaacctccggggtccaagtgattcacatgtctcagtttcccaagtagctgggactaagggcatgcacaccaccatgcctgggtgattactgactattcaattattaaccagcaagcataacaacaaaacccctcatatactctatattgggtaatctcactgtcctaatagaataatgaatattattacactaagaaaaagttgaaaaggctacctcagaagaacatatttcagacataagtgcattaacacgtttcgctctagaaaacagctgttaacaaaatcaccagtgttaacacagatccaaatagctcgaccatcaggaaaacaagagctatggaacttactccatcagaaattgtgctaagtgattttccatggattatcctacctgaagctgcataa

SEQ ID NO: 562508 - DNA, 320 bp, Homo sapiens
caggttgggtttttttggcccacccctgattaatgggccctttatttttggggtcccctaggagggtccagttgttttattgctgtattttgttattgcaggacttaataaaaattgttgatagggccccaacccctccagaaattttatgtctggtaaaaacccccaaaggccttggacttgtgtgaatggccagggtttttttagtagtaattttaaatttaaatgttttaagtgatcaccagggttcctttttacttataaagttggatttttttttagaatttgtaataaataaaaactgctgctttccccctgta

SEQ ID NO: 562509 - DNA, 603 bp, Homo sapiens
ccccgggctgtaggattcggtacgaggggagagagagctagactcgagtgtttgtttatgttttttgagttagagagtcactctgttgcccaggctggagtacagcggtgcgatcttggctcaatggagactctgccacctgggtttaagttcaagcgattctactggcttagccaggccagtagctggggttacacgaggcttacacaccacgcccaggtcatttttggatttttagtagagatggagtttcaccatgttggccaggcagctcttaaactcctgaccacccggtttggcctgccagatgagctgtgattacaggcataaaccaccacgcccagactcctataatttttattatagtatgttgttgtcattgttctagtttattaatagcgtatattgtgaatctcttactatggctaaggtaaaaacttcattaccggtacatatgcataggggcatggcttttatagggtatagtactggtcggattttaggccttcactggggggttttagaaagtgttctctgtggttaacagagggcttctcgtttacaaacctgtctctctctttactcaattcggcgcgctttttc

SEQ ID NO: 562510 - DNA, 538 bp, Homo sapiens
atgaccgtcattcatcatataacttcctcgtactggtactaccccttcacctcctctggtaagctgcgaggctcgtggtatagctccataaaggatagaccatgtctgtgttgttcaccatgatgcctaacacagagcctgtctgtgcttgataaagtaggtgaaatggatgctgcagccaggcacggtggctcacgcctgttaatcttagcactttgggaggccgaggcaggtggattgcctgagctcaggagttcgagaccagcctgggcaacacggtgaaacccagtctctaccaaaatttaaaaaaaaattagacgggtgtggcagcatgcgcctgtaatcacagctactcgggaggctgaggcaggagaattgctagaacccaggaggcggaggctgcagtgagccgagatcgccccattgcactccagcctgggcaacagagcgagactccgtctctaaaaaaaaaagaagaagaaaaagaaaagaacaaacgagaaatggatgctgcaaaggatgtctgcattcacgatgc

SEQ ID NO: 562511 - DNA, 251 bp, Homo sapiens
ggccagtatttctctgtctccttcagtttctgtattgcttcttcagtggtggcccagcagatctcagatgccatttctcggctccccgagtagctgggactacgggcgcgtgccaccacaaccagctaatttttttttttttttttttttttttttttttttttttttcccccttcccatttttttttccctttttttgggggggggcgagggggcccaaagagcggggcgaaacgccagcacggggccgg

SEQ ID NO: 562512 - DNA, 1073 bp, Homo sapiens
ggccgaggctgcagtgagctacgattgtgctcctgtactccagcctgggccacagggtcacaccctgtctcaaaaaaaaaaaaaatgcaatttccacaggcgcatgggccaggttgccagtgcttgtgggccttgtggtggatgaggtgcgcaaatcttgatgaaccggggaataggttccgtcactgcaagataaccagttttcctgggactgcctcgtggtccatgactggtgtggcagtgacagaggttgctattgcagagtgcctgaccagtctgtgatcatgccatgttggttgtaagagcaaccggaggggtcgctcatccatcaggtcggggcccctctggtggggggggtccggtttcctccactagcaattgcctcccctttatgggggaggcccaggttgcacgcccaagggtggctctcttcttgtcccctcgcttggccccctttttcttaacgtcttcgtccgagtcttgccaaccagaaaaatcttctatagactggtaagttgtcctagcaagaaagatcaccggatgaaaacaaactttgtactttccacgagcggaaaagtaatacggtgtccatgtgaaacgagaccaactcggggggcctaccagagatgacccgcactgtgttacctgaggcccccagggggggtcacacctgggtgtttctggaaaagggagtccagggccagattcaggcccttattgtattgacgcccctggaagtgtgaccaaatgcccagatcgtgcccccatcgcagagtgtccccagaatgggtttcctgggagtccctgcaagcagagcttgtagggaacgtggcatgcatgacttgcctcttgatccctggaaagtacatcgggattcgctgtacacgcacagctcgtcacctaaagctgtgtgggccaataggcctggactcacagaggagggtaccatataggtaaccgggttcggacaacaggaatctggtgcgagcctgatcgtagctgaagagccatgtgaagtaataaggatgaaagcatattgctatcggtgattagaggaaaatgtagactaacac

SEQ ID NO: 562513 - DNA, 695 bp, Homo sapiens
aaatgggatccccaccattgtaggtcggtccccagtttatcttctaaatctccaacctccccttctgccattgccattaaaaatcaactaagtgcttttaagtctttccatggtcagggtcaaccttgttaataaccaggtgcccgtcttaatggtgtaaagatttccaatactcctttaaaaacccagtgcgggttattttatgtcttggacgagcataaccctggtatcgtaacgaaattcttttttgccaccacaagaatttgtttcaatttcttaacgttcaaacacatgtcagtgttgtcacgtgtgcatgtgatagccacagcacaagtattcttcaggagcatatgtcctccagccttaaatggacccttgtccagctcctgtgaaaatcttaatatttgagaaagacattcaatggtacttgttttcggtacgcttcatgagtagttaagattttcttgtattaaggttaatcactaaaacggtgtttacttgggtttcgtaaactaagccccctaaagatgttttccattttattgttaaacacttggtgttagcaagggtcagcgctataaaaggcccaatggcaagagtttctgcaaactctgtaaagctgactgaattcatttgtcatgtaatacattgctgagtggcgcttcaatatggtaacaggcaataatattttctta

SEQ ID NO: 562514 - DNA, 236 bp, Homo sapiens
gatttgagggcgcacactgccagatgcagtatctcgagcactttttcgctgctccatcaagggactttcctttgccgtgtctcatccttgttgttgaattgttgtcccaaaaagatacagtcacctggtcaacagcccgcaagctcttccgactcacggggctaaaaaacacagagaaatggtcctggaggctcaatggtctccacatggagcctgccctaggacacgaatgttca

SEQ ID NO: 562515 - DNA, 959 bp, Homo sapiens
agcgggctgtcggcgcccgggccgtcgcaggcccggctccgtgggcgcggagcgcggtgcgcacggtggtgcccgagggccgcgggctgggcaggcgggagcgcggtgggtgttgcccgggccgttggacggggtatggtcggagccgacgcgcagctgcagctggcaacactcgaaggaacgatcgcgtgctccggtgctacgcgtggactgctgtgtctggagcagcggcggcggcaagacccacgcgaccgagaaagatacgggcgcgacagtgtttacgacgacgtgtggcatgggattgccctacggtatgaaacaaaggactcattcggaccttgcgacggcactacaagtcggttggagacctgggcagcagggactacaggactgctggcgaccggccgggaggcacgacgggctggggtcgcgtggccacgacccgacaggctcccggaggtcgtgcccgaagggtggcgcagtggaagtgtccacgcggtatgtgaacgacaggctcaggccgaagcgatagaggtccgaagctccctacgggggtcctacccgaaagggtacaggacgtctgcctcgggcattcaagctgacgatcggagacggagccgccggccgcaacggtcgtagccgccgattcgcgcgcagcccacccgccgcctactcggggaaccatggacctcgcttcggaggccggttggaaccaaaaatagggcccgaagaagattgaacaccgtagtttcccttcccattcgaagaacggagtgggatcgggaatttcaattccaaaccggatggaaccccaatatttcgccctttctaattcgacttagacccggtttgttagccatagagtatgcgcaattggggaaccgtttgtgttccatagagcaaaggattacgggtacagaacgaaaaccgtttaaaaaatgccggtgtgcccttgcggt

SEQ ID NO: 562516 - DNA, 206 bp, Homo sapiens
tcccacctcagcctcctgaatagctgggactataggcatgtgccaccatgtctggctaatttttaaaaatatttgtagagaagcgatctcactgtgttgccctagagggaaaagattaattatgtcttttgctaatgaagaaactgtgtaaacaccaggcacggtggctcacacctataatcccactttgggaggctaaggtggga

SEQ ID NO: 562517 - DNA, 273 bp, Homo sapiens
tgggccctctttggtataagaggaatattgcagcaactgaacatacagctcgctgtgtcttttttgtgtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactattatttatatt

SEQ ID NO: 562518 - DNA, 676 bp, Homo sapiens
  misc_feature (352)..(352): n is a, c, g, or t
tggaaactttaaaatccctcaaaaactggtttattatacaagggagtttggagtcacgaggggcttatcggtaggatttctggtagcgagctgcgggcacctagggcctccaaacacttttgggcactccgcagcgacgcagggtcagctaaccagcagggtccgggtcataactgggcatagaggatgtctttggatctcctttctgtggaagccttcatccacaattatttctggggtcaatacaggcccaccaaggggctttggggcagaatgggactggacggtgtataagctataacatatctggggcgccacgtgtggtaccaaccaacgcctttataacaaacgnggaccactgtgtatgtgtcttaaaccaccctagacataaaatcgcggctccctttgccgcggtggaagataaacggcgcagaaaacgactcggtggggggcctccccgaaggagcaacgactgctgtgtgataacgccgttgggaataagcgccgtagtgtgcagggcgggtggatcttacaagactatccaattgtttccgccgagggggggggtgcgcgacgacagcagtgttatacacaccctgttgtgatgatgttgcacgacaacccaccatgttgtgggctcctgggctgagtaattctgggtactacgttgttgtcc

SEQ ID NO: 562519 - DNA, 189 bp, Homo sapiens
  misc_feature (23)..(23): n is a, c, g, or t
gttgggttttggccacccccctnccccccggagagccctttcctttttcccggttttttttttggtggggggggccgcccccccccccccgggttttttgggtgggccggggggttttggggggttcccggttttttttttttcccggcccccccctgggggtttgggccccccccccgcccctgggga

SEQ ID NO: 562520 - DNA, 318 bp, Homo sapiens
gaagtgacttaagggagaaaaaaaaatagccagcgctcacgctgtaatcccagtactttgggaggccaggtggacggatcacctgagatcaggagatcaagaccagcctgaccaacatggtgaaaccccatctctactaaaaatcaagttagccagatttggtggtgtgcgcctgtggtcccagcaatacaggaggctgaggcaggagggctgcttgagcccaggaggtcaagactgcggtgagctgtgttcgtgccactgtactccaacctaggtgacagagcgagatcctgtctcaacgaatggggttaatcctga

SEQ ID NO: 562521 - DNA, 83 bp, Homo sapiens
acaatacagaggacaaagacccctcacagaatgcttttcaaccaacttcaacttttgcacactttttcaacggtcccaccaca

SEQ ID NO: 562522 - DNA, 974 bp, Homo sapiens
ttctcttcttcataacaattgtgtgtgcctgggcccttgttaagtcctctttgcattatctctggctgtgactagcacaacatgtgctctccttccactttcagcctggaagatccaacttctgagccctgaatgacagaccagcttcataatgggaagctgacaccaggctggcttcaagggctatgacctgtgcagttgcagaaagccttgatctcagaagggttgtgcgcttagtttacaatgctctgctgttgcatcttgaaattcttaattttttatcaaggatccctatattttcattttgcgctgggtcctactaactatgtagctcatcctgccaacatcattggcttccctgagtatgagagttcagaagaaacttagatgctattgtctgattcagtcatggcagcttacaaaaaggaactgtggggagcagtcactgggtgactagcctgaggttactcaggaagttagaggcagagctgcaatcaggaccacttctctttactgctagctgtatgctctttctactgcaccctggtcattaaaacatctcccaagccaggaacaagttctacctcgtagggtgggcacagtagcgtgatcactctctcagtcattctgtactcctcctttgcttgaccaaaagagataggaagggacccttttgcccacataaaaacctctcaaaggcttggcaacaacagataattgacgcacgtggttggctaagaccaatggttcaaaccatggatggtcaagaccaataatttgcggtccagcagaggaaaggctagatcagcaagctgggcctacatacctaagtaatccaacatcgcgggcacctggcgaacgcatctgggtacaacggcccaacacggacagaaaggcacacggagtacaaaggaccctagtgcaacacatgcgcaccacggatcggatggcagactggagaggacacggacgct

SEQ ID NO: 562523 - DNA, 449 bp, Homo sapiens
tttgtgcctatcaacccgtcatcgaggttcaagccctgtatgcattagatattcgtgtaattgtctcgctccctggctccactcactctcgagagagcccagtatatgatgtccccctccctgtgatccatgtgttctcatggttcagactctcacttatgagtgagaacatgtagtgttgggttttcggttcctgtggttagtgttgctgagaatgagggtcttccagaggaagctggtattatcctgagctgaaactggaagccagctgaaggttatagaggtggggaggtgacataataggatttgtgactgtagaagatggctctggatactacgtggacagtggttaggaggggccaagtgtggttggggagatcagtgaggaggccatgaggtgactcaggcaaagatggcggagggtgggaccagggagggtgagcagagaa

SEQ ID NO: 562524 - DNA, 368 bp, Homo sapiens
gtgagatcctgtctctaaaaaagaagaaaaaaaggaatgaaaaatagttaagcttctttgggaaggcagttttgggagaatttatcaaaaattggaaatatacataggtttttcattcattgattatgctttaagatttgattctagccaggtgcagtggctcatgcctatattcccagcactttgggagggcaaagcaggaggattgcttgagcccagtagttcagtcagcctggcacatgacacactcccatctctacataaatacaaatattagccagcaatggtggtgcacactttagtccagctactgggaggctgaggcaggaggattgattcagttcgggtggctcaggccacaaaagccg

SEQ ID NO: 562525 - DNA, 296 bp, Homo sapiens
tacatggtgaagctagcagaagagacagataggataataagtctaccaatagaccagtaccgggacctagtgcggaggagtctagagaagtgaagcaatcatcagagacgcctgctgccttggctagtgggaaacctcttcatggtactgatgacccactgggcgaaaggcccaccctagataaatacaaagaagccagcaggacaagggtaactaaggctcagcatccttccaggggctaagcagaacatggtaaacagcagcaggggagcgaagaggaaaaaggtagtggtggc

SEQ ID NO: 562526 - DNA, 271 bp, Homo sapiens
tggcgacgcttccatcaatcgggggccagttgcatctaccctggtgaatccaacactcagaaagcatgactcaggcccagacatctcttgccagaaaagcacatgggctacatttaaatggcattggcccctcatccctgtgaatgaggtgctctaaggggcacccccggtccctgtccacaaaaaagggccccagccacctgaggcactctgccatgttcacaggcccgctacctttctgtccactgaggtagatggaagcgtcgcgcat

SEQ ID NO: 562527 - DNA, 426 bp, Homo sapiens
cacgaggggccgaggggcgcgcgctgacggtcaagcaggcgctcgagcgtgaaggcaaggtgcccgaggcgcgcctgttcctgaccgcgccgaagctcgataccgacggcatcaaggacaagggctcgccgaaccgcgtcgacttcacgatccggcagtagcggcgccggtgcgccgatgcaccagccgcacgtcgcgaatcaccatgcgatcgcgcggcagcgcgggcaggcgggcgaagtccagcgtcagatcctgctccggcacggtgtagcgcaggccgcgcagcaggaacacgaccgcctgcttcatcagcgccacggtgatcccctcgccgggacagcgatgatgatcggcggcctgcgcaccgccctgcgggatgaagtcgaagggcgtgggcgcgcgggccaggaagcgctccggtag

SEQ ID NO: 562528 - DNA, 1176 bp, Homo sapiens
agatttggtttataaattgattttaaaatcactttatcagcacaatttcagtcacagcagttcaaagcacaacagcactttttttcccctccatcgtcatgtcacatcgtcgtcagctcatgcattcatcaatcgtacacacaccagcctctcattccagctgtctcaagacatgcagttcgtcaaaacccgaccacaagacacatacatcccatttcaactagcaaattccatctcatgcctattatctcaactcttactggcacaacatcaccatttctgcatcctcttttcatcaaagcagctctagtgctatggcccttattcattactgcatattatctatcacatgactacaacatcaactgcactcatctcttacggcgaccatgtacatcttttacatatgtctcttccctacagggtcctcaggcacttctgcatgccacactcttcatctcggcatcatccactctgcacgcacactctcatacactgcacactacacaacactggcaaaacaccatatacggtcaaacagtactgccgctatctggcacctcgtggagaccgatcgcgcaatcagctaccctcacaagcacaaaagaacacacgacacagatcgacaaagacatgatcccaacacagccctacaccaacactcagagacccacccatacacacgaacacaaccacatcctgccatccaaaacacccaaaagaatcacggcaaataatcacgacgctacaacagtgacacatcagcccaccaccacacccacactacacagacacacaccaggaaccaccacagagcaaccggcaatactcaaccacaaaaggacaacccgcggcacgcgacagggcacgagcgtgcccctcccgctccctccaccaacctggacacagacacacaacactcacgccacccgcgcacacccggccctctcccggcggaaaagaacaggcacaccccaaaccacaactcaataacacgaaaccgccagggcgctcgcgaacaaataaaccgcgaaaaagaaagcaccgggcaccgagcaaatcaaccacttaacgagacaccaaaacaagtcgacaaaacgcaacacgaaaatcagcccaaaaaaccacacacacgcacaagctacactcgcaacgccaacgagcacacagcacaca

SEQ ID NO: 562529 - DNA, 298 bp, Homo sapiens
agccttgacggctcaaccacatgttagtggcatactggtggacaccatggatcttgggcggctggacaggtttttgtgatgtgagggacacgcatggtgcacatggtaagcttggcaagggctccagtgaactgctgacgaagggttaaaggacccccacccccatgcctgtaccagggctggactccagagcgggtagaggacagagcagctgtgggcttttcattctgaggtcttggaccccctggccaccgcaagggactctttgcttgtcagggcttgcaaaaaccaaccttcg

SEQ ID NO: 562530 - DNA, 927 bp, Homo sapiens
ggtcgctgcagcgggcctctgcgtgggcggcggggaatccgcggacatcgggtcgggtctaggctcccgagttccgcgactcctgggcgggagcccttgtctgggtctcgcgtggggctgccagatgcgtagagccacactgactagttcccttcttgtccgcttttctccagcaaatggctggatgacgccgcgtgtcagcggggtgggcccgggggtccccgtggtgtgccctggtgatgcgggaaccgcggtggctttccgcggagggcttttcggctaagtggcgatcgggggccggggttcgcggccgatggacgggcgccggggccgaggcgccagcggaagtctcgcggaggcagaggccgagggactgcggagtggattgcccggtcacccgaaggtttgggcgccggctctgggtcccatgggccgtgaggggatctaagtcccgtggaggacgatcgtaatcgtcgtatcctaccgcatgcgccattaatggagtctagagatcattgatttcttcctgagcggcctctctcaacggtattgagcgttgccgaaggattattgccagtgcagaagccatgacccgttgtcgggccagggcaccaggttcaaggcatttcgtagctaatcgggggactactagatggccatcgtcggtctgggtgttaagtgctccaagggaggtggcaccgggcatccggtggggcatcatcctgggcaagctctccatcgtcccccgtgacgcagaagggtacgtgggggaccaggatcggcgagtcgcacaatggtccgttccacggtgtccgggcgtgcggctctgtgtgggtagccctatccctgtacccgggcgctggcttgttccggcctgtgctaaagatgccataaaggcgtttccttatggtgacccaccggggggct

SEQ ID NO: 562531 - DNA, 139 bp, Homo sapiens
tgctaggtcgatctctagcagcatcccctcagcaatggtgggctggctgagcgcgcggcacgcgacttgctaacggtttacaggggcgcggccgccgcctgaaccgtccgacgtccggcagtcatttttccaaggagag

SEQ ID NO: 562532 - DNA, 161 bp, Homo sapiens
  misc_feature (33)..(33): n is a, c, g, or t
  misc_feature (87)..(87): n is a, c, g, or t
  misc_feature (128)..(128): n is a, c, g, or t
cagcctagtggaaggtgctgagggggcctgagnaggaccgcctcctgaccctggtaggagggtcacatcacttggtgccaggtgccnttggtgaccacttcttctggagcgtcctgcctagagctcanccacaggactgcttcaggccgtgcacaggtagc

SEQ ID NO: 562533 - DNA, 877 bp, Homo sapiens
ataatatcatgaagtacatatatattgtgccctatactctacatgtttaaaactataaatatgcccaatattctgttatttgccctactttaagtatgtgtagttgtgttcgttcattgcacgttaccttgttatctactcttgtataagacttcgaggaattctgaaatggtgaaaattgtactcttcttctttctctttgtgtcgtgaatcattatgtttttatttaatagcacttatgagcatatagaatataatttggcatatgatgcatattactatatgtattcggttaatttttcatatagtttatatgcttacatgattgtgactcttggccagatgaggttgatagatattcaagtgctttatttgctggtgtaggtatctctcttactcgctatggtggattcctccttctctagagacctcgccgtgtggccttttcagttgactggtgactgctttgccctcgtctacctctggtacaatcgggtgttcttggggagcgatctctcctagtcttgtgctaatagatgattgtgatcgtgtcctatgtgtgatcttgttggctctatcaggtataaattgtttctcctttcctttattgtgggttatgttgagctctcctttgatgtcacccgttgctcgttccttttttgtcctacctagatgaccagtgctatactgttgagaagcgtctgggtctgccggacttttgtgcctctaaattctcgtttctgctattaggtcggagaacgccttgtgtggggataaccctggtctttggtcctacttcccctccggttcccccttgaacatcgcgcgccgacggttatccaccccgactggctttggcacgcacccctgggctcgg

SEQ ID NO: 562534 - DNA, 304 bp, Homo sapiens
aaaaatacaaaaaattagctgggtgtggtggtgctcacctgtaatcccagctacttgggagtctgaggtgggaggattgcttgaaccccagaggtagaggttgcagttagcccagatcgtgccacttcactccagcctgggcaacaagagtaaactccgtctcgaaaaaacaaacaaacaacaaacaaacagaaacaggttcagagggaggacagttctctcttctactagaggggtgtcaggattcgtcgacgcatttaaactcctcagcggcatggagccacagcacagttctgccaagacg

SEQ ID NO: 562535 - DNA, 242 bp, Homo sapiens
caggataactttattttaatgggcatgggcttgtctaaacccaaaggtatgtatattttcattataaaaaaccagtttaaaatttttttttattttaattgtttgaaatttttctagagccaaagaagctctttaaaaaagttgttttttccaaagaacaaagccaggttaatgacattcaattttaaatgaaacattggaattgggccttttttccccccctggattaaataaacttgtca

SEQ ID NO: 562536 - DNA, 120 bp, Homo sapiens
cctcctccttggctttaaggcgctcttcacggcgcatgcgtgctccttgtgtcttagacctgcgggcctcagcctggtcagccaggaagcacgcaaggcgctgtgaagagcgcctccagg

SEQ ID NO: 562537 - DNA, 324 bp, Homo sapiens
  misc_feature (67)..(67): n is a, c, g, or t
  misc_feature (106)..(106): n is a, c, g, or t
  misc_feature (118)..(118): n is a, c, g, or t
  misc_feature (136)..(136): n is a, c, g, or t
cgcatccctatatctactttgtgtatccctatgactgttgcaccaatgcctcgtatcacggatgttntgaaataccctgcaccatgtgaatgttcatttcttcctnctcgatctaatncattaaaaatcagcttgnagtttgcttgtctctatattcttccatataaattgttgattcaaccatcaggttgcaggaaaaagcctgttagtattttcattggacttacatggaatttgtagattttgaaaaaacagatatttttatgagtcttcctattcataaaaatagtatgtctccatttacttatgtctttaagtgtattt

SEQ ID NO: 562538 - DNA, 117 bp, Homo sapiens
gaagagaacaggtaggctcatctgcctgggcaggttctgagccttgggggacagttcacctacatcccaggcttctgttgtccttgcctgcctgtaaggaataaagttgctttgctt

SEQ ID NO: 562539 - DNA, 2077 bp, Homo sapiens
agctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacgcagactcccctgagttcaaggagcagttcaaactctgcatcaaccgcagccaccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccatcctggctaacatggtgaaaccctgtttctactaaaatacaaaaaaattagccaggcatggtggcgggcgcctgtagtcccagctactcgggaggctgaggcaggagaatggcgtaagtaaacccaggaggcggagcttgcagtgagcccagattgcaccactgcactccagcctggacaacagagcgagactctatctc

SEQ ID NO: 562540 - DNA, 111 bp, Homo sapiens
  misc_feature (95)..(95): n is a, c, g, or t
ctgtctggaataataatttaatgctcactgtggccctgactgaaagtcaagctcaggcacaaatagggccatggccgtgcttcgcttttgagganacaggcaggcaaggag

SEQ ID NO: 562541 - DNA, 566 bp, Homo sapiens
  misc_feature (361)..(361): n is a, c, g, or t
gcagctgtggcaggcctgttgggcctggaccttatttaggttgtgagtgggccccggccttgtagtgccttttgcccacgctacctacatttgggtgaaaactacctcatccgctatatgccttttgccccagccattcaaacgttccatcacctaaagtggaccttttgggaccgttttaaggtaccaactgggcagccttaaaggaccctggagttgctgctgggtcattttcaggaacagcccgggtttagggttaggatccttctgcccggctcaaccctgctttattcggccggatggttcccttaaaaacaggcccagcccctgcccctcagggtggcaaaactggtttaacaantgacaggccaggcccctgcttctgggcaacgggtgttggtgctaaaacttaactgttagggtggcgacgagggccctgcctttccccctttgccctattagctgtggcaaggcagcccccctgtcccctaggtcaatggagccccgggttcccagccctgccttgttagccccccgtaggccctccattaatgcttgtttaagga

SEQ ID NO: 562542 - DNA, 252 bp, Homo sapiens
accgtattcctaagtacggaaatgtgattctgtgtatgtattaccagatgtagtacttgagtatcccgtacgtggcgcattggttcacgaatccaactaggaaccatgaggctgccggtacgatccctggccttgatctgtgggttaaggactccggcgttgccgtgtgactgtggtgtaggtcgtatacgcggctccgatcccacgtggctgtggctgtggcataagccgatggctgcgtaattcgggtta

SEQ ID NO: 562543 - DNA, 393 bp, Homo sapiens
actctagaggacccccatatcgtggcagctgggggctgaggaggatgggggaactgggcagtgaaagctatgggtgtagcttttcttgtgggtgatgacaattttctgaaattatagtagtgacagctgcaccactctggtaacatagtaaaaatcactgatttggccgggtgtggtgggctcacgcctgtaatcccaccactttgggaggccaaggcgggcggattgcttaaggtcaggaggcctgcaccatgtagcccagccaatttattagatatttttatagagatagggtctccccatgttaccaaggctgatctcgaactccaggcttcagttgtcctcccacctcagactcccaaagtgctgggattacaagcgtcagacaccaca

SEQ ID NO: 562544 - DNA, 114 bp, Homo sapiens
gtcagtgtcactgcgatgaggggagataaactggggttcagatctcaggaggctcggggctagttagactcttccacctggaactcttttacaatattccccaccactgcctcg

SEQ ID NO: 562545 - DNA, 581 bp, Homo sapiens
  misc_feature (391)..(391): n is a, c, g, or t
cttctcaatgctcttataggtcttgaagtcatacatctactgtctggatctatactcgtgtcggatatcatcttagtcttcgtctactgactccatgaggacagccactgaaagtagcactgctgacatagaactttagaactttagtcgattcacagcggaacaggcgagatagagaaggagacataggtgttaaaacaaaaagaaaactttttaattttgcattcacaccactactaacaccaaatgtctggagtatctatacaggaagcatatctccaatgttcctaacaccaaccgggtatgttacgaatttaattcaattctgacatgatctacctgaagttgtggtcagatcccacaagttaaggggtcaatttcattagactgnccccatttcggatgtcaatcacaaatctgggcttccagtacttttgaccaactggctgtaaattgcggatttccatgatcccttcccttgggtttaataattcgctggaatacttcacagaattaaaaaaaaaacttacatttactagtttattaccactgaggaaatgcccatttaacagatgctaagc

SEQ ID NO: 562546 - DNA, 106 bp, Homo sapiens
gattttgggggggggggccccccctccggtttttaaagggggttgcccgccccccttgggttttttttttaaacccctgggggggcctttaagggtggccttttca

SEQ ID NO: 562547 - DNA, 264 bp, Homo sapiens
gatcgagctcggtccggctgagcagctggcagatctcaccttggtgtttggcactgctccaggctgtcagatgctcgcctggggttgtgggcgctgctccagactctctgatgttcacctgtggttgtgggtgctgctccagaccatcagatgctcaactgggggtgtgggtgctgctccaggctgtcggatgctcacctgggtgtgcagggtgctgttccaggctgtcagagactcacctgagggtgtgggtgcagctccagg

SEQ ID NO: 562548 - DNA, 302 bp, Homo sapiens
tttttggggggggggccccccaaaaaacccgggggttggggggaaattctggtaaaaacctcctttaaacccgtttttttcccccctgaaataaaaaccctgggggggttttatttaaaaccgggcccccccctgggggcttttggggttttcccccttccccctggggggttttcggggttcctttttccccccccttttttttgggttttagggggttggggttaacctgattggggggggggaagggaattttttgggttttttttttttttttttttttaacgggggcctttttttca

SEQ ID NO: 562549 - DNA, 370 bp, Homo sapiens
aacacatacccaccccatgtctgtcttttctcaaactaaaggagaaactaagggatggttgcgcatctcgcgggcctggggggataagagatgatggctggggaccaccggggcagagtcaggttgtctgcactggctgagcgcttcctcgcggatcttcttaggtccttgtacttgtcctcgcagaggcgagagatggcctcaagcttgtgagccctctccctgctcaggggctccaagggaaagctcaggttgttcgcttctgccagagaacgaagatcaaaataatacttggcatagacactggaaggaacattgatgttgaactgcagcaattcaagaaactgtcgctctagctcgttcatgtcct

SEQ ID NO: 562550 - DNA, 271 bp, Homo sapiens
gctcttgcccttttagctttctgcctgctgttgtgtttacctggaggtcccttgggccctcccctttttcaaattgaacccatcctcatccagcctgttcctcttactgtttcccttgtttccccaaagggggggttagccccttgcaacctgtcagaattgagggggcctcctgggtttttccctttttccccctaggatccttttcatcctacttcctgggacctgttccctccctcccttttgcaacggaatactcaattgggcctta

SEQ ID NO: 562551 - DNA, 206 bp, Homo sapiens
ccccaatgtttagccacaggcatgtatcaacacgtcagtccagcctgtggctttggaataaagatgagtgtctcccacgtggtacatgggcaggcagcaggaaggcgggaggggccatggtgcccggactcagacccaggctcttagcataggagggagcctgggcatcgctgcgtgcacccagaagctgggcacacattatggag

SEQ ID NO: 562552 - DNA, 317 bp, Homo sapiens
cgcctgggaatcctagggggctccatgaccccttccccgccagacccagacttgggccgttgttttgacatggacccagccaggccaagctgctcagacctacttccttgggagggggtgccggaaccagccctgtgtggagcccagcttcaaggagcggaaggctggcttgaggccccccagctggggcggggacttttgtctgcctgtgctccatgggggggcggctccccccagcctgggcccctgggttttttttttaaggggcttccagagaaaacggccccccaatcaataaagaactgggcagaacccca

SEQ ID NO: 562553 - DNA, 373 bp, Homo sapiens
ctgagacagcaggcccacggatgtccattcagcaagaggctaaggcttgggggtcaggtgaagaatgttgagagacacaaaaattgttctagtatagtcatgacttagaaccataaagaatcattgccgagtctcttagcgaatccatgtaattggtgtttattgcggagatatgaatgactttcagtaacagagtctccgaatcatgataggtatggaggtggaaattctattattaagattgatgattaccggaatattttcatgattcctcagatccatttgtggagtggccttatgcttcaccagatgatgtttattattaaagttgatttttagcgagtgttcattaataaaaaatggtgttaaccac

SEQ ID NO: 562554 - DNA, 421 bp, Homo sapiens
  misc_feature (148)..(148): n is a, c, g, or t
  misc_feature (303)..(304): n is a, c, g, or t
  misc_feature (329)..(330): n is a, c, g, or t
  misc_feature (346)..(346): n is a, c, g, or t
  misc_feature (356)..(357): n is a, c, g, or t
  misc_feature (397)..(398): n is a, c, g, or t
ttccactgatatgactaaactgtgaaaaacataatgtgaaaagtatactagtacacttaacgtatgagttccgttgaaacactgcacttatgtagacgtgttacatcgtcaactcgtgtgtaaaagtatctgaacacagaggtggaangatgagacgtcggtttctagcatacaaattgcaattacgtgtatgatctcgaagagtacttaaacatggcctcctacccacactatgatgtcatctctgtatgtggcatgatacataattagagaagcgaatgctgttattgcagtttaatatannatgcaatttttaactccctgtgttnncaaaaatggagttcantcatgggctnntaacacatgaaaatggcggtggcacaggatccacttgcanngaacccaaagattttacacaatc

SEQ ID NO: 562555 - DNA, 1081 bp, Homo sapiens
tctgtggaaagtgggcggcggagccagtgtccctggaatggctggagactctgtcaggcctagggtgattctggagcggcgggcgcggtggctctgagcgtccgacttcgatctagattaccgtgtgacgcggcagcctcagcgacctgcgagatgcatcgactctgcagggcggcacgctggacggaacacggaatgtggactcggagcggcagacaaagaggcgtaataggatgggcagccggctgaccgaaaggccaatctgaccgcagtgcacagcgtgggtcaatccatgcacgaacacatttgcagaataaacacgtcccgaagggcggacaaaccaagacaacaccagtgcagacaggaagagatccaaaggacacaaagggcgacagcaacagcaccaagaagcgcacacgaagcgagctggctgcgcaagagatacaccggagcagatgggacagggaagcaaaccttccatggcaggcacattggccaccagcgtgcagcgccacacatagggaaagaaccgcagaatctaggacgagagaagacatggacacagcggaccgactgcgacaccagatcacacgcggggcagtagaccagaggaagggatgccaacgggcaagagacaaaagacccaaagagacaggcagaggggagtcaaaaatgcgggaaaacacgacgcgaccgaaacagaagaccatcaagggcaggctgagacagcaaacgaaaaccgagaagcggagcacgtacccaaagaagtatcgagcgaccagtcccgacagaggaatggaaagaatcaccgaccgagtggtatacgggagttacaagtaaagaagaagagggaagagaagaccggcacgtacgcatgtagccacagaccacgcaggcgagagaagccacatattagagcagaggaggccaggcgcattagcctcgaagtagcaggacaggacgaagccacgacagcgcgagagacacgacagagctgaacgtcatacagagagcaagagagcacgacacagcagcatacaaactgaagcattaagtcgtactagcaaacacacaggacgag

SEQ ID NO: 562556 - DNA, 375 bp, Homo sapiens
  misc_feature (132)..(132): n is a, c, g, or t
  misc_feature (325)..(325): n is a, c, g, or t
tgagatggaaggatcacctggactcaggagttcgagtccagtcttgccaatatagtgagaccctgtctctaaaattgaaaaaaaaatggacaggctgggcgcagtggctcatgcctgtaatcccagcacttngggaggctgaggcaggcggatcagatgaagccgggagttcgagaccagcctgggcaacatggcaaaaccccatctctactaaaaaatacaaaaattagcaggcacgatggcgggccctgtaatcccagctacttgggaggcttgaggcaggagaatcgcttgaaccccgggaggccggagttttgcagttaanccgagattgcgccacttcactctaagctttgggcaacacagcaagaatcc

SEQ ID NO: 562557 - DNA, 502 bp, Homo sapiens
  misc_feature (11)..(11): n is a, c, g, or t
  misc_feature (15)..(15): n is a, c, g, or t
  misc_feature (97)..(97): n is a, c, g, or t
  misc_feature (298)..(298): n is a, c, g, or t
  misc_feature (355)..(355): n is a, c, g, or t
gaaaacgccantccntgtctcgctgcccttagatttaaccctttctgggatgggcagggagaaagaaagaccttccccaagaatgctgaccaggcanttgtgtttgtggggagagccttcctgacagcaaagaaggaagaactaacttcctttgccatgaacaactcagaatccggggggtttttgctgctgttttctggctgttttttggccttgctctgttgttcactgcaacctcgactcctgggctcaaggaattctcctgcctcggcctcccaagcagctgggactacaggtntgcacatcacatccggctaactttgaagtattttgtagcgatggggatctcactatnttgcccagacagtctcaaactcctggcccaatcagtccttctgcctcaatctcccaaatgctgagattacaagtatgtgccaccacaccaggctttagaatcctgttctaaaagttctttcttatttgaccaccatagcttcttatg

SEQ ID NO: 562558 - DNA, 274 bp, Homo sapiens
tgtagaaattttaaaataagttttatgaaacggtggaataatagggatgattttaagtattgccatttttgtaatttgggttattagggtgatggtatcaccattttttgaaagtgggtgaggtttggttattttgtatggggaaaaaatattggttggaaaagactaccagttagtgttggaaaaaccgggtggtgtttacaatgttgctaatcattgcaaaacattttaaatgggagcgttgataatgaatatgaaatgcaaaacgttttta

SEQ ID NO: 562559 - DNA, 797 bp, Homo sapiens
  misc_feature (26)..(26): n is a, c, g, or t
  misc_feature (85)..(85): n is a, c, g, or t
  misc_feature (92)..(92): n is a, c, g, or t
  misc_feature (153)..(153): n is a, c, g, or t
  misc_feature (167)..(167): n is a, c, g, or t
  misc_feature (237)..(237): n is a, c, g, or t
  misc_feature (255)..(255): n is a, c, g, or t
  misc_feature (308)..(308): n is a, c, g, or t
  misc_feature (314)..(314): n is a, c, g, or t
  misc_feature (317)..(317): n is a, c, g, or t
  misc_feature (319)..(319): n is a, c, g, or t
  misc_feature (332)..(332): n is a, c, g, or t
  misc_feature (337)..(337): n is a, c, g, or t
  misc_feature (353)..(353): n is a, c, g, or t
  misc_feature (355)..(355): n is a, c, g, or t
  misc_feature (374)..(374): n is a, c, g, or t
  misc_feature (389)..(389): n is a, c, g, or t
  misc_feature (401)..(401): n is a, c, g, or t
  misc_feature (447)..(447): n is a, c, g, or t
  misc_feature (462)..(462): n is a, c, g, or t
  misc_feature (476)..(476): n is a, c, g, or t
  misc_feature (489)..(490): n is a, c, g, or t
  misc_feature (504)..(504): n is a, c, g, or t
  misc_feature (519)..(519): n is a, c, g, or t
  misc_feature (521)..(521): n is a, c, g, or t
  misc_feature (545)..(545): n is a, c, g, or t
  misc_feature (553)..(553): n is a, c, g, or t
  misc_feature (567)..(567): n is a, c, g, or t
  misc_feature (569)..(569): n is a, c, g, or t
  misc_feature (588)..(588): n is a, c, g, or t
  misc_feature (603)..(603): n is a, c, g, or t
  misc_feature (615)..(615): n is a, c, g, or t
  misc_feature (626)..(626): n is a, c, g, or t
  misc_feature (630)..(631): n is a, c, g, or t
  misc_feature (644)..(644): n is a, c, g, or t
  misc_feature (687)..(687): n is a, c, g, or t
  misc_feature (775)..(775): n is a, c, g, or t
gcatacaaagaatctagtgtgctcanggcttggtacaatgagctgaattagatggccttatgaaactctttctaacctcttaccnaacctgnttctccttggttaaaattatacttgaaggcccagaacactcatggcacatttgtttaatantgcttatagttagnttaaggtaattttgcttctacagtattttggaaggtctgaaaacttgcacagggtcatctttgtaattanataaccccaaactaagangcacaatgtctccttcaggtgatcacacacagtggacgagtatgtgcaaacanggacanaananttcacttacaaangtganttgatgttaacactananaatgatgactgtagaacanttgagcaagtaaaanagtaaagcacanagtgagtgtatgtccatctaactggtacattgataatttagtttgngcacataaaaggaanatttatatggcttncaaatgcagagtnncatctattcgtganttctctgagtattanancccgttcctttttcatcttaaaanaatgaatnttactgttgcacanangggcttaatataaggacanaacactgcttctaantttgatatatgnaaatgtgctgnattnncagaaatactggnatccttttatgggtaaaacaaaagtgaacattgcatgcatgtnatgtgatgaatttgtaatttaggagttctttggggcttctgtgacttgggaaatgcttacattcaggccttaatgttgcattagctancatgttttccctctgatgtata

SEQ ID NO: 562560 - DNA, 582 bp, Homo sapiens
aaaaccccagcaactttaggacacaatacgagagtgtacaagtggctcccccagaatgacctccttggtcatccaaaaacaaaagcctttgtaactcatggtggggccaatggtgtctatgaggtgatctatcatggaatccctatgattggcattcctttgtttggagaacaacatgataatattgcccatatggtggccaaaggagcagctgttacattgaatatcagaacaatgtcaagatcagatgtactcaatgcactggaggaagtcatagacaatcctttctataaaaagaatgctatatggttgtcaaccattcaccacgaccagccttaccgaagcccctggacagggcttgtcttctggggttgagtttgtcatgcgccacaaaagggctaagcacctgagatcacttgggacataaccttacctggcaccagtaccactttcctagatgtgatcggcttcctactctcttggtgttgcagtcactatagttcctactgtaagtgcccttggtcattaccgattcctttggtaaagaaagaaaagaaattaagatgagtagagctctttgcc

SEQ ID NO: 562561 - DNA, 706 bp, Homo sapiens
tcgccctaaaaagagaaaggttcccccagtcccaatccttccataggaaagtggggtccctaagctgttgaggccccttcgcggtttgggctctggattttttccggattttagtcctggacaaacctcctataaattttttttgccctcaccaagggccgaagccttagtttttctataaggtctctgcccaaggcatggtcctatatattttgcccacataatttcctttcgctgaaggtccagccatcatttagtctgtaactatcaggagctttcaccctcttccacaatctcctacaaagatgtatgccttagcctgtttgttcaagtccgctatgatgtacaagccacagtattggtcccaaaagctgcaatgcgccaaatacacaataggcctttttttgatcattcatacgacatttctggtttaggtgtatgtagttgggccatgttacttgtccagaggtagagactaaagatataagaataatttcttagtccacaatgctgttttgctcactttaagtcaacatatttacccgtgtcaaattctaactacagcactgtgcaattatggataaagttttttcatttatttgaagttagactagatatacgtttttaaattcaacatctggctggtcagtgctttatcaactcaattaatgtgtctccttagtcttgtgctaataaatattgatgc

SEQ ID NO: 562562 - DNA, 714 bp, Homo sapiens
  misc_feature (26)..(26): n is a, c, g, or t
  misc_feature (85)..(85): n is a, c, g, or t
  misc_feature (92)..(92): n is a, c, g, or t
  misc_feature (153)..(153): n is a, c, g, or t
  misc_feature (167)..(167): n is a, c, g, or t
  misc_feature (237)..(237): n is a, c, g, or t
  misc_feature (255)..(255): n is a, c, g, or t
  misc_feature (308)..(308): n is a, c, g, or t
  misc_feature (314)..(314): n is a, c, g, or t
  misc_feature (317)..(317): n is a, c, g, or t
  misc_feature (319)..(319): n is a, c, g, or t
  misc_feature (332)..(332): n is a, c, g, or t
  misc_feature (337)..(337): n is a, c, g, or t
  misc_feature (353)..(353): n is a, c, g, or t
  misc_feature (355)..(355): n is a, c, g, or t
  misc_feature (374)..(374): n is a, c, g, or t
  misc_feature (389)..(389): n is a, c, g, or t
  misc_feature (401)..(401): n is a, c, g, or t
  misc_feature (447)..(447): n is a, c, g, or t
  misc_feature (462)..(462): n is a, c, g, or t
  misc_feature (476)..(476): n is a, c, g, or t
  misc_feature (489)..(490): n is a, c, g, or t
  misc_feature (504)..(504): n is a, c, g, or t
  misc_feature (519)..(519): n is a, c, g, or t
  misc_feature (521)..(521): n is a, c, g, or t
  misc_feature (545)..(545): n is a, c, g, or t
  misc_feature (553)..(553): n is a, c, g, or t
  misc_feature (567)..(567): n is a, c, g, or t
  misc_feature (569)..(569): n is a, c, g, or t
  misc_feature (588)..(588): n is a, c, g, or t
  misc_feature (603)..(603): n is a, c, g, or t
  misc_feature (615)..(615): n is a, c, g, or t
  misc_feature (626)..(626): n is a, c, g, or t
  misc_feature (630)..(631): n is a, c, g, or t
  misc_feature (644)..(644): n is a, c, g, or t
gcatacaaagaatctagtgtgctcanggcttggtacaatgagctgaattagatggccttatgaaactctttctaacctcttaccnaacctgnttctccttggttaaaattatacttgaaggcccagaacactcatggcacatttgtttaatantgcttatagttagnttaaggtaattttgcttctacagtattttggaaggtctgaaaacttgcacagggtcatctttgtaattanataaccccaaactaagangcacaatgtctccttcaggtgatcacacacagtggacgagtatgtgcaaacanggacanaananttcacttacaaangtganttgatgttaacactananaatgatgactgtagaacanttgagcaagtaaaanagtaaagcacanagtgagtgtatgtccatctaactggtacattgataatttagtttgngcacataaaaggaanatttatatggcttncaaatgcagagtnncatctattcgtganttctctgagtattanancccgttcctttttcatcttaaaanaatgaatnttactgttgcacanangggcttaatataaggacanaacactgcttctaantttgatatatgnaaatgtgctgnattnncagaaatactggnatcctttatgctgctttgggacttggaaagcttaccataagccttatggtgcataacttgcaggcttcct

SEQ ID NO: 562563 - DNA, 1038 bp, Homo sapiens
cccactgcgtccgctccatgcgtccgccgctggctgtctgccggagacgccttgttgtacgatgatcacgcatcgcacctgtacctcccttgtgacggcccataagtaccgcttgggagctccatgtaggcgatggtggccccctggacagacggaggctggtcgatggtgctattgacatgctgtgaccctcgaaaggcctcgtcgttattgactgtatagtttcgcaacatagtggtgcgcgaaccctccgagcgagacgggtctggttctacgcgctttggacggaggcttcctcggggcgtgggtcttccactggtcctgaaggtcaggatcatgtgggcgccagctactgacccctgggaagaaggaggaccgtctacctggaagccaatccatagaacaagtcttgatgagtggggcgtgtacgtggaggcccatcgaggtatgtgcctggtgggagacattgtgggcctcgtgggcgctggaccagttacctggttgaagcactgggtcaccatcgaccaccttcagagtcacgcgtcacaacatgcggtgtgatgaacgttcacgctgtacagcccttgttgtcatgagtggccgtggagggcaagaacccggcttggacctgcccaagcgtggtgcgaggtgctgaagcggctgcccgagtccgacccccatggtgcagggcatcctccgaggaggtcgaggagagcacttgatcgcgggcgaccgggaacctgcagctggaggaatcttgcttgatgggactggtggggagcgacctccggcttggattcccatgacaaagtctggaccagagcgtcctaaccaggagacagtagtggaaactagaggggcccacgactcgaataccccagatacacccgtagatttaggaggggataccacgagacgcgaggacaacagaagtggcgagagcacaagagtccagtcaacaataatgtgcgacatcgtcgccgcccgatctcatctcattctcagcatatcgctcccaccacacaaaacgagagaagc

SEQ ID NO: 562564 - DNA, 147 bp, Homo sapiens
  misc_feature (11)..(12): n is a, c, g, or t
  misc_feature (118)..(118): n is a, c, g, or t
ctcggactgcnncaagggtgcggtgaagaggtgacggagggcgtggctatgggcggccggcggggtggggaacgagcgccgggttccgtccaagccagccctccgtcactcttcacgnacctcggacctgcccataaggccccccgg

SEQ ID NO: 562565 - DNA, 192 bp, Homo sapiens
aaaccacgctcagtcaggttccggcagcagctgcagcatctcatcttctgcgactctcggtgccctctccttccgatttccggaaacatggcctccgatgtggctgtctctgacgacgtcatcaaggtgttcaacgacatgaaggcgcacaagtcttcaacgccagaggaggtgaagaggcgcaagcagata

SEQ ID NO: 562566 - DNA, 652 bp, Homo sapiens
ggcgggcgcgaccctgggtggtcagcgccccttgcccctcggtggtctcgctggggaccgtgtgggaccttggatgagaagtgcgatgctggccgatgcgccccagtgtgcccagtgcctggagacccttcctggtgagagcggggtgcctgatttttgctccgctggctcttatgtcgcttccgaggtgggtgatggaatggagtcgggttgcacagtttcacatttcggacccgagtgcgcattcctgagagggagtgctttcccttgcggctgcaatagacgggccctgtcctgcgtgggacccgcatccttgcgccgccggggaccctgagccggtcgccgacggccttgacggacgctgcactcttcctgatccgcgctggcctggtgtcgggactgggccgtggctactctacctgctctcccgggtccgggactcttacccagttggtttaccggcgcttgctattccccgtcccgacatccaagacatccttgagcgcctgcactaatcgccaggccaatcgactcgactcgggaacacctctgggtggtctcgcctcccacagacccaggctcgtgtcttcccaaggcgcaaccgtctccaccagccaggcccccgcgcccaattcctcgagcctgggccccg

SEQ ID NO: 562567 - DNA, 693 bp, Homo sapiens
tacccagggtgctaccttttatggggggtgtcttaggaaaaaaaaaagggtaaaaaagggaaaaaccttaaataaaaagaaggccgaggccccttaggggggcccagaacgccatatctccacggggcccaaaaccgccctatcacccacccgaggccgtggacacaaagagggagaggtggctctgcgtggggaggaggaatatccctgaggcgcgcggtggcgccctctagaacctccacgtgtcctgcggcgggcgcctgagaaaaagtgaggtgcgggagagagaggggaccaggtgtgtggcctctgggcccaataagagaggagagagaggtgtgtagagagagagagactcgtggtgggagagagagagagagagttcgccccagccggagagagagagagagagtagtgagagcgcgagagtcgtctctagtgtgcgcgcacactgtgtgtgtcgtcccctgtagaagagtcgcgcgtcgcgctctcacacaacagagagcgcgcaacaagcgtcgtccccagtgtgtcgcccacacactatcgagtgcgctctctacacagagagatgagacataaagcgctcatataagagtgagagagacagtagagtggcgccacggcgaggagagatcatatagtagaagaacagaagagaaacacacaccactgtagagaagagagagt

SEQ ID NO: 562568 - DNA, 121 bp, Homo sapiens
ggtgatctggccggcctgggcctctagaatgaggttatttttatgatatagtgtaaagtcaggatctaacttttttccccaataaatagtttttaaacactggtttataggaaaatttggt

SEQ ID NO: 562569 - DNA, 302 bp, Homo sapiens
  misc_feature (86)..(86): n is a, c, g, or t
  misc_feature (91)..(91): n is a, c, g, or t
  misc_feature (126)..(126): n is a, c, g, or t
gcatatcccccagaatagggggaccaaggtacattaacaaaaaatcaggattgagaaaggatatgggtacatatgaagattgtttngtttngtttttgagactgagtctcgctatagtcacccaanctggagtgcagtggcacaatctcggctcaatgcaacctctgcctcctgggttcaagcgattcttgtgcttcagcctcctgagttagctgggattataggtgcccgccaccacgcccagctcatttttctatttttactagagacggtgtttcaccatgttggccaggctggtctgg

SEQ ID NO: 562570 - DNA, 615 bp, Homo sapiens
tccgtaaatgagatgatatcattaacggggaaaggcgctttgtgaagtaggccttatttctcttgtccttccgtacagggaggaaattgggaagttacatagaaacccgaccgtggattacctccggtcgtgaaactcgagaatccacgttaggacacttaaaactcgttggaaacaaacgaaacctttaatagcggccgtgccccatgtgggaatgtccgtgaatccacacatcgaaggtccgtaaacccctaattggttccgattatggcacttctaaaaataggattggcgctggttaatcccctaagggtcaactcttcgttccccgtagggtccaacgtacatctggagatccacatctcgacgtatcacgtcacgtcaccgtcttttcgacttggtagaaacgctcctcgaccccccagtgatacccgtggcctccgcggcaggatcagcgcgctcaccgctgactcccagaagcgaaccgccccccaaaccgcggacaaccacttccaaacagtgacacagcgcttgacggccacgccctcaacgcagacccgtgagagcgggaccaccgcgcccagggcaacccgggctacgcgcacctccaacaaa

SEQ ID NO: 562571 - DNA, 710 bp, Homo sapiens
gtacgcagttcaatttcaaaatgctaaaatgtgttgagctttagactataacattgttgtaataatgctaggtagaagttcaacatgtaaaaaaagggggcatggatttacagtgcaaaaggtgtccacagtgtattagtgacattctttcattgacagcttgacataattcattgagtgaaatattttaagccagaaaaaaattcccttttttaataaaagggggtttaaatactgttggcattttgatggttcctttaaagtgccctgagctattcccagaggggttgtatatgggtgggtatatttgggtattgattattcttattgtgttctctttcttctatcttatcgtttttcatttgagtcttagctcccatttaagttatgcttctgacctatgtatggtctgtagagcttgcaccagaaataagaccacggttttgaactaccgtcgaaatagtataaaatgaatattttaatggctacaatctttcctgtggctgtggagtctctgttgaaatgaatcaggattcgagctctaggatgagacagaaagatgaaagcagtgtggttgtgccgaggacacgtgtgggttatatggatgtgtaacaaagttgatttggaacactggactctcattctgtatactggttagttattaggtagaggatacttttgtaaagggcatgagctagtccagaaaggtt

SEQ ID NO: 562572 - DNA, 911 bp, Homo sapiens
gaacggactgggtatgggggggcagcagaattactttgggctatgggtggagtgtggatcatgggaaatggacacagcagagtccagatgcccacggtgcaccacgtacaagagcccgcaactgctcggcatcaggagaagcgttccagttctgagtaagactggacggtgtgggcggtctggagatccctcagaggagcatggttgggcatagggcgaacagaggagtcgatcgcgtgagatgtcgtgactgctgcaggcccgaggccactgtctggagatcacgtgggcattcgcgcctgagctgaagggttccgggaagtcccaggacgatgactgaggagggctgtctgatgccttctctggatgccaggaactggcataccgtctggagtagagggcaactgctcgtgtcagctcgcgcgtcttccgcgtccacacatgggtgttaactggagtgagcgtaccgcacggtgtcacagtcgaggctatgtccgcacgagtgtgccagagacatacgcccgtcttgagagccagtgtacgtagactctatgtggtggatctcggcgaggaagatagatgttttgacaaagtattatctattgtttcacccttaccaggggtcacgcctcagggatctcgtccagagaatagtcgtatgttgtccataaatttaggtaagcttcacgtcgttataccttgggtgactctatgtttgagccgaacgacaattcactagagcatgctgaagacctttccagaagccccgactggacatttaggggaaattcccgctgggcattagggcaattccggtgggcattagggagattccggtgggcattaagggacttccggtgggatcaggggaattccggtggcgataagggaattccgttggataaagggaa

SEQ ID NO: 562573 - DNA, 145 bp, Homo sapiens
gtggaactgcaagcattaggccccccgcctggttaatttttaatttgttatgtggggacgggctctcgctatgttgcccagtttgctcccaggaccccgggcaacggcgggtgttgggccgggctgcccggcagggttgcctcca

SEQ ID NO: 562574 - DNA, 415 bp, Homo sapiens
tgccacagtcaagaaagggaaaccagagcgtacaaagaaggtacagctaacacgtggtgataggtcaacgaaagtcacagcgtagaaaagatggagtgtatcggtattgtgaagagaatgcaggagtcatagtgaacaagaaaggcgagatgaaaggagatggcaggagaggaccagtagcaaaggagtgtgcaaacgggtgaacagagaatgcatagaaagggtgagacagtagaggagtctacagtatatgtgtaaaaaataaaaaggaactaaacgcatagaaaaaagaaaaagaaagaaaaacacgagaagagatctctacgctcactctctctctcactctctctctctctctctctctctctctctctctctctctctctctctctctctctctcacactctctctctc

SEQ ID NO: 562575 - DNA, 520 bp, Homo sapiens
tgcgggactagacgggctcagacatgggctccaggaacagtgtcccaatcgagggcaatgtatagtacgtcaataatggaaattcaaaatgctgtcaacggggtgaaacagataataggactctcatagagacaacgcaaacgacagagcgcaagacactgctcagacacctcatagaagaagtcaagcaagaggacagaggatgccctaaactgagaccaaggtactcacgaggcaaatgctgaagggatgctccctaggagtgtgcaagatgagatccatgcactggtacctttgggaacggagtgtcaagccctgcctgtgaagagtacctgaatagacgttctagcgcgagcgctgtctgcatgagagtgggtcacgccgtggtttggacgccagtcgttgagtgagttcctgagaccgagagctcgccacttctactatctggatgaattggtgacctgcatcgactccactgctggaagaacgaactggcagcagaagcacatgctggatgtca

SEQ ID NO: 562576 - DNA, 724 bp, Homo sapiens
ggtcgacactgtctgtgtatcggaaagcaagcgtaacccgctcatctagttcctgattgactcctcttgtcctcctacatccactacctccactatacttgacgctagtgagtctccaaccacgtggagcaccattgtctgcgctgtccaggatatgaacattgccctactgcgagtagtctctacatgcacttgaaaacactggctatccccacccgagtagactatgtactctctcagggtgaactaaagaacccactaggtggcgtatcgtagaattgcaaccttgcgtatcaagcaatcctgtctatttaaagtagaccatgaagcgacgactcgcgttcgaaacttggcaccggggctgatggtagcgtgaacttggacaactcatccctcaattcgctcagagaaatcgtacctcgtgacttagcgacagactacgtgtcctctgctgtgacacaatacgttgacatcgtcataagaatagaattgcgggcaacctatatgcatgacacctcgtaggtccattaacagccatatcgatggaaggcatcatctcatatgcctccgtctgctgataggatcctcgcaatgcagttggagctaggcttgggatcgtgggctctctggatctctcgacgtgctttcgtgtggggttatgccgaaccaagtgtttgttggagggcgaactggctactggagtataccatccctatgcccatgg

SEQ ID NO: 562577 - DNA, 716 bp, Homo sapiens
  misc_feature (431)..(431): n is a, c, g, or t
tagttaaaggtatttaaatagcaaacttacaggaacagcacaaaaaacagacaacattaaaaacatgtacttgcatgtaggacaactcagttaaaaaagtatagtgaatggatggaatctacggtatgataaaaatgctacaaacacccatttagttgtgccactcaataagaaaattatcactggtgtttttcaaaacaaactccaaagtgcgtggctatgtgctccagaaaaaatttacacgaggttatatttataaattattataagagttggaaccggcgtgaaaaactggtgtctccacgtgaacaccatttataaactgggcattaagtgctattacgttcctccgccattcattactatttaagacaattttcacaccacacaatgtgacaaagtgggaaaaaaactgtgcgcaattaccgtgnaatttttcgtggtcccccatattttttctccacctcggcaagtcgaataatacttgtaggggtacccttttggacccccagtgggaacaaaaaatctatctacaggcgtttccagaaaacttacccaatttaaccgaggaaagacaacgagaaacaatttttttaattttttttgttgtggggacgaaaatgtgacagagtggtgtctcccaatttcaatatgaaggggtggatcccccacacggcgctccgcgggaaatatagttctctaaaacactcggcaaa

SEQ ID NO: 562578 - DNA, 320 bp, Homo sapiens
tacgccgtacaccaatcaaaggtgtcatatgacgatcccctcctcaccctgtttgtggccagatctaaacttgcatgaccatacggaggacaacattaacacgtgaatgtcttttccacgctattggtcacttccaggcggccttctggctggtctccggactctgagtcacagcgctttttcgaattggctacgcccttcatcgaaataccacgtgtaggatgcgtgcccgctgtatcaacagcttactcgagactgcgtcactcgcctgggttattagaccaggcattcacatatatacgcttcttactgctttggcc

SEQ ID NO: 562579 - DNA, 438 bp, Homo sapiens
tggtctctttggtgctaaaggtcagttcagccttgatgttgttgttgtcgttgttgtttttgagacggagtctcgctttgtctcccaggctggagtgcagtggcgcgatctcggctcactgcaagtccgcctcctgggttcacgccattctcctgcctcagcctcccgagtagctgggactacatgcgcttgccacgcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgttt

SEQ ID NO: 562580 - DNA, 410 bp, Homo sapiens
ctcgcagtacagtcatggccatttggcaacaacccttagacgctttaccaccccagaccagaggggccaggaggccatcttattctcaatatacattttattacccaatccactcccagcattgcaaaaaggtccaaaaatcagattccggccctcaaaccccacaacaggacttaattaacctcgccttcaaggtgtacaataatagagaagagttgcaattacttgcctctgctgtgagagaaaccccagacacatctccagcacaaaagaacttcaaaacgcctaagccatagcggtcaggtattccttcgggacctcatcccccaggatcttgcttcaagtgctggaaatctggccactgggccaaggaatgcctgcagcccaggattcctcctaagccatgtccc

SEQ ID NO: 562581 - DNA, 304 bp, Homo sapiens
ccccctccccgggaaaccatcattctactttgtttctgtaagttggactacttcagatatcccatataaggggaattatgcagtatttgcctttctggggctgttttatttcacttagcacaatgttttcaaggtttatctatgttgtagcatttggcacaattttcttctttaaggctgaataatattccattttatatatataccccattttctttatccattcatctgtccgtggatattacactgcctctacttcttggttgttgagaatcacaccgaaatgaacacaggtgtaaccgta

SEQ ID NO: 562582 - DNA, 377 bp, Homo sapiens
gcagcatggatgaatcaatccgcagcatgggtgaatcaatccgtgcacttgctcttgtgtgtagccaaattcaacgagccggcagcaatgcgcgtacagcgcgttgtttcgtcctccctcgtgcatcggaatcggaaacggtcgttgcgctttatcaatttttttcgatcgttcgaaatagatcggcatcggcgaaagttccccgtctgcaatatgtacccattcgcgcccgcctgtattttcgcttggaagaactacttgaccgcgcccggaaagacgatagtcgccgacgaaaccgccagccataagcactgtcgcgtcttgtcctttgatttttccggtcgaacgaaagaaaaattgaaatcctcgtattgttc

SEQ ID NO: 562583 - DNA, 921 bp, Homo sapiens
ggtcaccacagtaggtccctcgggctcagtcggtccagcccggctctcagtcctccccaaccccgataagcgccacgacgagctctgagacgcaggtcccggcggacggagagcaggcaagcatgcaggaaatcatgctcgcaaccctccagcgcatggagaagaacctggagcgctagggtctcctctgagtcgatcgttcactcggatcatggccactctgcggtccgaatgtcgcagcgtatcaaggataccaggttcggtgacgagcgacgcccgacggaccgaaggatggaacgcaagaaggacggacgcgacagatacgatgcgacggacaggagcgacatgacccgtgaatggaggctcaggctggcataggctgtgacgacggacggacaacccgcccgccccgtcgcacgtgccgaaagagcgctccatgattgacacattctgagtccgctgaaatgggcgcgagcgcaccccccttgacctaaaactgtgtgcgcgcaagaattcgacatacccaagggcctcttgactgaccaccacgtgtgggaggcgatcactgaagggggctcgggccttgcccctcgtgtcgcacgcacgcagaagtgcgtgggacactcggtgtgcatgctgtacatctggcgtgaagcaacgaccttggtcttggcggctgcgccagaacttgggagcagtcgcaacatccagccgcaggtgcagcagcccgagggtcgattgaatcgccttgtcccagagccagaggacggccagtgcgcgcgtaactcaccagtaatgccacgctgccagtggaccaggaacgacaaccatgagtgaccagggccaccaagcccgatgcaacaccccacaaacaccacctgccatcaaagacacaggggggaaagccagcaggaagaagac

SEQ ID NO: 562584 - DNA, 235 bp, Homo sapiens
  misc_feature (167)..(167): n is a, c, g, or t
cgtacgtggtgtaccgccatggcttggaacactgagacatcttatgaaatggggtgaaacagccaaatctcaaatatttagttcttgtccaaacatttaccaaaaaaaagttctcatgactttctttcacacaggggactaggaagtgaaggtgcatgttttatgangagcttataataaaagaaacttatttagactataggataggggtagccttccccatagaagtgatgat

SEQ ID NO: 562585 - DNA, 399 bp, Homo sapiens
  misc_feature (383)..(383): n is a, c, g, or t
  misc_feature (394)..(394): n is a, c, g, or t
actatgcctggctaatttttgtatttttagagacggggtttctccaagttggccaggctggtcttgaactcctgacatcaagtgatccgcccaccccacaaagtactgggataacaggcatgagccactgcgcctggctccccaccttctgtatatcttacttttgtattacgtgtgtgttgtttattgtttgaccctcccactggaaaataaactccacatggacatggatctatgttttgatcacaatatgtcccaaatacctaggcacagggcctgagcacagggtagggtatggcaatatatatttgttgaatgttcagtgggatgggatggggttggatgagtggggtaggatgggatgaatgggatagtttcatgtnaatggcccttnatttc

SEQ ID NO: 562586 - DNA, 130 bp, Homo sapiens
gagtccttcgccataagcaaggcaagcaacatgtttcattcaggagggtttttttcatccagtgccacagctcagggactccggaaaaaaaagaagagcctgatcctttgcaagacaatctattagtcct

SEQ ID NO: 562587 - DNA, 921 bp, Homo sapiens
  misc_feature (176)..(176): n is a, c, g, or t
ggtctcgagtttttctttgttttttgagggaactggcaagcatattttatttataaaaagggtaactaagctgctttccaaagaaaacaaaaagatggcaaacccagcacccagctcgtgaaagagtctatttaaaccagcaagacaaacggactttcagcgtggggcacccacangcaacataattccgggctccagaaagagacaggggaaaaacggggggcgttggggaggaagcaagcccatttcccccataatacgggggtcatattcgtgcctccagccgtgagttccgagtccaagatagttagtggctcacaaggagaagtagtgcgccgtggagggacgaagggaacgacaagcaaacccatatgcagggaagcataccgagatctcgcggattccgggaatacaagtgcgccaaattccacatctgggggaagaaccgtgcgtgggccagaaggggtatcttgggtcccagtggtatacccagacaggttgacggtgggctgaaagtcagtattcaagattcgcgggtaccgaggtccccggtcgaatggccacaaagtacaccggtctggaacaccggctggaatgtctgggtggtggagacgggtgggcaagtgacaagccggaaccccaagtgacagatggtgccagcgaatacacctcttggtgaggggcaccagggtcatacatcagacagtcttaccgagatatttcccgtctatttatcacctgggacagaagacttgggggccagtatgtatacccccagctcttcataaccggacaggcttggcaagcctggcatcaactttcgaaaagtccccggagcaagaccaggccttaatgccctgggggcacacatatggcttggacagcacaagacttcctctaaagggaggggaggcccaaagg

SEQ ID NO: 562588 - DNA, 255 bp, Homo sapiens
gcacctcgagcttaaaccaattgaagattgggcaaactgcttgaccaaggagcctttgaaagggtctacctctgttatcatgttgatacagtaagagaattggctgttaagcaagttcaatttgaccccgatagtcctgagaccagcaaggtaaaaatcactgcacaaattactttgtcacattataagaaactttattcattattattttttaacattaagccccttccattctaaataagaagcttttttttc

SEQ ID NO: 562589 - DNA, 496 bp, Homo sapiens
tcggcctacgcctatcctttaagatcaacaggctagaaaagagttttacagagtcggctataggtgactgaccagactatcaggatgaaatcagtctgctagctcaacaagggaagtaaggaagagtatatatggaatagagaagatccattagggcatttttttagtattaccatgccctgtgattagggtcaaagggaaactacaacagcccaatccaggcaggactacaaatgacacagacacttcaggaacgaagggtaagggtcacaccaccaggaagaaaaccacgacctgctgaggtgctatgctgaaggcaaagggaatatagaaagggtagtaagaagaaggtagtcatcaataccagctacaaccatgtgaccagctacagaaacaaggactgtaattgtcatgagtatttccttattcttttgtgcaaaacatgttagtgcatgtatacactcatatgaagaaaatatcttccttttatttcctt

SEQ ID NO: 562590 - DNA, 340 bp, Homo sapiens
  misc_feature (226)..(226): n is a, c, g, or t
ggaagttacttaaacatgaatcttttactatcaaaatctaatattatttgatactttcctcctctcctggatactctgttgagctcatttttattcacattgtcattattgcattgttttaattctgtctgtattttatcttgacaggtttaatttgtattttcaatagccatttagatttacccacaaaatttatccttttcatttcctaactagatactttggngggccccccccccctctgcataaagaacaccctttatgcttcccaccttttgtgtaacttctagtagtgaatttcctatgttagtctagacatgcctcaaattgatcttccttt

SEQ ID NO: 562591 - DNA, 220 bp, Homo sapiens
cacgaggggacccactagtgccatcttcaacgcctttgatattatcattgtcatgctggtctggagtacaggggctcatgtccaaatggtaagggatatgtcacccaactcacctgaggggtccatcacgaatgctggcattccacactccatcattaattgtgtcaaacagatcagcgtggccaggttggagaatctctctcagtccccccccaagggc

SEQ ID NO: 562592 - DNA, 1460 bp, Homo sapiens
ggcaggtattcgctaccatgacctgctctacaccggggtctatgtcgcagttcgaggccgctgcgcggccttgcgcatgggaggtggcagatcatgggcctgagctagagaaaggtatggatgggtggtgaccggttgcgagcacgctggcatggacggagctcaacgtgccaagaggctcctgtctgatacgggtcaaggtccgccagatgttccgagtgcacaggagacctcgacaccgtgtatcaggtcgccagtaaccaagtcacgtgcgtcggcgcttcggctcggaatcgctatggtcctcgtatgcgcgcaagggacaccaaactgagggatggcctagtccgttgcgtgggacgggtggtggacatttggaccgagcggttggattgcagcttactgtctggcaaattacagtctctccgatcatttcctaccattcaacctgattcagggttggagacgccggcattgtatctcattggtcgagagcgttaggtggccacgggagccacgcctggaatcctcgtaaggggtagacccgtggggtggtaaccctggagcctagcgggagggcagatgaagcctggcaatctgaagctgcagcaatcatgaattctgctcgttacgcctggatgtacttcatccgtgccgtgagacctcggcctgggcgtgagtcggcgattggatgggttcactaagtccagcgtgggcatgtggcctgcggaatgtggctgtcacggccttgcgtcctatcaacggggcctatgtggattgggggcggatttcaactccaagagtgtcccgagagagaccaatatccagtcgaaaggtaggtattccgtggggactttccaccgtggaagcgtaccgttggaaggccgtcactcaatttaaatcggggccagagagggggacacaaacgttgcacgggcggttgagtgctgtaataattccgtgcatccgggggcaatttgtgctacgtctctagcccccttaacgtaaaccatccccagcaatcccgatggtatgtaaggcctggttagtgaatcacgggcatggcaaccgtatcatcacgccccagtaggaccaggggtccttgtctgtttaccttaccccgccttttgaaccatggagggactgcgtgtgtcgtgcatcgcaagtgaaggtgcccatctcgcgggaggcccataggatgtcgtaaacatcctgtttcactcggtccaccgtgcgactttcttggccgtagcaccttttatacggatgccagctgagaataatgtgcctattccgaggtttctcgttctaacattcatcttagcgatatgtatgcatcctctttcggtgattattaccacaacgccgaaaacggtattatagacagcagcgctctcacaactaatactagacgcagcataaatgtcatatcccttaccgcgcacgacatgactacttcg

SEQ ID NO: 562593 - DNA, 1286 bp, Homo sapiens
  misc_feature (263)..(263): n is a, c, g, or t
  misc_feature (377)..(377): n is a, c, g, or t
  misc_feature (758)..(758): n is a, c, g, or t
gcagcgctggaggccggctgaaacctcatagacgttctgcgtgtacgctatgtggattccgtccagcaaatgaggatcgagttggccttctggagaggccatctagctaaatctggtataagtaatctctcagtggagcttcagaatcttgctcgcgtgagacatgctgggctaggatggatccgagacagggcgctactcgatgggcatcttgcagtccaagcgtctcgtgcaagatctgcagcgtagcaaaggagatattncacgctcgaatcgaatagtaggcaggtaggtgcttatggcaagccaagttgcgacgcggtggttccacggtcgtgcatgagctcgcggttcggaggaggctgactctcgctagntcaacactgacggagactgcaggcacacatagcccgatggaacagtgggaacctgatccaacggtgcagctgagtttgggagttcagtcgagcctgtggagacactccagtggaaggcttctcgtcgacaccatgggcgatgtacgtctggtacgagagcccactgggtcagggagatacgcgaagtccttctcacctgagccttagcggttgtggcactcgcacgtgggccctcgccgggcaccgtttgcctccatcccgcggctcccggtcgtcatgtcgctcggacatttttcatctcgtcggcatgttccatgcatccgttggcactggcagttcggcagatgccaggagcccgtccagccccgactcccacctagntgccccagcactggagctctccagtgccagcgtgggaacggttgatgtggactgtctttttcattgttggtctctctggagccccctcctcccccggctgggcctcccttctttccagttgtccaagaagtggaagcctggactgaggccttgtgtgtcaggccctctgactgcactccctgggcctgtgccgtcgtgtgctgagacctgttcaagaaccgatttcggggaaggcttgccgggcattgcacacgggtggttcctcttgcctctgtgcttgcccgggctgggcgtcgcactcggccatttcctcaagtgccagggacagtgctgaattgggggggaaaacagggggggcttaagacaaacaagcttgtgacccggccagggcgcactccaaagacacacagcacgaggcataccttcacacaggatccctacccgacgaacgcttctccctcctgagagtacggaatctcgcgacaagtcgtcttccaggtggaccgatgagagaacctcccaaaagaa

SEQ ID NO: 562594 - DNA, 368 bp, Homo sapiens
  misc_feature (9)..(9): n is a, c, g, or t
  misc_feature (14)..(14): n is a, c, g, or t
  misc_feature (72)..(72): n is a, c, g, or t
  misc_feature (113)..(113): n is a, c, g, or t
  misc_feature (158)..(158): n is a, c, g, or t
atttggagnatggnaatggaagtggtcctccctaccctttacctggaagggtgttaggaacccccattaaanggtaaccatacaagaacatattttttatgaaaatgaaactnggaccaattttaatattttttaaatgtgatctgtttccaatttanggtttcttttcccaagttgggtgagaaacatttcttctgatagagtgcctagtaaagtggtggctgaccaagcttcacagaaacgactacttgtttgctaagattctttgacaaattacttacatatttgtgtttttttcttcaagcaatgaaaaccatttttggtctgccacctgtcagaacattgccattctcatcaaggtcattatg

SEQ ID NO: 562595 - DNA, 262 bp, Homo sapiens
ccccccccccccccccccccggggggcccctttttggggggggggggccccctttccctttgggcctttaggggggggggggccccttttcccccggggggggccccaatgtggaaaaaaaaccccccctttttcccgtccggggttgtggggggcctccccccccccgggaaaattttttttttcccgggggggggggggttttaaaaaaggggcccctttttttttttttttttttggaaaaaagggtttttccccccca

SEQ ID NO: 562596 - DNA, 156 bp, Homo sapiens
gctttctgagcccatggaggacacagctaatcagtaaaggcatatattcttttttttttgagacacagtctcactccatcacccaggctggagtgcagtgagctgagatcgcgccactgcactccagcgtgggggacaaaagcgaaactctgtctc

SEQ ID NO: 562597 - DNA, 157 bp, Homo sapiens
ctgcagctttgtctactctcagctcatcaggctctcgcctgggggcggtcgtcctgactcctgcggctgtctggcggctgggtgccggctcctgcaggctgggaacttggttggcggccttgggcaagcacccttcgggggtaagcaaggtaactcc

SEQ ID NO: 562598 - DNA, 308 bp, Homo sapiens
  misc_feature (17)..(17): n is a, c, g, or t
  misc_feature (177)..(177): n is a, c, g, or t
  misc_feature (231)..(231): n is a, c, g, or t
catatattgagtatctnttctctgttaggaaacacaacaaacgtaaataagacagtgtatcctgcctcacaagttcacagtgcaatcagcactaccccaggagtgaacaaaatgatttaggcatataaaggaaagggtaattaactgcctaggcttcacagaggaatgatagttganttgcttcttgaaggataagtagaagtttgccagagaggatggttttcccataanttgattatggctggagcatagagcctggagtaaagttgtaggcgagattaaactggagaatatgaaaggacatagac

SEQ ID NO: 562599 - DNA, 204 bp, Homo sapiens
tacttcaagggggccccctgtaagaaaagccaaactccaagaccaagtaagttaaaggagttttgattttttagacttccctggggagttttggaccccctttgccctgatgaatttgaatgggtttgatttgcaaatttggatttacccccattgttttggaagcacatcagctgaaaaaagttgaggtttattttttttaga

SEQ ID NO: 562600 - DNA, 901 bp, Homo sapiens
  misc_feature (35)..(35): n is a, c, g, or t
  misc_feature (69)..(69): n is a, c, g, or t
  misc_feature (103)..(103): n is a, c, g, or t
  misc_feature (124)..(124): n is a, c, g, or t
  misc_feature (129)..(130): n is a, c, g, or t
  misc_feature (145)..(145): n is a, c, g, or t
  misc_feature (148)..(148): n is a, c, g, or t
  misc_feature (165)..(165): n is a, c, g, or t
  misc_feature (173)..(173): n is a, c, g, or t
  misc_feature (180)..(180): n is a, c, g, or t
  misc_feature (194)..(194): n is a, c, g, or t
  misc_feature (196)..(196): n is a, c, g, or t
  misc_feature (206)..(206): n is a, c, g, or t
  misc_feature (212)..(212): n is a, c, g, or t
  misc_feature (219)..(219): n is a, c, g, or t
  misc_feature (226)..(226): n is a, c, g, or t
  misc_feature (231)..(231): n is a, c, g, or t
  misc_feature (240)..(240): n is a, c, g, or t
  misc_feature (245)..(245): n is a, c, g, or t
  misc_feature (261)..(261): n is a, c, g, or t
  misc_feature (276)..(276): n is a, c, g, or t
  misc_feature (299)..(299): n is a, c, g, or t
  misc_feature (311)..(311): n is a, c, g, or t
  misc_feature (327)..(327): n is a, c, g, or t
  misc_feature (332)..(332): n is a, c, g, or t
  misc_feature (354)..(354): n is a, c, g, or t
  misc_feature (357)..(357): n is a, c, g, or t
  misc_feature (372)..(372): n is a, c, g, or t
  misc_feature (379)..(379): n is a, c, g, or t
  misc_feature (383)..(383): n is a, c, g, or t
  misc_feature (390)..(391): n is a, c, g, or t
  misc_feature (396)..(396): n is a, c, g, or t
  misc_feature (401)..(401): n is a, c, g, or t
  misc_feature (428)..(428): n is a, c, g, or t
  misc_feature (455)..(455): n is a, c, g, or t
  misc_feature (478)..(478): n is a, c, g, or t
  misc_feature (485)..(485): n is a, c, g, or t
  misc_feature (492)..(492): n is a, c, g, or t
  misc_feature (530)..(531): n is a, c, g, or t
  misc_feature (616)..(616): n is a, c, g, or t
  misc_feature (672)..(672): n is a, c, g, or t
  misc_feature (770)..(770): n is a, c, g, or t
  misc_feature (802)..(802): n is a, c, g, or t
  misc_feature (805)..(805): n is a, c, g, or t
  misc_feature (828)..(829): n is a, c, g, or t
agaaaaacgagaatgattaaaattaatttcgagcnttctatgtgtcctgcatcacccagtaggtatttnacatatgctatatgttttttattacaaaaataanactgcagagagcccataactnttttnnaggaatcctgaattnaanatttagtaatgctacanatacttantttgganatcagcaatctaantnccggctttgnaaactnattcttnaagaggnaagtnattcttggnaacancgtcctcaggaatgangctcctgcagttgangttcagtgaacgctgggtcaggnatgtgggcagangtgtgggacccaatgngagtncttggtgtgcagggacgcgggntgntcacatagtaaaaantcgagtncatngggaagnncaggnaaggntttaaaatgaggatcaggtgggatctnttaggggcaaatgggggggatcaaagnttcccctcgaggtttattaactntggagtnggttctntaggtgtgggaagaattgggagataacgatgtgtctgnnagaagaggcgttttctaaggagacacacaaagggagtgggaccctccaacctcactctgtgagaggtacaccgcacagcagtgtnggggctcgaacaccccaagagcggcagagcgcggttcagaaaacatgacccttganatgcacacaaagcctaacaacgtgtcctccgcggaagaaaacagcttgaaaaggtcggctttgaagtgacccagcggaaaggaatcaccctggaaganacacgcagcagccccggggcaatgcgcgggcnggnggagcagcgagcgcggggtgcgnngggcccttcggagagggcgctccaccggccctgcgctccgtacctgtgccgccacgcccaccggtcccctgc

SEQ ID NO: 562601 - DNA, 155 bp, Homo sapiens
agacgggcatgagcggtccggtcagctgggtggccagtttcagttcttcagcataactgtctcccttcttggtgggcctgagtggcttcctggggaagaggatgagtttggagcggtactccttcaatcgctgtcacgttggccattcaacgcct

SEQ ID NO: 562602 - DNA, 990 bp, Homo sapiens
cccagctccacattaccatggccgcggctacccctgccgtcccctcttcgactccctgcacgccgggtctctcagtgctcttcaggatccaagtcagtattgccctttaaggggtctagttgccgtttgcgaggcccgtgggactttggtccctatgacagcgtggggatccggatggcttccgtgcggatcctgagaggccaaggagggagactgtggagatatcctgaggctgattcgaggtgaagactgcaggccggtaacccgggggtcagcagtggcgcggacagagacggggtcgtaggagtgcggggcgcagggggaggggctcgccttgggaaacctgctcggggagcagcaggggcccttcgtgctctaatctagcttccgtacccacgccttagtgagctagccgaattcgaaaaactctcggatcaggtgaacgatcagtgaagaaggtgcggggactcaagcgcccaggttctggcggatggctgtgtgaggaaattgagggactgggttcgccatggccgacaggcttccaggctggagcattacacccaccgatccatcttttctctatcatctattgctcacaacatccaatacatcgcgacatgcccttgatgaggcagaaatggccttttgggcagacacatcactttacgtaatccactggtactgggtatatcaagaagagtatcatttcacaggggcaccggggacagctaactgggggtaaagagccagcctggccccgttagacacgttccgaccatattgcacagaccgggcacatcaaggagggatctcacgccagaaaggtcctttccaaggaaatcccgcatgaaattccgcccgtagttacattcatcttattcagggggcccatggcggtgggtggggatatatatggcgaataattacgttatcacgaatactaacagtgtaacatggcaaggggaacgcagacacacttcttgtgtggga

SEQ ID NO: 562603 - DNA, 719 bp, Homo sapiens
ggtgttcgactgctagagccgagcgaagcgatgcctaaatgacaggaacttgttacttcaagctcttctggcgagtgattctgacagtgaggttgagaaaaaagttaagagaggaaaaagcaggttgctcgcgagaaaaacctgtaatataaagaaaagacaggtgagacattctggagagcccgtgtcatcttctaaaccagagctagcagcaagctagagtatgaataacatgtttcagatttgggaaaaatgaggctacgtaaggtgtgtcggcgatttgttaaagggcgaacaggtgctaaattgcatattgagagacatcattggatggtatccgtgacagggtgcaaagtgagagacgcagggaaagaagagaggctgatctgtcgttgtaaaagtcgcagcagacaattgggagctcgagtctgaagggtagacaagactgttctgaatcgattgcattgaagtgccaaagctacagaagaatacttggtaacacgattcggaagccaatagtaaagtagaatagccgtggtagctgtctctaaggttagttttaactgctgtcgttcttgtacatttgggcttatgggtcttcgtagaatgttcgtccgaagctattgtagtgtctgggattgcagaagaactttgtaagatgcaatacgtttttttttaagtgtgcatttattacacgcactattgaggtgaacgctaat

SEQ ID NO: 562604 - DNA, 573 bp, Homo sapiens
ttttccatgagatcgaaaaagagacaatatgtttggaatacattttaagtaggtctgtttccttatgagtccctgttgtggcagaattccattaacaaggcccagttgctgcaatgttggaatagctgatatgtcagttttgggcaggctacatggaactccaggactggtattaaatgaattccgtagaacatcagtacaggttgcagaaactgttttaacttgtgatgcaaactgactgttgccatcagtttgaacttcagaatgaacctttggagggcagggtggccgctgaagtgaccagactggggtggaggtacataagccataactagaatgaggagttgcctgagaattcagaatgagagggagcatggcatggtacagcaggaattccattagggatgttctttgaagtcaagtcattcatcagtgacatctgagtctgcacgtgcctcccagagggcttggtatattatgggtgaatacattctataatgatcttgcaatgaacagttttgctctaggtctgatgtgtctctttcatttctagcagaaggttattaggtatct

SEQ ID NO: 562605 - DNA, 124 bp, Homo sapiens
aggatcctgtgcgagttggagcatctctcttgcgtctgctcagcgtatggatgtgtctgtgcctctgtcagcctttgactttgacatttgtgtgttcatcctgccaggctccttcatacgagtg

SEQ ID NO: 562606 - DNA, 223 bp, Homo sapiens
ttatatccggaacagatagttactgtaaggaggagagtccactagactaatatcgcaaaagggactaccaataagtactgtactttagtcaactacacagttgttttccacgagggtactcgttaacaattctgatactgctaaacaagtgtattggaattgaacaattaagtaaatgggtggcagatgggaaaagccaagtttctcactgtggaatggaaat

SEQ ID NO: 562607 - DNA, 265 bp, Homo sapiens
tgccccgaggaaacaatgggtaaattttaaaattttttaaaaacaattttttaaaacaaatttgttaaaattgcccttaaaagtaaaaaactttaataaaacggttaaagcaggtacccaaaaattcaatcctaggatataggacctagtattatagggactataaaccctaattttttttatttaaggacattttgctttttaaaggtgatttttttttaatggttttaaaaaaaataaaaaaactggccaagaaatccttgga

SEQ ID NO: 562608 - DNA, 670 bp, Homo sapiens
  misc_feature (623)..(623): n is a, c, g, or t
  misc_feature (625)..(625): n is a, c, g, or t
gttagcttgttattgcaatgacttgtttgtctggttgctttatagtgtcactggtcttcatatgtaaatgtgtttttgtattggctgatagcattcttccttctatatttaatgctcctttcaagatctcttgtaaggcaggtctggtggaatgaattccctcaacatttgcttatctgaaaatgatcttatctctccttcacttaggaaacttagtttggctggatataaaattcttggttggagatatttttctttaataatattgaatataggttccccaactcttctagcttgtagggtttcagctgagatgtcttctcttagcctgatggggttccctttgtaggtgacctgccctttctctctagctgcctttagtgttctttctttaatttcaaccttggaaaatctgatgattatatttctggggaatgatcttcttgtgtagaatctagcaggagttctctgtatttccctttcactgttggcctttctagcaaggttagggaagttttcacagattatatccttatgttttctatgttgctggctttctcctcttccttttcagagatgctgatgattcatagatttggcttctttatatttccatacatccngnaggtttttgtcattctgctttctttatttttggctgctggcttct

SEQ ID NO: 562609 - DNA, 105 bp, Homo sapiens
acgtaatatgtaacccccacctttttgttcgtttgtttgtttgctacgagtcacattcctgttgtaatccttggattcgccggttttctgtttcagtaaagtctc

SEQ ID NO: 562610 - DNA, 666 bp, Homo sapiens
  misc_feature (455)..(455): n is a, c, g, or t
  misc_feature (644)..(644): n is a, c, g, or t
tggggtgcaggacccagggctctcaattaacttccatgaactcagcagcggggtggggagctggaggctggggaggcgggtggcgccagaaatgacccggtccggtggccagcagggcgtttgcgccaggttccgtggcgttgggataaaaagaggacatataggcgtgccttgggaacctcgattcgtgattctcctcattgtgaccgaggggtaagacgcgtgttgtgctcatctcagaagtatagtgtgccacagtgtgggcgcggcgtgtcttccgtgtgtgtgtgcacagggacaaaatgtgtgtgtggtgtataaggtgctcacatctcacgcgcacatgtgctccccccatatatatgtgggtgtgtgagaaaaaccccgcgcgaagtgagaggtctcatatatatgtgtgttgctcacgacgcgctctcgcgcgagatatctcgganaacatctctatatctctgtgtgtgcgcgctgtgtgagatgtgaccacaacaaacctctccgcagagagacagagatctccacgagagtgctctcgcggggagatatagagaaacaacactctcacgagcgagaagggggtgtgttctcacaagcgctatctcctctctctgcgagagagaagacaaaanctctgtgggcgtgtgataagaa

SEQ ID NO: 562611 - DNA, 89 bp, Homo sapiens
gcctgcgccgagcacaagacaatgatgaacattctaaaaaaaaagaatgacgcacattttaataaagcacagcacaaactgttctttcc

SEQ ID NO: 562612 - DNA, 352 bp, Homo sapiens
atccaccatgcttaatgttgatgcatctcgtgacccagaaggtcccatctgtcatatctcgcaatatgtcatttatctcctccctttgaaatatccctccagtaccattctgcatcctgaatagtaacacatgaactgtccttcattccatttggaattgctgaattcatatggcttacgtggctttggtgtatgagctggaggatccatttcacatataatatatcagttctgtcgaatagggcatcatcacctccctccagtctgcgtcatcgctgttccctgtttaaaacgtattgtacatcgcgctgtcaggggcaggtcgcccggagatatatagaaggcatatatt

SEQ ID NO: 562613 - DNA, 343 bp, Homo sapiens
ggaccgggcggcactatagcgagactctgtatcatcaactttataaacttagctaggcatggcagcacagacctgtagtcccagttactcaggaagccaaagcaagaggatcactggagcccaggagttcaaagctgcagttagctatgaccacaccgctgcactccagcatggacaacagagcgagactctgcttaaaaaaaaaaaaggaaagatggtttatacttcggtttggagaaatattcaaaatacctattttatgtacctaaatattggcccattggtgctactttaccacacagagatgtactggtttggtgaggtatggatatatattgggccg

SEQ ID NO: 562614 - DNA, 437 bp, Homo sapiens
  misc_feature (25)..(25): n is a, c, g, or t
  misc_feature (29)..(29): n is a, c, g, or t
  misc_feature (31)..(31): n is a, c, g, or t
  misc_feature (174)..(174): n is a, c, g, or t
  misc_feature (177)..(177): n is a, c, g, or t
  misc_feature (313)..(313): n is a, c, g, or t
tcccaagtaaggtacctgccgtcgnagtntnggagctttcttcttggagacctaatacccacagtcctccaggcacttaggctctggtagattgcaaatgacctgctttctttctgttcccgggtggcatcgacccgtcggagagtaaatcccaagtaaggtacctgccgttgnaantcttgagctttcttcttggacacctaatacccacagtcctccagtaaatcccaagcaaggtacctgccgtcagcagactttgagctttcttcttggacacctaatacccacagtcctccatgaaaaacaaacaaangacatggatttactgtgcatattagcagatccatactgggaaaatgcatggaggtttcatatacaccacttacaggtttccaaagccacaatttccttcatatgttcaaactcttcaggatgca

SEQ ID NO: 562615 - DNA, 427 bp, Homo sapiens
gagtagctgctgcaacctcagcaaagaaggtggtcgtttcccaacaaaaaaggttgcagttgcacaccagccaaagaaagcagctgtcactccaggcaaaaggcagcagcaacaccttgcaagaagacagttacaccagccaaagcagtttaccacaccctgtcaagaagggagccacaccaagggcaaagcattggtaggcaactcctggtaagaaagggtgctgccaatcccagccaagggggcaaagaatggcaagaatgccacggaggacagacggtgatgaagaggaagatgatgacagtgaggaggatgaggaggactgacgaggacgaggatgaggatgacgatgaaattgaaccagcagcgatgaaagcagcagctgcttgccctgactcagaggatgaggacgatgaggatgacgaag

SEQ ID NO: 562616 - DNA, 516 bp, Homo sapiens
  misc_feature (98)..(98): n is a, c, g, or t
  misc_feature (128)..(128): n is a, c, g, or t
  misc_feature (219)..(220): n is a, c, g, or t
  misc_feature (226)..(226): n is a, c, g, or t
gagacagcactcaatgctaaggcctacaagcgcagcaagcgccagtccctgccgaggcccgcatcactgagaagctgagaagcagcagaagatcgagncaggcgcaagcgccggcagaagcaccaggnatacctcaatagcattctccagcatgccaaggatttcaaggaatatcacagatccgtcacaggcaaaatccagaagctgaccaaggcagtnncacgtnccatgccaacacgagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcttgcagcagacagacgagtacgtggctaacctcacggagctggtgtccgagcacaaggctgcccaggtcgccaaggagaaaaagaagaaaaagaaaaagaagaaggcaaaaaaaaaaaa

SEQ ID NO: 562617 - DNA, 286 bp, Homo sapiens
cgcgaatggtgttcaacgttattgcccgaaaccaggacgatcacaccaagaacatcagctttctgctggatacagatggcacttggtacctgtcgcctgcctatgacatgacttggtcgtacatgcctggcaatttctgggtcgatagccatcagatgagcattaacggcaagcgcgacaattttgtgctggaggacctgctcagcattgcaaatcaaatcaaggggctcaaggcacgcgagattatccgggaggtgcatgaggccgtcgttcaatggcctggtat

SEQ ID NO: 562618 - DNA, 179 bp, Homo sapiens
ttactgttagctttctctcctattatactccaccctaggccatgtcgtcaaactacatcttatcatgtactcatatgctgaaattcatatgatgtatcgcttccttatattgcttgaggtactgagccagccccttgttggtttttcttatatggcttacctgggcacacattatggag

SEQ ID NO: 562619 - DNA, 110 bp, Homo sapiens
cgagctcagtaccctcgataagggcaaaaaaaacatagcctcatcatccccaccatcatatgccaccatcaccctccttaagcctctacttctaccttggccttatcgag

SEQ ID NO: 562620 - DNA, 186 bp, Homo sapiens
agatcccccctttccatcccttctccgccaggcacaggaaaagtttggaaaggacaacgtcaccgagaattccagcatcttgtggcatcctcctaggtggcgcatgaagagatcctgctagttcataggacttctgcctattggtgttttctgagcggtgcccctcgaggtatagattcgtgggac

SEQ ID NO: 562621 - DNA, 282 bp, Homo sapiens
ggtgaaacatctactgccgactggcggcctgatgtgctctgttacatgacacggacggaggggctgacgtttcagcgaggatggatggctctgtggacttctaatcgggactgggccgcatacaagcagggcttcggcagtcagctgcgggagttctggctgttttaacgacaacatccacgccctgaactgcccagggaagcagcgagctccgtgtagaacctggtggactttgaaggggcaacacccagtttgctaagtacaaatcattcaacggtggct

SEQ ID NO: 562622 - DNA, 330 bp, Homo sapiens
  misc_feature (31)..(31): n is a, c, g, or t
  misc_feature (68)..(68): n is a, c, g, or t
  misc_feature (80)..(80): n is a, c, g, or t
  misc_feature (83)..(83): n is a, c, g, or t
  misc_feature (85)..(85): n is a, c, g, or t
  misc_feature (90)..(90): n is a, c, g, or t
  misc_feature (98)..(98): n is a, c, g, or t
  misc_feature (100)..(100): n is a, c, g, or t
  misc_feature (116)..(116): n is a, c, g, or t
  misc_feature (129)..(129): n is a, c, g, or t
  misc_feature (137)..(137): n is a, c, g, or t
  misc_feature (167)..(167): n is a, c, g, or t
  misc_feature (170)..(170): n is a, c, g, or t
  misc_feature (180)..(180): n is a, c, g, or t
  misc_feature (186)..(186): n is a, c, g, or t
  misc_feature (204)..(204): n is a, c, g, or t
  misc_feature (221)..(221): n is a, c, g, or t
  misc_feature (303)..(303): n is a, c, g, or t
ccatacaataggttattataaactatagtcnccctactgatttatcattatcaaactgtatatttctntccctcaatcanccncncttcntccccccncncctctccccttctcancctctggtaaccnccaatctnctctctgtcttcatggggtcagtgctgggnttncttgcttgtnccactntgccccgccaggttttcnttcttttttatggctgnataatattccattgcatatcaatcacattttctttaaccattcatccactgatgggcacttaggttgattccatattttggntatttcaacagggcttcaataaacatg

SEQ ID NO: 562623 - DNA, 207 bp, Homo sapiens
taaacggtagttctattttgggctcttggaggaatggcctcactgttttccacaaggggtgaactagtttacactcccaccaacagtgcataagcgttcccttttctccacaatctcggaatctgtcaagaaagggtatctcactctggtttggacttgcctttctctaatgatctgtgatgtgggccttagtccaacatccggggt

SEQ ID NO: 562624 - DNA, 857 bp, Homo sapiens
  misc_feature (54)..(58): n is a, c, g, or t
  misc_feature (120)..(120): n is a, c, g, or t
  misc_feature (226)..(226): n is a, c, g, or t
  misc_feature (229)..(229): n is a, c, g, or t
  misc_feature (289)..(289): n is a, c, g, or t
  misc_feature (302)..(302): n is a, c, g, or t
  misc_feature (323)..(323): n is a, c, g, or t
  misc_feature (332)..(332): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (356)..(356): n is a, c, g, or t
  misc_feature (370)..(370): n is a, c, g, or t
  misc_feature (377)..(377): n is a, c, g, or t
  misc_feature (380)..(380): n is a, c, g, or t
  misc_feature (385)..(385): n is a, c, g, or t
  misc_feature (394)..(394): n is a, c, g, or t
  misc_feature (397)..(397): n is a, c, g, or t
  misc_feature (401)..(401): n is a, c, g, or t
  misc_feature (407)..(407): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (425)..(425): n is a, c, g, or t
  misc_feature (427)..(427): n is a, c, g, or t
  misc_feature (430)..(430): n is a, c, g, or t
  misc_feature (436)..(436): n is a, c, g, or t
  misc_feature (448)..(448): n is a, c, g, or t
  misc_feature (457)..(457): n is a, c, g, or t
  misc_feature (460)..(460): n is a, c, g, or t
  misc_feature (466)..(466): n is a, c, g, or t
  misc_feature (490)..(490): n is a, c, g, or t
  misc_feature (498)..(498): n is a, c, g, or t
  misc_feature (501)..(501): n is a, c, g, or t
  misc_feature (506)..(506): n is a, c, g, or t
  misc_feature (508)..(508): n is a, c, g, or t
  misc_feature (512)..(512): n is a, c, g, or t
  misc_feature (527)..(527): n is a, c, g, or t
tccaaggtgtactctaattcccatttgcaaaatttccagtaacttgtcacaacnnnnnacattatcgggagcaggtcttccataatgtataaagaacaaggtagttttacctaccacagngtctgtatcggagacagtgatctccatatgttacactaagggtgtaagtaattatcgggaacaggtttcccataattttcttcatgcaatgacatcttcaaagctngangatcgttagtatctaacatgtatcccaactcctataattccctatcttttagttttagtngcagaaacatttngtggtcattaagcatggggtngggtaaatncnancantgtaaaatgaaattacnacaaaatttgaatntagctgnggntttgntacctttanggnttcnaccagntccnctncttaatgananantancatacnttataatgttgntatgacaantcntttaanttatcacattattgcagttccccnaaaactantgngaaantntaanccaaatgactttgantaagaaggggactttgtatagaaggttgcggctgtgagacaaggagagtccccatggaaggttctgaacacggtgtggcctaaccatgcggggcggtccactaacatctaggccgaactaaagtcgaagcccggggtgaaccacataataccgggagaccaaggggctaggaagggaacggctcatagggaaagcacgggcccagtcaagggcatacaattacgacatggatgtgcacaccaggctacaaagacacaccccacggacagagacaggaagcaacacgggggcacccataacgggcgccacaagggggctacctgacacggc

SEQ ID NO: 562625 - DNA, 329 bp, Homo sapiens
aggaatacggataactatgtactgatgacatgggacttggaaacacagtacaggtaatatcatattctaggactagcagtatacgcataaaacagggaactcgtagaggatatatgaaaataatcatgccagagtaaataactacagaagtatagaaaacacgaacccctatacaactacagcacaaaaagatgtacttaatacgttgctcctactttctgtcctctacaactaggaaggcttgctatggacacctaggggaatataaccagagtcactagttttacataggaaacagcaaacagcataaatgaaatacactatcgtgt

SEQ ID NO: 562626 - DNA, 197 bp, Homo sapiens
gttcgatgtagctataggtgtctaggatcactgtaatgcacaggagtcactacggctccgctgctatatatatcgaatatgatcttatatatagcagaatgctactcatgctttccgttctctggatatatgacagatgcttgttatcgagctcttactcctctactactggctatgcattatctgagacgatgtat

SEQ ID NO: 562627 - DNA, 287 bp, Homo sapiens
cagtctgactggcgcgtgtcttacactcacgacagaactatctctgtcgtaccatcttagacgctcaggcgatcgacaccgtctgccctatcctgcccgccatcctcccagtcctcatcgccctcccatccctacgcatcctttacatacacagacgaggtcaacgatccctcccttaccatcaaatcacattggccaccaatggtactgaacctacgagatacaccgactacggaggactaatcttcacctcctacatacttcccccattattcctagaaccaggc

SEQ ID NO: 562628 - DNA, 193 bp, Homo sapiens
  misc_feature (174)..(174): n is a, c, g, or t
  misc_feature (187)..(187): n is a, c, g, or t
atcacaacaccatgtatctctactaatatttaacgcgtcccggattaatgccggtctctgacaattctggccgtcattcatctattcctcttcgccctcccattcctacgcatcctttacataacagacgaggtcaacgatccctcccttaccatcaaatcaattggccaccanatggtactgaacnctacga

SEQ ID NO: 562629 - DNA, 403 bp, Homo sapiens
tatattaaaatgctttctcatcctcaaagtctatgattaaaggatggcacttatgcattctgacgcgcatgagagaattgatgacacactgccattgtgagcaaatatctactctagaagagttcaacgtaattcatgtatacaatcaacccttcaaaataacactgctgtaaccactctgcatctatttagcaacacaaataacgttcaacagccaaaatcactcatttaaattttcacagtttctctcctccatgatgtgtttaattaacgctgttacaagtccagcataattttttagcatgtgtaaccgcaccacatgctaacccagtttcagggttcagaaaactaaaatttatcattctaacatggttctccttaagccagaagtaccagaatagaa

SEQ ID NO: 562630 - DNA, 187 bp, Homo sapiens
aagctttttttttaaaggaaaaaaaacccaaagcctgctgctcccccccctttccattgctatttttttaaaggcccccggatgtgttttaaattgatttccccgtttcaggggaatcccgggccggagtttcagttttgatgggataagccaaaccaataaaacgtttataaaagttggtttttta

SEQ ID NO: 562631 - DNA, 307 bp, Homo sapiens
caagcagtccacactacacccacaaactccacccactggaacccatccacttcacattctatttctaccttcttcaaatcagtaggatccatgctctatcgtccatccctactgcagccgactcttttgtggctcccaaggtttcttttcttggtgtttttattgaagcagggtgtcactctattactcaggctggagtgcaccagcacaatcatagcttactactgcagcctcaacctcccaggctcaagctatcctcccacctcaaccttctaatttgctgggaccacaggtgcgcaccaccatg

SEQ ID NO: 562632 - DNA, 920 bp, Homo sapiens
tagtgaccataggaccgagtatgaaatatttaaaaaaccactagtagattatagctagaaataatcctaatgggtccaggtacttgggatatcatgcttccatacaaaacatgagcaaattgttatagagaatatgataacagggaaagtatggaaaactggcaaacccgtccatagtgaactccgccacttatgtgccatcgcaaagatgtatatggtgcgactaagaccctttgtgattgcggccgggttgtggagacacgtcctatcagaagaccggagtcatgaccttctaggtgcatcagtatcctcatgccgaaggaatacaccctatggtagtaatgacatgcgggaacacgccttctgtatgtgaatcagtccctcattgtcacaatccaggaggaacttccatacaggagcactaactctagatgatatgctatgaactgccggctcggattcagatatttgcattcagaagcattgtgatactgcagtagaattcacaccatggtggtacgtccctatgagtggggagaattgtgggaaatggtactacactgggaagagaccaggggtaggtctggcacgagcccgaaaggatgtacagtttgggtacgagcacaaacctagtcttgttggtgttaaatggattgtggggaatgccttgcggatcaacattcggcatgctacattagtgcagtcgggacggaactgcaatacaggggagaagcccacgcactatgcagggccaaagtcggtggccataaaagccctttggtacgaaggccaacacggattattggtgactccggagaagccctaacaggtgaagagaacgtgtgagggagaggcaggatgaatggtgcgacgggccactaaaataggagtcccagctaccaggtgataagggggaacgg

SEQ ID NO: 562633 - DNA, 114 bp, Homo sapiens
  misc_feature (82)..(82): n is a, c, g, or t
  misc_feature (85)..(85): n is a, c, g, or t
tcagcatttccagcagcggtcagcatttccattttatttttctccagagaatagcctgtcttcagtctttaagaactcagcnggntacatgggctttagtgagggttaattggg

SEQ ID NO: 562634 - DNA, 431 bp, Homo sapiens
cgcaccagccttactttttttctagttcacaaaaatgcaatcatactaataacatgcttccacaggacaacatatgcacatttcaacattgtattctgttcatgcatacaccaccgttcattcaactaagcaatccccttgccttagatttttaacaatgctaaatgaagtttcattaagtaaatcttggtacacagccttcaatgtttctttagaatgcctgaacaattactagatcaaaggctttagagacacatttccaaggatgtctcaaaatgattttgcctgtgtacatccaaaccagtaaagtgtgaacccatgtcactgtacctctctctcaatggtgtgtatgttctttaatatttttgaagcatatactgagtggtgttactagcaactgctttttttttttttttttggaggatggctca

SEQ ID NO: 562635 - DNA, 453 bp, Homo sapiens
gtgttcatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcataagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtg

SEQ ID NO: 562636 - DNA, 551 bp, Homo sapiens
  misc_feature (22)..(22): n is a, c, g, or t
  misc_feature (95)..(95): n is a, c, g, or t
  misc_feature (141)..(141): n is a, c, g, or t
aaccccaaaaggtgccatatgnatgattccatttatatgaatatccagaattaaaaagtaggttagtgattgccaggggctaagggaaggaaaancagaagtgaatggttattggacagggtttcttttggggcttgaatncaatgttctggaattagagaatggtgatggttgcacaaccttatgaatatactaaaaaccactgaattatacactttaaacatgttggattttattatatgtaaattatatatcaataaaaaatggttaggatgggaacgatagctcacgcctgtaatcccagcactttgggaggccgaggcgggcggatcatgaggtcaggagtttgagaccagcctggccaacatagtgaaaccctgtctctactgaaaatacaaaaattagctgggcatggtggcacacacctgtagtcccagctacttgggaggctgaggcaggagaatctcttgaacctgggagcagaaattatggtcagccaagattgcaccattgcactccagcctgggcaacagagcgagactccgtctcac

SEQ ID NO: 562637 - DNA, 620 bp, Homo sapiens
  misc_feature (495)..(495): n is a, c, g, or t
  misc_feature (553)..(553): n is a, c, g, or t
  misc_feature (557)..(557): n is a, c, g, or t
  misc_feature (567)..(567): n is a, c, g, or t
  misc_feature (576)..(576): n is a, c, g, or t
gtgttcatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccngagaatccagtgtgacatcccgttctttggcatccaggaagaattcaatgctccctcnaagncaacctctcntttgactgntacatcaagacctcgcataacacctcctgatcgggagcacagct

SEQ ID NO: 562638 - DNA, 787 bp, Homo sapiens
gacaaatcggacccggaaacagtcatgaagagtagaggtacatatatccaacacagcacaacctaccctgtgcagcctcctgggaatccagtataccctcagaccttgacatcttccatcaggactccaccctataccgatgctccacctgcctactcagagctctatcgtccgagcttagtgcacccaggggactgccacagtcccacacccatgatcagaccagcgatctccatgtgagacctcatcatgtactcttcccaatgagacaccaagtctgtgagcatgtaagaggcacatattagagattccacaaaatacccacactggctatagttatccagatacgagtcaccagtctataccaccattggcctaccacagtggctcggtctgagaacgagaaggagtaatagaatagcgagagtcgaccaaggcatttcacggcagactagggagactacactagcatggagcaaagccagttcgcagatccattccaaccagtcccgtgcagaatagacccattccccacacttggcgtgcctcaagccttattggcaggatcaatggcaagggaggagcccgaacaactgatcgcgtcgcttaacctccaaggcgggcaaagcgcgagaaaaccatgtcgtatccaatcgcgcgttgcgctacgacggattggcggtaggcagtaacaacccaattcctggggcatgagaaggacgacgcaacggagacacaccatttaggtagaccgagggaaaaacgatcagttcgacgaataaccctt

SEQ ID NO: 562639 - DNA, 605 bp, Homo sapiens
  misc_feature (480)..(480): n is a, c, g, or t
  misc_feature (538)..(538): n is a, c, g, or t
  misc_feature (542)..(542): n is a, c, g, or t
  misc_feature (552)..(552): n is a, c, g, or t
  misc_feature (561)..(561): n is a, c, g, or t
accccatcttcccggaaaactcagaggtcacctttaatatcacgtttgatgtagactctaaggcttcccttggaaacaaactgctcctcaatgccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccngagaatccagtgtgacatcccgttctttggcatccaggaagaattcaatgctccctcnaagncaacctctcntttgactgntacatcaagacctcgcataacacctcctgatcgggagcacagct

SEQ ID NO: 562640 - DNA, 1290 bp, Homo sapiens
ggtcactgccgtagagatcttctcgacaggacaacatgcctaacgtagcgcgagcctcgtagacgatggccgtatgtccccgacaaccgttggctaccagcccaactacaagccgatcgctgccttacttaccccgtccttctccttccggcgcgggctcaagcgtgcgcctgtctgtcttacctccaggggagctggcccgcgagcacagtcgtctcggcttcttcgctgaagctctggtgggtcgggcagtgatcccgtggctctgactatcgccttgcgccttccatccccgccggcttttgaaccggcatgtgcgaccaagggctggcctctttcacactacgggtcgacaccgggcgggtgactgatgcggggcaatacgaaggcacaacgaaagcaggcagcaattgccctttcaaccctggagtgatgacgcggcatcctttgatccttgagcacttcctgtcagcttccatgcgcgtcgacccgacttaaccacggctgggttgggtacaacttggcaatactcctgcggtacctacttgccactaccaacgcggcgctcgcccgtgtacacccgtatcacggagtggctcacaacccacacgttgcaacgacaggaactaggcgactcttgccaacctttcacgcctcaaacgtccaacccttcactccgccgagggcccacgtgccccctctcggggcccctcgagtggcaatcacccctgtaattagatggctcaaccctttcagcccaatgtgtcccacgggaaccattcgtcaccatcgaagcaaggcttggaaccagtccttgagatgagaaccaattggcaatgtgacccctcggaaacacttttcgagccccccgcccgtggatgtcaccgtaatcacgcgagggaaaggaattcgcaaggagagagagcctcaccacgggctcgacaagaaaaccaatcaattctagttcaatgggcgcttacatgctgccaatccccaacaacgacaacgcaggcctaagggtacagcgaactccccaaggactgcggcatccgcacaccggcgcacaacatggcctcaatgcccacaattaacgtcgccccgccagatgggcgcacaacgggctacgcgccaggggtcccgggaaaacacaggtccttccctggaacttggactacgcgatgggagagaaactccgaaggggaagaagtcacaacgaaatccacgcccaggacagccccatatctcgcgccgccgcgcaccacgagcaacacctagtaagtccgagacacc

SEQ ID NO: 562641 - DNA, 416 bp, Homo sapiens
  misc_feature (25)..(25): n is a, c, g, or t
  misc_feature (406)..(407): n is a, c, g, or t
agagcctagaacctaaacctagaancttttgtccttccttggtaactgataatgaccatatttattcccattgattcctatgacatggacgaataaaagctgccttaaggcccaggcgaggtggctcacacctgtaatcccagcactttgagaggcctaggcaggtggatcacttgaggtcaggagttcgagaccagcctggccaaccaatatggtaaaacctcgtctccactgaaaatatgaaaattagctgtgctttgttgtaggcatctataatcccagctactcgtgaggctgagagaagagaatcacttgagcccgggaggcggagtttgcagtgagctgagattgtgccactgtacacactgtacactgtaccactgtacagcctgggtgacagaataannctctgtctc

SEQ ID NO: 562642 - DNA, 178 bp, Homo sapiens
cgacgtatctttttctgtcatcctcgtccctaaacccatcaccccagctcactcagtacagaaacagcacacaaattctctaattcagcttcctctgaaatacctggcaatcctcctccaaagtgtaagggtcattaaaaacaagtctggagaaactattacagcccagaggagccgg

SEQ ID NO: 562643 - DNA, 621 bp, Homo sapiens
  misc_feature (15)..(15): n is a, c, g, or t
  misc_feature (22)..(22): n is a, c, g, or t
  misc_feature (77)..(77): n is a, c, g, or t
  misc_feature (302)..(302): n is a, c, g, or t
  misc_feature (599)..(599): n is a, c, g, or t
gcatcagctgtttcnagggtanaacgcgcgccggaaggtatatggggcatgccttatgaagcgtgtgtcgctgaatncatggcgatggggttgatattcctgagcgtaaacaatccgctttaccttgcactggccttaccgatgcacgccgttctgtacctcatcagcgccaacgatccgaaaattttcagttccatccacatgtggttgaaaacgaatggacgctgccggaattttctgtttgggagggcctcaagtttttcgcctcttgccaccaagaagttggagaaagtcaggctatngactcgcatcgtaaaatattttcgcgtccgcgaaaactaaaggagaaatatttatgggtgccgcattcaagtacgccgatgcgttgaagaatgaaaagtcgacagccttatttattccctattccagccacgtcaccaaaaatgttgtcaagctggtaaacggggactacatcgcaaccattcggatgcagggtgcggcgcacgaaagcgcagacgtacaagatattacctcgtggcacgatcagcttaatgggtttatgagaaacatcgcatcgccaacacggcggtgtggtcgcntgtggtacgagtgatatgggaa

SEQ ID NO: 562644 - DNA, 905 bp, Homo sapiens
  misc_feature (610)..(610): n is a, c, g, or t
ggaaggacctatgatagaacaacttagcaaaatgttctttactactaaggcaccgttgttatcctcatgaacggtatcacagatgtcgtaagaatctgaatcctccaaaagacagatgatgcggaggttcctgggggattcaaagagaaatgtgcctcatttgccattcgagaaaatgccatgtctggtgtattcagtaatatatagtaaagtaataatgataaaatatcttttcatatattagaatgtgtaccttttcattataatagtaattcttggatttgacagttcttcattgagagaaacctgattttcttgtgtgtctgttttctattgtagggttgtcattgatgtgcggtctccaattgaggacttttccatagtgccaaagccatagatatgcaggagaacatcagataatattacgagtcagaaattcaaggagtttatgtataaaacggggttcgtgtaggtaattcgctagacagtaggctaactgtaaggtgttctgagcatatttaagaaggctagcatcttcaatttacgaatatcttcaactgatagtaggtgtatgggatgtaacctatgataagtggagaaacatctcttngagtgcccactgggattgaagtatttgaatcatcaggcaagcattgtagtagtataagatggttattaacactgttcgtggttcgtggacgagcacttttaaatgcttggaataaagccatagggtacgaagaaaatatgtttgatgttcggaggtcttagaaataatacgggtaacataaacaagggtgattatcaagacacatacacgggggtgggttccccacaaaggaaaaaacgtcgagggggcaataatgaaaaaccgggagagcgaaaaaaaaaccgggcaaataggt

SEQ ID NO: 562645 - DNA, 134 bp, Homo sapiens
agtggagagtaacatggagctgcagacgatgattgccgccgtggacacagactccccccgagaggtctgtatccgagtggcagctgacatgtcatctgacggcaacttcacctggggccgggttgtcgcccttt

SEQ ID NO: 562646 - DNA, 751 bp, Homo sapiens
tggggtcatactaaaaacgggggtctcgctgaaactccgggcctccagggatcctccatcctcggcctcccaaagggctgggaatcacgggggtgagccaccgcacccagccctctctcttcctcaaggcactctggggttcttccggttcttccgaaacattcagctggactggtaatccagggcttccgggactccggggaccccacgtcctggcaccccgggcttctggactcatttcctaggggccccttggtggtatcataaggggtaatggattttaatagtcacatttacaaccatctggagattttaattttttttggaacgggagtctcccactggtcgcccagacggggatgtccagggggcacaatctcgggctcactggcgatcctccacctccggggttcaaggtgattctccggcttcagcctcccaagtagctggggatgacagggtgtgcgccaccacgcccaggaattttatggtagttttagtacgagacaagatttcaccatgtgggccaggcgggtctcaaactcctgaattacagggaggatccgccaacctgggcctccaaaagtgctgcggattacagggcatgagctaataggaccgcggctaaacaggggtgggagtcgaggaggggaactccgggccacatgaagatcacggctaccaaatcacacgcatatccggccagaccccaagagtgggataagggacccgtgaaccggaattttgtttg

SEQ ID NO: 562647 - DNA, 382 bp, Homo sapiens
aaatgcctcctgatctcagccaccctactatccaggtacttatcacgaacagaaaccacgctacctctgaaacccctgaccatcatttcttatccttctagctcgcctgtactctagccatgaactaccagcacattcccatatcataacagcagctctagccctaactatcactcctactacttgtgcagctcacacacgtatagccccatacattataatacttttccttataaaataactacaatattactatgtacccttatctacataaatatacctagcaaaaggtatacctatctcccaaacaaaagccatttcctacactggtagcttagggtcccaccccctctacactttcctggagactttgtatctatcg

SEQ ID NO: 562648 - DNA, 557 bp, Homo sapiens
  misc_feature (331)..(331): n is a, c, g, or t
gaatcatatataagggaaccttaggaaccctctattctaacactgtttacagatgtggaaatggaggtactgagaggtgacttggttttcttgaggccacactgtttgcagcactgtatttctgaacttgtattctaacatctcaagtagcaaaaagtggaaatgaaaaacaattgagggagctatcagtcagagatggtagaatgaatatctctaatagcccctgttttttcctcatacctcattaaatgacagtaagaaaaagcattaactcagaagaacaaaacagaactgcagaagagagaacagcaacacaattttggaaactggnaagtgggtagatgaacgattactgacttagtggcaatgggggagcaaggccgtttacactttgaaaacccagaaggctcaggagtgggtgcatcagttccctctggaaatgggggcaaaagtgggttgcaaagagaaggattcactgaaagtttaagaaaagactccagagcctccctcttcttctatgaagccaagagaatgtcctttccttaccctagcagaag

SEQ ID NO: 562649 - DNA, 1414 bp, Homo sapiens
tacttttctctttaccctttttttttaaaccttaggtttcacacaataaacactttagcgcacggtgaaaaaacaaaaaaaaaaaaaaaaaaaaagaaaaaaaaaacacaaagaacaaaaaaaaagaacaacaacaaaaaaaagacggggggggcgcgccccgcacaagctgcccccgccggggggccccgagagcgccagcggcggccgccgccactgttttggtggagagaaagggggggcgcccaaaagaggggaggaggagaatatataaatatacagcgagcgaggcgggggggggcgcggcggtgataataacaaacggagtggagagagggggagaaacacaggggcggcgaggagggggagaaacatctggagggagaggagaagaaaccacaatattttagcgcggggggggggggagaacacacaagtggagtggggcacaacaacccacccccaacaaagagagatatatataagcaggcgactgcgcaggggaggcgcatatatatataacaatacttacagggagcggtgcaatatgggggcggaaacaacacgcggagggcggagaccagacgaggcggggcgaagagagggagaggaagacaaagtggcgggcaccacgaggggaggaacaaggcgacaacagaagaaacaacacattcataacacgcgcggggggggagcaatcgccaatacaaaacatccggacgacaaaaaagacagaaacgaagaagaacacaagtgacagaaagagaggggaaagggaggaggggggagggggagggaggcgagcggaagggcgagagagcgaaagaagagcaaggaggaggagcagacgagagggagaagaaggaggagaagagagagagaggggggggggggacgaaggggagggcggaggagggaaaaagagaggagagaggggggggggagggaggggggggaagggggggggagagggcggggagacgcgggagggagagggggaaaagggcgagacagggcaggacgagagagggagaggagaggggagaggggaggaggggaagaagagaagaagggagagaggagagagggagggggcgggcagggggaggacaggggaggaaaaggaggcaggagagcgggaggaaagggaggggcgagagaagagggagagacaagagaagaaagggagaggaaaggacagaagagggacgcaggagaagagaagaggagaggccgaggagaggacagcaggaagggaagggcggcgaggagggagaagcggtggaggcacggaggacggcggggatacgtaggggggagcgggaaggaggaggagaggaaggaagaaggggggggaggagggcagacggggcgaggcgagggaggggaggggcagaggggagggacgtgagga

SEQ ID NO: 562650 - DNA, 129 bp, Homo sapiens
ctagttttactttttttctttattgcattgtagttttcagattggagaactggcaaataccctgaacaagtaaattcgagtttctaggcattaatagactatccatctccaactttcatgtactgctct

SEQ ID NO: 562651 - DNA, 494 bp, Homo sapiens
  misc_feature (146)..(146): n is a, c, g, or t
cgtcgtcgaccgtggcgtagggcgtgagatgcgccagcgcttctcgaccgacggcggatagaggcccttgtggacgcagacgatgtcgtagcccgccttcacgatcttctcgtagaagggatagaccagcttctcgtcgtccatcngccagggatggcgcgccaggtccttgttggtgttgtcgccgaccgtgtagcccttccatgaatcgggcttgagggtggcgatgcacttgtcgacctcgtccatccagccgtcgtagcccggcgtgaagatggcgtgcgacagcagccgcttggagccggccgcggcgttcaccttggcccgcgcgtcggccttcatctcgttggtcaggaaccagtcgcgcggatcttccgaggccgagccgctgatcagcgcgaccttggtgtcgctgtcgaggaagacctccttgaaccagttgggatacttcaggtcgtcgatcgtctgcggcttgtcgacgaggtcgggattcc

SEQ ID NO: 562652 - DNA, 314 bp, Homo sapiens
agctcagtgatactcctgcctcagcctgctgcgtagctgggattactggcgtgcactaccactcctggttaattttggtattttgggtagagacggggttcgccatgttggccaggctggtctcgaactcctgacctcaggtgatccacccacctcggcctctcaaaatgctgggattacaggcgtgagccaccagtgcctggacttccatctggtaactttcctgctcttgaggaggaactacccgtgcccctggcacgaggctggcggatgacaggaggagagcgatcaccttgaagcccaggggctaccga

SEQ ID NO: 562653 - DNA, 1004 bp, Homo sapiens
tgtgttttgctgtctcttaccccacacttcccgtgtcctttccaccggggcttgagaggtcacaggttcttgatgctgtggtcttgatctgcaggtgtctgacttccagcaactgctggcctgtgccatgcgtgcaacgctgagcatctggagttggagttttcctgtggagaggacccatgcctaagtgggatgggccattgttcatcttctggcccctgcttgtctgctatgtaagcgttaataaccagcaaccaggctagtacgggcaaagattggaggaaagatgagctgatgagcatcgattagcgttctctgagcaagcactagagccagctgtgatgcgtgaactgccaggcatgcccttcctccaggcatcgaagggtctccagaagacgtgcacccaaaggacgcaacggcgtgcgagcgttggatcacactcttgatgagctgtcccctatctgcttgcagagggacagggtctcgttcatgtgccatccaagaggcgtaacttctgtcccagactttacgtgtctcctggaccagtgcatatcacccggcatcccttgtcctggaatcatagctgttggtctgaatctgagccctcgtggaggtcacagcccactttggttctgccattgctgctgtgtggaagttcactcctgccttttcctttccctagcagcctccaccaccccgtagatcgcatgtctcactggcttttgtctgcccagtttcaccagaagttggcctcttcctgacaggcagtgcaccactgcctggcgctgcgcccctttcctttgctctcgcccgctggagacggtggtttgtcatgggcctggtctgcagggatcctgctacaaaggtgaaacccaggagaggtgtgggacatcccgagtgttgccaggacccggccaggcattagttgcccgtggggaaaaccggggaactcccgaaaaatggggggtcctggccatccgtgaaatctttcccggggatccccc

SEQ ID NO: 562654 - DNA, 896 bp, Homo sapiens
gaagcaaataactgaatagatgtgatttaagaagagattagacatagctaaagaaaaagttagtgaatgggaatataagacaatactctaaagtatgagaagaaaataatagaaaatagagaaaagcaaaaacaagcacaaagtatagaagaattaaatctgacacgtgtgttattgggatggtagaaggaaggaggagagtttcagagcaagtatttaaggttttcaaaatgacaatgacatgccatgctttcaaggaggctaacaaacaagaaaaccataagtaggaccagtagaagaattctgtcacagtccaaagacaagatcttagagcctaacagagaaaaaagagagggctttcaaaagagtaacactcacaccaaggaccaacttcacaataaaaacagtggaaactagaagattaagtgctcataaaaaatacactgctaaactggaatttggtatcactaaaaactgaaaaggaaagtgcagattaaataacagaaaatataaattagaaggaaaattatagtcatgatagaatacatgtgattgctgcaaatcatatagctatataatgagtcattgaaaccaaaagtttatgcagaaagcatgtcaactcagaactatataatatcatgggtctattacttaggaactgttttgttgctctggcaaaacatttcttggttccaataatttctcactctttactgggaaactttttctcattgagtgacaaagtatttccttaggctaaattacgtgatggaaatttcagggggggggggaaaaagtcacttggggtctaacaaagggttaaaggtgttatttttgagaaaaaaaaaagtggggggcgaaaaaattgggggggaaaaagtggagaaggtttaagg

SEQ ID NO: 562655 - DNA, 309 bp, Homo sapiens
actcagtatggaaacagaacatgatcatcttcttcaccacatcacaggaaaagagaacatgtcagacggccttcactcttactagaaaggcatcatattgtataggtccttttatccatatgtaaaggaataaaagaagcaatgtacaaggagaaatgtatccctcatgataggttctatcgcacattccaccataaaggctcacagttcacgaaaagactttaaattctctatgtgaacgttctgcatcagcaattgactgaatagagacagtcatctgtgcagctgctggcacttcatggcctcatg

SEQ ID NO: 562656 - DNA, 906 bp, Homo sapiens
gaaatggcggatgacgccggtgcagcgggggggcccgggggccctggtggccctggtgatggggaaccgcgtgtggcttccgcgcgaggtttcaggctagtggctatccgtgggccggagtttcgcgtgccgatggatcgtgggccggggcactgaggccgcggagctcgcggagtgcaaggccgaggcataacggagtgcgatgcccgatcacacaaagttgtgccgcttggtcaaggacatgaagatcaagtccctggaggagatctatctcttctccctgcccatttaatggaatcagtagatcattgactttcttcctggtgggcctctctcaacggatgaggttccgaaggattatgccacgtgcagaaggcagatcccgtgaccggctcagcgctaccaggtttcaaggcagtttatttcgcatatcgggtgcactacaaaagggccacgctgggtcatgggtgttaacgtgctccacacggtaggtggccatccgtcatccgtggcggtccagtcatcctgggcaagctcgtccattcgtccccgtgcgcacgacggctagtgggggaacaagatcggcaagccccaaactgtcccttgcaatggtgacaggccggtgcggcatctgtgctggtacgcctcatccctgtcacccaggggcactggcatcggtctccggacctgtgtccctaagaatgctgttcatgatggctggtatcgagtgactgtctacacctcgagccggggcttgcactggcaccctggggcagcttcgccaatgccacctttgatgccatttctaagacctacaggtacctgaaccccgacctctggaaggacgactgtattcaccaaggtctccctattcagagttcactgaccacctcgttaagaccaaag

SEQ ID NO: 562657 - DNA, 204 bp, Homo sapiens
  misc_feature (6)..(6): n is a, c, g, or t
tatcangtaattctgttatattttgaaagcccatgggagaagtcaaatggagagtatgctcatcagtggctatgcactcaacttggtgtggtgggatcccagggcatgcccaagagaatcgtaaatgcaaaaattgcttgccttgacttcagcctgcaaaaaacaaaaatgaagcttggtgtacaggtggtcattacagaccct

SEQ ID NO: 562658 - DNA, 260 bp, Homo sapiens
tcgctgaaatccgcgaggcggtgttgctgtgagccgagatcgcgcatttccagcctgggcaacaagagggaaactccgtctcaaaaaaaacaaaaaaaaagaagagaaaagaaaacataattttcccagggcaatgtcgggcgcaacttcgggcattggtggggggccacggcctttcatcatccagggcctggggtccagttgggggctcccaaccacccaggggccagtggggaatctccaattcggggaaagggagg

SEQ ID NO: 562659 - DNA, 637 bp, Homo sapiens
ctctcgtgtgaggttttgtaagcctacttaacttttaagacaggtttccttaacattcataagtgcccagaatacaggtgtgtagtacagcatataaagattgtacagctctgaggtttttccgtattgacttggaacatttgtgttgtgcctgtcgcttgccacatggccaatcaagtaatgcttcacgctttctagataattgttatcttagagattatgccacgtgaatgtatttcattgtacatatggtaaagctgagtaattcatattctgtattgtctatatagtcaaatatagacatgtccaccgaaaagattaagagtttttaagcttcgtagatgctgctggtcatgaagaattaatttgtcactggttataagagtaatttttaaggttatttctaagtgcatatctttaagtagttttcggaactgagagtcatagtggagaaacttagtggtttgttgtaaaaaagtcgtgtttttatgggctgagatacttagaatcagccatccagagggggcggttcagggaaaatacatgatactttggcagatatcgaatagtgaaagtaaaaacttgggtcataagtaatgaaccaagagttagttcctgatgtttggaacatagaatt

SEQ ID NO: 562660 - DNA, 119 bp, Homo sapiens
agaggatccccctggtcgctgtggttctgttaacatcttctagggtttacaccccaaccctaataagtcatgtgaagatcttagcagaagagctgctaacaatctaagggtcatgaata

SEQ ID NO: 562661 - DNA, 427 bp, Homo sapiens
agaggtccctgatatgcatctcatcacttctaataacttgctacatatataattttccacgggctgcgtcacttatgtctattatatctgtgtggtaaaagtactaaagaacagtaatctactggcccatctttccccaactttgtgtatagtgaaaactagttagaagcttacaattggctatggtgggagtatttataccaccaaaattgcgcaaatgctaccaattcaaagctttttccccaagaagacggggttgttaaacattttaccagcacaccattacaactaatctgttatttctcttgtaaggacttctcttgctaaagactccattctctttttttttttttttttttttgggaaacggaatatcggggaccgggccccaattcggaaaccggggcaaaaggggttcccgggggga

SEQ ID NO: 562662 - DNA, 136 bp, Homo sapiens
actactcatcattgccactcaactacccagttttcctggctggaagattgggcatctgacaaaagcctcaggaagcttccatttatggcagaaagcaaacagtagtcacagtacagaaatcacatggccactggga

SEQ ID NO: 562663 - DNA, 425 bp, Homo sapiens
tacttgcattccatggggtccaataatggtgtcatccacaggtctgcaggtgatgtttacccagtatgaatgctcatctgcaaattcagacgtgactctcaaggtgtggtctccatacttggaatgacttgagtaatcacattccgtcataggtagtattcatgcatttatcttggaatatccgataacttaggtactgagctgtgaaagtcaggttccctttggcacaagcaggtgactccctctgtagaatgttcttggaattaacaggattcaatctgtcatttccggtaggtggtaccattcccaatgctgacaccagcagtcagcctcccagccagctcccaaggctccacgccatgacagtacactgcgggttccgcggcttcctccaagctcacgacttccgccagcgtccgggacag

SEQ ID NO: 562664 - DNA, 410 bp, Homo sapiens
  misc_feature (410)..(410): n is a, c, g, or t
attgtgtctccatatctcaacgtcattcagctcgcacagatgagtgagcgacacccttatctactttgtggtgtatatctgttagagctgcaccatagtagtgcaatctacgtgtgaaaccgtaccgatgctgagtgatcctactcattacttcaagctattgatacatctgataccgacctacactgaggagttacactgatgcgggctctgagatgacattgatagcgagtactcgcaatgctaccgtgctcacagttgcactgacctgtgtctcactgtgtccaggtcgatatagcataccgcagtacttagagaagtatctgtctaccccatgtgagacaggggtactcaggacctgcttgtcccctgcccactgacatgatctgtgcctgctggacattgcgtgn

SEQ ID NO: 562665 - DNA, 847 bp, Homo sapiens
actgatgtagtattgtcgttttgctaatatatgtatctcaaaattctttaagtcagactatttatcatagtgtaaattaaagcatgaagtacattctcatcttataacttacatcttataaataaggctactaacccttagaacaccacctgcggttctgtcctctaccccagttggtgactactgtttaccactacgctggtgaattgtagtagggaaagacaatctacatattgaagaggaatggcctaataaaatatatgatgtcgtcataggatagatatattgtatggagttaaaagaaataatctagatccatattcaacctggattaggtactcggaaaacataatgctcagatgaagaatagcaagttgtagaaagttcatattacaacattatagtatatgctcacgaaatacgaagtgacctactggcattcgtctagtgcggcatagtattaatgataccggtcaagaatcgttaattgtccttaacccaccggtttcaagaacggtaagtccactacctagagagctgtcgtagaccacggcgaagattgacggggagggtcataagaatgagcaggaatttccccgggtgccaaatccaaggattcgtggcgatgggcgtgggatctacaaagcgcagactatgatgtttagagtccaggttagagccatcaaactgtacctaggaaatctctatacagtgtcttctcatcggttccactatcaggtttgacaccccctaatagcatgtcaatgcttgtcagtgccagtaaaatccattccttgatgtgcggtaccagctgccctttagcacttcttggagcgccccccttatt

SEQ ID NO: 562666 - DNA, 1151 bp, Homo sapiens
acgctgtgcagggccggcgcgggtcggggggcgcccgaggggcccgtgccgagcgggtggcgctgcagggcgggtaggcatccactcgggccgcgatcgccggctggtgcacaagcgtgccgttgagctgtgctcactcctggccggctgcctgtcctgtgttggaccccgcgcaatggtgcatgagcctcgtggaccacgatccggtgaggacccagagcagcgtgcccccccatcgatgtcctctggatcaaaggggcccagggaggtgactacttctactcctttgggggctgccaccagttacgcggcctaccagcgaacttgcagctgagagaccatccccgccaaggcttgtccatgtccactctctcagaccttaagggtgtacctgggagcattccataccagactttgcagtagcagcctcctttggcacctgttgccacctttcaagagcccagaagagacacctggccctccagccaggctgggccatgcagaacgggatcagcaggggtgcattctctttgcacctggcgagagggtctgatctgggaacccctctcaccggctacaaggccttggatcactgtacagtgtgggagcccagttcccactctgtgacaataggatcatggcttacccttgaagcattaccgagaaggagaaccagagatgggctttgaagagccacgtgctgccagagtccaaattcccaaggaccaggatccctctgcattaggtctatgtaacctcttatatggcctcacttcagcttgcaggcacggaagacctttgacttgacggtgggttaaaccgacaccagcaagcatggttttccacattagcagtgcatctgagcacaatggggggcacagggcgaatggggacaaccaaacccaccgaacggcacgagggcacgacacagaccaccaatacggacaaaaacagaggagcagaaaaaaaagggcccagaagagaggggagttaccaagaacgaaggtcgggccacgaaacgaggcgatagcaactaccagagacaacacaaagaaacgaactgtacaacaaagacgcacaggaaagaaagcacccaaatagaacgaggaagcagaacaaaagaagagaagaagcacgacaacgaagcaagc

SEQ ID NO: 562667 - DNA, 137 bp, Homo sapiens
ccccgtggcaagtcaggcggtactacagtgcagtactacaggcggtactaccaggcagtactacaggcagtactacagtgcggtactacagtgcagtactacaggcggtactcacagggcagtactacagcgccagt

SEQ ID NO: 562668 - DNA, 135 bp, Homo sapiens
gctaggataacaggcatgcacaccatgcaccgcgcctgggtgcttttcactttcttgacagtgtctgtataacttggctagggctgcataacaaaataccacagactgggtatgaactcactgggcgagctagga

SEQ ID NO: 562669 - DNA, 744 bp, Homo sapiens
tggaaccagacggtgccgatatgaggaagcgggctccatggctgccctcctgctgctgcccctgctgctgttgctacctgctgctgctgctgaagctacacctctggccgcagttgcgctggcttcctggcggacttgtgcctttgctggtgcgatgctctgtgctgcaaaatgggctcttctgatgctctgctgccctgtgcctgctggctgcctgcctgaccctggaatggtccctgagtgggtggctgcatgccattgccttggcgcctcgctggaactggcccagcatgcgctgccgcggcacacctttctcattcactggctcgcggctgctttagctactcatgaggctggagcgcgagatgtaacaggggctagcactgcgccttcctactgtgcgctagtgcttgtgactgtggaccctgacggcgggaacagcgggcaaggggaggcgctggagaagtgcgaagcgggcagctgccaggtagccgtagatgcatgctggccggaagctgcgcggacgtttgccggacggggacggtgccgccagagtgttggatggagccggcctgcccctcttgtcaccgtggatgcaactgtggagctgatcctcccctgttggccagagtttcttgtaggtctggttcggggctggccaatgccggctgcgcactgcctttgtgccatcggacctggccggtgccccttcgtgcatgcctccgcaatcggcgcgcagcgcga

SEQ ID NO: 562670 - DNA, 178 bp, Homo sapiens
aggggtcccagataattctttttttaaaaaaacccccccccctagagaagcccacctgtcaagagtctgggacccccaacttcagctttgcatcccgggtcttgtattccaagaaaatcaaagggggccaatttgtttgtttcccctatgatcctttctaaataaactctttttttta

SEQ ID NO: 562671 - DNA, 139 bp, Homo sapiens
tacgctcaaccgaacatcagcggggagaagtgtagacagtaatgagaaatcctgcgaataggcttccggctgccaggcgattataatgggcgtttagtacggtgggagtaattttcgataactgttacgtaaccggtgg

SEQ ID NO: 562672 - DNA, 181 bp, Homo sapiens
tgttcctccgggtttgggtcgggggtgggtttttggggaccctccaaaggtggaggtgggctaatggcctggctgcctggtggttaatggttttgctccccctcccttttttttttttgagtttattttgattgatttttttttttggtttttggataaccccccctttggggacaggata

SEQ ID NO: 562673 - DNA, 216 bp, Homo sapiens
  misc_feature (30)..(30): n is a, c, g, or t
  misc_feature (40)..(40): n is a, c, g, or t
  misc_feature (89)..(89): n is a, c, g, or t
  misc_feature (151)..(151): n is a, c, g, or t
  misc_feature (160)..(160): n is a, c, g, or t
  misc_feature (213)..(213): n is a, c, g, or t
tcagatatgtgacagagcatgtctttaaanctgtgaatcnttaacgtcccagtgatgactccttggttaagagttaatcaggatgtccncatggagaagcaaaattactactatactttgtcgtctttctcaaactgacctgctgatgagnaaatgcaanacaatttttgatactggaactatgctttgaaatacaccttacactcttcatanggc

SEQ ID NO: 562674 - DNA, 281 bp, Homo sapiens
cggggtgaggcgcatgagcatattctgccactgcactccagcctgggtgacacagtgagaccctgtctcaaaaaaaaacaaaaaaaaattagagataacttgcttccggtgtttctaaattgaaaaaaaaaaaaaaaaaaagggacggtgtttccagggttaaaacctctaaaaatattccaaatacccaaattaaaccgaacgtggaaaattttttcttctcctatatccatttagtggaaactgtgcgccccaccacgaagaagggaactagagttacc

SEQ ID NO: 562675 - DNA, 143 bp, Homo sapiens
tgatcgtctctagaggtatcccccgcggcgacttttttttttatgcggccgccccttttttttgcggaatcaccattgtcggtctgggacccctgtacacgtttcctgaaacactggagggccttcaagggtctcatactgct

SEQ ID NO: 562676 - DNA, 326 bp, Homo sapiens
  misc_feature (42)..(42): n is a, c, g, or t
aaagaaagcaacaacatcaacatcagcataaagaaaccctancaaaaccccatccaaaggtcaccagcctcaaagatcaaaggtagataaatccactacaatgaagaaaaaacagcacaacaatgctgaaacttccaaaaacaagaatgcctcttctcccccaagtgatcacaaatcctctccagcaagggcacaaaaatgcatgcagaatgagtttgacgaattgacagaagtaggcttcagaacgtgggtgataaaaaactcatctaagctaaagaagtgtgttctaaaccaatgcaaggaaggcgtgaagacaagattagaga

SEQ ID NO: 562677 - DNA, 619 bp, Homo sapiens
  misc_feature (27)..(27): n is a, c, g, or t
  misc_feature (134)..(134): n is a, c, g, or t
  misc_feature (147)..(147): n is a, c, g, or t
  misc_feature (155)..(155): n is a, c, g, or t
  misc_feature (157)..(157): n is a, c, g, or t
  misc_feature (168)..(168): n is a, c, g, or t
  misc_feature (179)..(179): n is a, c, g, or t
  misc_feature (183)..(183): n is a, c, g, or t
  misc_feature (198)..(198): n is a, c, g, or t
  misc_feature (229)..(229): n is a, c, g, or t
  misc_feature (238)..(238): n is a, c, g, or t
  misc_feature (265)..(266): n is a, c, g, or t
  misc_feature (279)..(279): n is a, c, g, or t
  misc_feature (298)..(298): n is a, c, g, or t
  misc_feature (344)..(344): n is a, c, g, or t
  misc_feature (431)..(431): n is a, c, g, or t
  misc_feature (433)..(433): n is a, c, g, or t
  misc_feature (445)..(446): n is a, c, g, or t
  misc_feature (558)..(558): n is a, c, g, or t
  misc_feature (605)..(605): n is a, c, g, or t
tgcgccttcctggtggctctctctcanggcgggtcaaggctgaacaagacagaaaagcacagtctaggtccaccatcacctcccactggccaccagttggccagccaggaaatcatttctgtacatcttttgtntcccccttttatntccctctntnttctccaaaanttgttgctatntatnactttcatgtaacantggacttagtgtccattaaactgcctgggangtggtttgngcctgacatattttcctgagctaaaannggcaaagtacctntgtggccttcttgccattnagatcaagtgaaagggggactagcactattgggaagggtgagggtngggaggcgttagaatcctctctccaccccgtgaaggtttctctagctgtagctcttaagggtacaagagggcaaatattctggggtnanggaggtataatnnggaaacacatttattttccccttttaaacttccctgctgccccagtttttgctttcttcttagtggatcccttgggttctggctccttgcgcttagctgaagagagtgagcnggtcaccttgaagaaatcatccaggcggccctgggtgctgccttggnggctctaactcagc

SEQ ID NO: 562678 - DNA, 451 bp, Homo sapiens
  misc_feature (9)..(9): n is a, c, g, or t
  misc_feature (181)..(181): n is a, c, g, or t
  misc_feature (201)..(201): n is a, c, g, or t
  misc_feature (228)..(228): n is a, c, g, or t
  misc_feature (244)..(245): n is a, c, g, or t
  misc_feature (255)..(255): n is a, c, g, or t
  misc_feature (274)..(274): n is a, c, g, or t
  misc_feature (318)..(318): n is a, c, g, or t
  misc_feature (331)..(331): n is a, c, g, or t
  misc_feature (334)..(335): n is a, c, g, or t
  misc_feature (339)..(340): n is a, c, g, or t
  misc_feature (357)..(357): n is a, c, g, or t
  misc_feature (364)..(364): n is a, c, g, or t
  misc_feature (424)..(424): n is a, c, g, or t
gccagggcnctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcccccnccaccatatgaagaccgctnacccctgttcccaggccctctgcgccntgggggctatgggcanncatctgtgcngccaggagggtatcgtgcntaccctggctacccgcagcctggctacggtcaccctgctggctncccacagcccatnctnnccanncacccgatgcccattanctatggnccaggccatggctattatggggaggagagacggtgagtgatatcttcgagcctgaagagngggatgaccggaaagtgcaacacactt

SEQ ID NO: 562679 - DNA, 541 bp, Homo sapiens
cgtcgctcatacgcggtggacgaattacgcctatcctccatggcatcaacctagcagtgtgcacattccaccagaaaagaagaaggatgttgagtccaattgccgggcgcacggcatcggccttattgtttttgccgatcctctgctttcggcgtcgtacgatatattgctagccccgacgcgaaagtccccacatccagcagatgtcgaagactacctggaaaagcgtctcaaagctgccgacctagccgcactcaaatcacgcattcatgagttggagttgagcattcgatgaaaattattgtcgtgttcaacatgagagggggaattggcaagaccaccctggcagtcaccctagcagaagggctagcgcagtacggaggatcgaaggtgttactcgctgacgctgacccgcaacgcagcgcgtcgcaccggttatgcctgctcactaccgtcaacgaatgcggacagccgggaagtggacgcaatatcagtaaatatctttcggacgcgattgttcggaatagccttcccgatccca

SEQ ID NO: 562680 - DNA, 409 bp, Homo sapiens
gcgggcacgaccctataggccatttatcaagcagcattctagatgaagggcttgacgccatttgaattacagcagttgactcagcagctgcaagcagtctggccatttcggaacgcaaggttacctttcagccctgtctactgaccaataccccgactcaacttgtgtggcgcacttcagaatacagatatacctagcagtctacctgtggttcggttatataattaatcagctcgttacttaagccccatgaaaatggcatccagggctgacaggagattcagagctcaaaacaaggcgagcttgagttctgcactccagatgtgtccaaaactagtaaaacttaaaggactaacaaccttgtcagtattataatgaggcagggatactcttgtctacacactaaaca

SEQ ID NO: 562681 - DNA, 394 bp, Homo sapiens
tgtagtgagtatcacctctaaatcaccactgatcaaaagggacaatgcatcatgcactgcatgcaatgcatgctcaaaatgcttagcctagccacacccccacgggacacatgcagtgattaacctttagcaataaactgaatgtttaactaatgctatactaaccccagggttggactatatcgtgccagccaccgtggtcacacgattcacccatgtcaatagacgcctggtgtaaatgagttgtttaagatcaccccctccccaataaatgctcacaactcacctgagtatgtaaaaaactccagtttgacacacaatagactactgatattggctttaacatatctgaacaacaacaatatctaagaaccaaactgtgataagatacccc

SEQ ID NO: 562682 - DNA, 412 bp, Homo sapiens
  misc_feature (19)..(19): n is a, c, g, or t
  misc_feature (72)..(72): n is a, c, g, or t
ggtttttttcccctccccncaaaatatttttcttcccccccggggggggggggagggggggtcccccccccngggggtttccccccttccccggggggttttggggggccaggggggttttttttcccccaaaaaaaaagggtttgggggcccccccccccccccgccccgggggggggggttggggggggcccccttttgggggggggggggggccccctttttttcccccttcccccccccccttttatttttggggggggggaacaagtttgggggggggggggttttccccccctttttaggggggggaattctcccccccggggcggggggggggggggggggtccccccctttcccgggccccccttttttttttttttttttgaaaaaagggggggtttttttca

SEQ ID NO: 562683 - DNA, 208 bp, Homo sapiens
gcagaaagtagcagccactctcacagtcagcattaaggatctacccaaacattaatatctgcctacttgtattcctgggcatccttccagtccatgcccatcaaggagcacatcagaggtttacattgctagaacagaaaatcgtcaaaacagaaaatgtcataggactaaaaaaattatcttttcatatctgccagattatttacat

SEQ ID NO: 562684 - DNA, 368 bp, Homo sapiens
gttttgccttgattattaggcaatatttggatatatgtacaaaatcaaaacagagaataagtagtctagctagagaaggtagctggtgggtttgatttatgaaggggaacagtaaaaaagagaagttgaggacagaaagtagtatggggtgctctaagtgggtagattgcctcttaaataatgaaatctggatgtggttattgctagaacagtggctgaagaaaatcttgtgtttcaaagaaagtggattgaagagtactttttgtgacccagaattcaaaatttaaaacttataaagtcaataaatggaaaacaaatgagtttctgaagtgtcttcatcaaataatagaattatggccagtagtaaa

SEQ ID NO: 562685 - DNA, 293 bp, Homo sapiens
atgagatagtaacgcgatcccatgatttttccgaggggcgccattcctagcaggcatcagcacatgtaagggcagagccagtagtccgttatccgccccatctgtcagtggaccgagaaagtaacttgcctcagttcacacagctagtccgaattctcgggttgctgaggaaggatgatccatcatagtgctggacatgacctaggtcaaaactccttcaaataatggataaatgttggctcaacttcttgagaatgaacataatacatgtctatttataacactatgtaaga

SEQ ID NO: 562686 - DNA, 197 bp, Homo sapiens
ggcctgtcagatgtagcacccactctgtcatccaccatgattgaagctccctgtaggctcctcagaagccgagcagaagctgtcatgcctcttgtacagcttgcgagaaccatgagccaatttaaactcttttctgcttcaaattacccagactcaggcatttctttgtaacagtgcgaagaacggactaataccat

SEQ ID NO: 562687 - DNA, 508 bp, Homo sapiens
gtgctgtctaggtggcaagccagctaattaccatcaggttaccagtttacacagagacgtgaagcagcaaagagctgacgcagaaatgacataggaaaacagcagcaaagtccttgagtcccaagagtccagctccaagacaaacatactaaagaacaaaggcccctaatccacctcctcaatggtagggcctgagccagaccctcccttgggaccctgagccccgaagccgccaggcccgggaccaccggcaacctggtacagtccgctgatgatggggttaccagcctgatccagatccttcctcttgtgctcaaactcgtccttctcggccaaggtgttggcgtccagccacgagatgacctcttgaaacttgtccagaaccttcttcttgtccggcctcgctgatcttgcccttggagcccgtcatctccaaggcgctcttcatgtagaaggcgtaggactccagcgcgtacttggatgacaccctctcgcgctgcacctcgtc

SEQ ID NO: 562688 - DNA, 269 bp, Homo sapiens
ttttttttttttccccaaggccttctctaaaaggatggggaattttttttgccccccgggcaaaagaaaacccccgccccgggaaatccttttttccccccccccccccccccggggggtttttaataaaaggggggccgggtttttttttttttaataaaccgcccaaagcccaaaaggggggcttttgatggttccataaaagttttataagcgggggaacccgttttttttggtaaaaattaaaaggctatgatggtgccctttta

SEQ ID NO: 562689 - DNA, 862 bp, Homo sapiens
  misc_feature (1)..(1): n is a, c, g, or t
  misc_feature (9)..(9): n is a, c, g, or t
  misc_feature (14)..(14): n is a, c, g, or t
ncttttggnaactnaggatccacagcatagcatgaccgcgacagcatcataaacatgtgaggcctacatcataaatgagtctcgggtgagagagctgcatgaaataggactcgccaaaggtgcatatacgctgaaccataggccacctactcatttgttaaagggcctatgaggtgggcctgacagaatctggcacatctgatatatgcacgcaactactcgtgactgtctaaactgatattaagagggcaaagagagagcgcctaaaagacctgcacggtgactcttacgggggattagtcatttggggaagaatgatacttgatccttgcatgcatactccttgcatttggaactgagaaataggtcagatacttcggtatgaaattcagagagaatcccactgaacacatatctgtgcatatacttatgctttatgtatggatcacctagagcaagtacagtcattaacatttaaacagacatttctgagactgctcctcttgacattcggcatggaatacggattgatgaaacaggacgctgaaaaacaaagtagttacacatatcacgatcttgaaagtgcgcggggcaagcactatgaaggcccatgtaccgcgcttaatgaaaattcaaagagtataccgaaaccctaactggcctcgtgtggctaaaaggtgggaccttgctgacagtttcctttagtggggggtaattcatgagcctggctactggctcagtgggttgggcgtacatcccccgagcggataacttattaaaggcggagactggtttccaaggacacggggtaaccagaaaaactcgcggcaaagccccaaaagcggaaaccaaaaaggctctg

SEQ ID NO: 562690 - DNA, 190 bp, Homo sapiens
gggtgcacagcaaaactctgtcaaaaaaacaaaacaaaacaaaacagacaaacaagaaccaaagttggatgcagtggctcatatctgtaatcccaacaactcggaaggctcaggcaggaggattgcttgaggccaggagttcaaggccagcctgggcaacatactgagaccctcgcctctgaaaaaatta

SEQ ID NO: 562691 - DNA, 229 bp, Homo sapiens
  misc_feature (7)..(7): n is a, c, g, or t
  misc_feature (26)..(26): n is a, c, g, or t
  misc_feature (37)..(37): n is a, c, g, or t
  misc_feature (95)..(95): n is a, c, g, or t
  misc_feature (100)..(100): n is a, c, g, or t
  misc_feature (110)..(110): n is a, c, g, or t
  misc_feature (129)..(129): n is a, c, g, or t
  misc_feature (142)..(142): n is a, c, g, or t
  misc_feature (144)..(144): n is a, c, g, or t
  misc_feature (161)..(161): n is a, c, g, or t
  misc_feature (192)..(192): n is a, c, g, or t
attactngcaggccacctactccatngcacctaattnggaagcgccacccttagcaatatcaacccattaaccttccctctacacttaatcatcnttcancaaattctanttctactgactatcctagnaatcgctagtacngncttaatccaagctaacngtttcacagcttctagtaaagctcctacctngaccgcaacacataaacaaaaaaaaaatttttttttt

SEQ ID NO: 562692 - DNA, 704 bp, Homo sapiens
ggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaggagctaaactccgtctcaaaaaaaaaaaatgttttccaaatataagccgggtatgggggtgtccggtagtcccagctactggggaggctgagaggggaggatcactggagcccaggagtccaaggtggcagtgacgctatgatggtgccacgggtatccagccggggctaaccagagggagacccgtcgaaaaaaaaaaaaggtgcagggcaaaagtccattccagggcctccctatggccccgcagaataaagaaacagcatggtggcatggggccgacgggaggacacaacgaccgggaaatccaccagccacttgggccaaggactgagagcagggacggaaatcaacttaggacggcccaggacgtgagaaaagccagggcgggcccagaagtggacgaaaaccccgggacatcatcacacaattacacaacaatagggatgaggacgaacaaggagcgatgccctgtgacgcccaaaacaacacgggaaggcatgaggccaggcaaa

SEQ ID NO: 562693 - DNA, 689 bp, Homo sapiens
tgtctcattttctctgctgctgccatgtaagaagtgcctttgcctcccaccgtgattctgaggcctccccagccatgtggaactgtaagtccaattaaacctctttttcttcccagtctcgggtatagtctatgatacagcagcgtgaaaacggactaatatactgaaataggtaccagtagagtggagcactgctgaagaagacagcacgaaaatgtggaagcgactttaggaagtgggtaacaggcagagggttggaacagttggagggctcagaagaagacaggaaaatgtgggaaagtttggaacttcctagaaccttattgaatggcttagccaaaatgctgataacgaatatgaacgagtaaggtccaggctgaggtggtctcagatggagatgaggaactagctgggaactgggagcaaaggtgactcttgttatgctttagcaaagagactggtgacatttggccccgcctagagattgtggaagttcgaacttgacagtcatgatttagggtatctgggtggaagaaatttctaagcagtcaaagacgcaagaaggtgacttggatactataaggaggcattcagttttataagggaaacagcataaaagttcagagaagattgagaccgatgatgcagtagaaaagaaagagccatgaatgaggaacaattcaagccag

SEQ ID NO: 562694 - DNA, 758 bp, Homo sapiens
gttgcgcttgctgaggcgggcttgctgacactgcatttccctaccctgctaaaacgcgcaaaccgaggagtccgcattctggtcatgagcggtgactagcatttgtgcagaacggcatcccatgaggagaactactcactcacagctgagcaaaacgactccagccgacgctgatcgtggtggttacaatcttcaggaaataactctgacgtcagacaaactgcaatagaccttccataaggatgcgatctccatatttcaagccatgcaaagacagctgagtcatcaccagagttatcggcaacgaagccttctcacccactcatggatcctctactaccacatactttagctgactctctctaaccagcaacaaattctagtcataccgatgcccatgaaatacttgtgagcgagactcttgattgtgatgaaaacctgcagcacgacttgcaatgtgcttgatctctcgagatgaggtgttatgacaaacatcatatccgaactgagttaatggagactcaatttccttgactggcacccaatggacttgagccaatacacagacaaacatgcaccacatttaaaacatctgagtaatcaggtccaagccacgagggagccccaaaaacctttgaaatatcctttggggaaaagataatgatgccagggttaactctctgcccccccttcccgagactttactgaaaaagcttgaagtctggagttcccccctcaaacaagggaatatgatttag

SEQ ID NO: 562695 - DNA, 262 bp, Homo sapiens
agggaaaagaaagaaagtgaagagagaaagaaaaaaggaaggaaggaaggaagaaagagagagagagagagaaaaagaaagaaagaaagaaagaaagaaagaaagaaagaaagaaagaaagaaagaaagaaagaaggaaagagtcagctggatgtggtggcatgcacctatagtcccagctactctaggagaagctgaagcaggagaaggaaggaaggaagggagaaagaaagaaagaaagagaaagaaaagaaagaaagac

SEQ ID NO: 562696 - DNA, 107 bp, Homo sapiens
tcgatcgagctcttaccggtgaagtgggaggactgcttacgcctcccaagtagctggacacaggcatgtaccactgtgctggctaatttttttttaattttttgcag

SEQ ID NO: 562697 - DNA, 556 bp, Homo sapiens
gtacgtagaggctggcgaatcggacaggtgttttcattgttcatccgccaggtctccccggtgctcgcaggccaggactgggccccggggcggtgctgctggtgctgcacctccctccccgcgccccgtcctctcccgccctacagccctacagggcaggcggagtccgtattcgtggtccttcgcggtgtcccggacccacggtgtggatggcaaagcccaagtggactggtcagctgcagacaaaaaagtcttctgataccgtcacgtctccgttgataaaatcatctcgcattcggggcgcccggaacttggtgcaagaaggcccagttgggtgatagccggctgagcccggatgtggggcacctggtgctgaccaccctctgccggcctccacgcccctggttggccggggacgggctgaaggcctttccggaaggacctcatcaccgtggcagcgcagagcagccccctggagcgtggttggaggcgtcggtgaagccaggctccagcaccgtccctgggaaccctgtatagccaggtcagcgtctaaccc

SEQ ID NO: 562698 - DNA, 1000 bp, Homo sapiens
agcggagtttcaacctgcagaggcccggagaacacaaccctcccgagaagcccaggtcaagagccaaatcccgtcactgaccccccagaccgaggcgcccagccactccccaccgctaccatgggccgaacgacgcagtacattgtcgcaatgagcctggagcgagatgcagtcgcaagggtctgaccagattggactgcatgagtcgactgcgcaaagctacccgatcgtatgactgctaactgcgttgaacggagaggtagaagatgcctggctatcatgggactttggattatgcttggagtgaacaaggagaacctaactgtgaatcggcattgacggacagggacctggactcacacatgtcatactatagggagcagtgaagacgaaagccagaatacacgaagatttgatccggtactcttacggaaagttcttgcgcaggcgtttgtgctagtgtccactgttacactaatgcttacacatgtcaaggtgacttgcttacatgagagagagccatggcggcaagtatagtcagagatcggcagtggtgtgcgcatgcaccagcccctgtctcagtgtaggtgcgactgaaacggggcagtcaagaatgaggcagtcacgtggcgcgcttctatcccgcaggtgtaacaatatgactgccgcgatgaaagatgaaactggactgagaaaccttatgatgcacgtgtgagcggcaatcatccggagaacctccagtgacattggccctggatattgggccatgagatcgataacagcagagatcgccagatctgacaggatcattggagaagggttgattccatgcaaagccgagaacttgatgaagccaacaacgtgcaacaaagatgctggcagtgggttagtgtgcccacccggttcgcctccaaatgctgcgggccagatagtcctcatgcttctcatggtaatactctaaacagtgttgacatagaacattagtcagacccatgagaat

SEQ ID NO: 562699 - DNA, 801 bp, Homo sapiens
tgagacaaggtctcactgtattgcccaggctggagtgcattggtgcaaacatggctcactgtagcctcaaccttccaggctcaagcaatcttcccacgttggcctcccaagtagctggaagtacaggtgcatgccaccatacctggctaattttttttctattttttgagagacaaggtctcactgtgttgtccggactggtctcaaactcctgggctcaggcaatcctcctgcctcagcctcccagaatgctgggattaaaggctcgagccactgaacccagcctcgacctcattttttttaatgacttcatgctatttcatcatatagatatactgtactttttgcctattcccatattgatggatatttgtttctggctcttttcctttttgatattgcaaacaaagttgtagtgaacattgttatatgtacatctttttttttttttttggaaacagaagttccgtcttgttggcccaggctggaattccagtggccggttttcggtcacaaaaactccaccttccccggtcaagtgatgcttctggctagagctccaggtagctgggatcagggcgttgcccaaacccgtgaaacattgggtttacgaaaaggggtcccccacgttagcaggcgggtctgaacctgactagataatacgctggcccccatgcggatcagctagacccgtcgcctgttgtcctcacatattctggaaggacagattcctctgaagtcattgaaattacagcgcggatgtattacagtagaccgatctcttatattcgaaaacggttg

SEQ ID NO: 562700 - DNA, 400 bp, Homo sapiens
  misc_feature (12)..(12): n is a, c, g, or t
gcccaggtatgntcagaaagcaagatcgcgcactgtttccagcctgggtggcagagcaagacgcctgtgtcacaacaagaacaaggctggtgcacagtggctgacgcctgtcatcccagcaccttgggaggcagaggcgggaggatcatgaggtcaagagatcgagaccatcctggccaacatggtgaaaccccatctctactaaaaatacaaaaattagctgggttaggtggtgcgcctgtagtcccaggttctcgggaggctgaagcaggagaatcgcttgaacctgggaggtggaagttgcagtgagcagagatcatgccactgaactgcagcctggtgacagagcgagactctgtctcaaaaaacaaagacgatgagcctaggtttcgggctccag

SEQ ID NO: 562701 - DNA, 394 bp, Homo sapiens
ctttttacgggaccatttggcttctttgcatgctttgggtttgttaccaaaatatccagtgtggtgaaggttgactgaagaagtccagggtgtccagttaaaacagaattaaattaaacttttcatcaccaaagacctgtttttgggactgccttgagtttaatcagaattattggcctagtaatccttcagaaacaccgtaattttaaataaaccttttccaatacacctttcccccataagaggtgtcttcaacactttaaagcattggaatggggattggattaagtatatatttggtggttctcaatgaagagcaaatttaaatattatgggcatttgtaaatacagtagttatgatgaagggcaggacattgcattgtaaataggattt

SEQ ID NO: 562702 - DNA, 769 bp, Homo sapiens
  misc_feature (214)..(214): n is a, c, g, or t
tggctaccgtgaactaaaatggaagcgttttgggggtcgcggtccgaatcttggggggggggtgtcctggccccaggaaagtttaacctgcattccgtccactcccgattccttcagggattccgtggctgtctgcactttacatgatgtgtccaatcactgctggacccaaaaccccatggtgtgaccggggacctcagtcctcgtgcgttanatgttcagagggctggagtgggtagatgtgcctgcagacatgctgggactcctatagcggcactccttttggctctcgtttctccggtcaaacatctcttcttcgcattatattgcagagtctcaaacaacagttacccagtgcgtgggttgccatctgtggacagaaacatacgcgtgatttttccaggtatatttgtgaacgcaagattctcgggccaaatgtggtgtgatggatcagaagagacgctttctgggagaagatgtgccaacactgctaatatgtccctaaagatggctattcacatatcatgggtctgagacacaggggggccatgtgtaaaccagccgggccgctctcagacacgaatagaacccctgtgtgttgggaaaccaccatggggatcatcgggagaagggcataaatgcctagagtagggaagaagaacgctttccctcggtatatttgttggccacttgcttatgggtggttaagcccatttaaaatgccccttttcgttttgccccctgtgtatttggtggacatcctgggctc

SEQ ID NO: 562703 - DNA, 345 bp, Homo sapiens
tctctagaggcagagtcttccttcggttgtccaggcaatggttgtgatcttggctcactgcaatctctgcctcccggattcaagcaattctcctgcctcagccccttgggtagctgggactacaggctttgtgccaccatgcctggctaatttacgtattataatgggagacagggtttcaccatgttttggccaggctggtctcgaactcttgagctcaagcattccacccgctttggactcccaaagtgctgggataagaggcatgagccaatgtgccaagcctataaaagttattcggtatcccccatgtatttttacccaggttgtttgggaccaagaggg

SEQ ID NO: 562704 - DNA, 528 bp, Homo sapiens
  misc_feature (11)..(11): n is a, c, g, or t
attgcgttggnttgatgattcttgctctacttaggaacttgtggtccaggatacaaaatagacagacacacacacacaaacacacacacacacacacacacacacacacacaaaccaagaccaggacacacaggatacagcaaagcccaaatgggaatgtgcctgtgccgtgagatttccaggcccgagtgcatgatttatggacctggtaacatgaagcctagatctatgaagtgagttctgaaaggcaaagaggaagtaagcgcattaagacagatggggcatgttataacatcctgctatttagattgtcactttcccccagactctactgtgcacgggtcactacagttgacagagatcccctcccgccatcctggtcacgctgaataacaaagggaagagaggaataagaactgtaatatctataaattctcagcatagtgaccgagagtgttcttctactttgtattcatgtctaaaaaaaagaggggacgggcccggcaccgtggctcacacctataattc

SEQ ID NO: 562705 - DNA, 392 bp, Homo sapiens
gggcacttcgtggacatggtgttggtgctgctggtggtactggtgccgtggacgcgcatcaacctgatcgacttctatgcaatccataagggcaagtacgacatcggttcgatctttcgcgtcgatggcgggatttacgggcggtacaaccctcaggcgctggtggcctatgcggtggggattgtcgtgcagattccgtttatgaatacgccgctgtatgtcgggccgatttcggacacatcaacggggcggatttgtcgtggttggtggggttggtggtgacgtcgccgttgtaattccggttggccaattcgggacagtgcgtataagcgccggttggagggggggaagttggtgggtggggtttaatagagcccggctcagtgtcgacg

SEQ ID NO: 562706 - DNA, 441 bp, Homo sapiens
atagtaggggttacaggtgtgagccactgcaccagccagggagggagggtattaaaggctcagttcattctttctaggaaaccttccctgcagatgtcccagcctgctcactctagccatggaagaagcctttatactgaaaaaagtgacagagccctggaaagctggggacccacagacagatgcagttaacattaagatggaatgggactgggagggtcttactgcagatgaaattgttactgttttgaggcagtttctagactttgtaaaatgagctaaattaggtttatgtaaaaaaattgaattctaaaagagtgttgcaacagaacgaagtaccaactataagagctttaaggattgcaaagtttaaacagataaaggctttctttcttagggaggagcaaaaaagattagaaggtcagaggggaatagcaaatg

SEQ ID NO: 562707 - DNA, 837 bp, Homo sapiens
  misc_feature (249)..(249): n is a, c, g, or t
  misc_feature (376)..(376): n is a, c, g, or t
gcccacttctaggcttggttgagccgcgcaggaagagttttgctcttcttgcccaggctggagtgcaatggcatgatgttggctcaccacaacctccacttcctgggttcaagtgattctcctgcctcagcctcctgtgtagctgggattacaggcatgctccaccacgacccgactaattttgcatttttacgtagacgacgggcatttctccactgttgttcactgcttggctttcgcaactcccanacctcagcgtgactctgccccctgcctccgcctcccaacagtgctggcgacttacacggcttgctgacgcccactactgccccggccttctcttaactctacttctctgagcagcttcttgttacantacttcctgactgctttacatcctttcagctctatactgttactttagcaattatcttttccacccaaaaggtaccagctttgcccctttttaacttcttatttacgcaactttttcgtaatttggccaattgtttggacacacacgcttacgggtgcattacttttctctggctgctcctctacttccttaaggaaaacacttacctttccctggtctccttccacgcttcccccgcacagccaattgctttcccttttttctacacgcacttttcggggccttgggtcctccacttgccttcctaaggcccaaaactccctcgcaccaccggcttggccccaaaaacacaccttctctctccgagcttacaaccttctcacacttacttttccaactgtggacacacacgcgcaccaacccgggcggcaaacaccccctttaacaccgtcacacttcag

SEQ ID NO: 562708 - DNA, 1185 bp, Homo sapiens
gctaaagtgatcctgaagccaggactaagactacgtattcacgaggagacctagcaccacatctggcaccactctgagctgatcgaagcaatggactcaacggtcgacgcgtgcacgcatcaacggactcgtgatctgtgcgctgactacgcgcaacgtaaagaatcaactgtgaagcgtggcagtcactgacacgaattcagacatttcgagacatcagtcctgggctatggaccgatctcggactacacgtcacgagcaagcggctagacagtatctgctgtagcatcgagatagcagaccatagggaacaatcagcagctgacggcaacacagactcgcactgtcaccgagcatggcgatgagtatcatcgacctccaccgacctagacaactatgagacccaggactttctcatccaaggactgagtgggagggtcagggaccatactcatgctgccaagctgccacctaaggaccaatcacatctatgtttcatcatgacgacatccaggagactggcgtacaccgtacatccttcccaagaatgtgcttaagacagttcatctgcaatatctgacgcttcgggcccaaattgcagtgatacctatatggggtggagcccaccagataaacccgcaggctgaaggagatacgctgacatgtgactggtcgccgcaatggggccactcaccagagcgtgaacctgacctgcccacctgaccaaaatgactacatcaaaggcacattggaacccttaaggatggaatcacacatcagaccaatgagtcaccgccgctatacaacccacggatgtcacccaccaaggcgaggatcatggctgcccaccctactgggcatgagagaagaacattatgacacatgcaattacagccaggctcagataaatgaaggctaaccttaaccacatggaacaattggacactaaaaacagaaagggacacatccagggcactgagcctaaaacaaaagggatccataagatcagcagcagatgaactatagactatccgcctatcgcacaaaaaggacttatcacccagtaataatcgggagcaaagtccaaatatagccctataaatcatcacagaaaaaccaataaaaagaaacaacagtcacaacgacggttgatcgtcctaaacactgacagcagtcaccgttaat

SEQ ID NO: 562709 - DNA, 181 bp, Homo sapiens
cacagagcgcaagggtgtcacacgacttggcggaggaggaggctgtggcacctggcacgcccactatgggtgccactaagaccgcggacgagatggccttctttgacgggaagacaacgcgtggcgtttacaacttctgtgcccaggacgtgccctcggaccagaagcgggtggaccggat

SEQ ID NO: 562710 - DNA, 113 bp, Homo sapiens
aagatgtgcaactgcagccaagttaacactgagattttagtcaaccacgagaacctaggaagagatctggatgtgttcttgtagggacaccagtcatattggattagaggcac

SEQ ID NO: 562711 - DNA, 696 bp, Homo sapiens
tcccaagccaaactgtttccagcttaattaaaaatacttcccataaacaatcagggttattccaggcaggacatgggcagacaatcgttaacagttatacaacaatctttacaaactcccttcttcaatgggactaccaaaaatcaaaaacgccactataaaacccaatgaagtcttcatctgatgctctgaacagggaaagtatagagtgagggtaggacatttcacattatagcatgttggttataacaacttttcacaagccagaccctggactttccaggaatgtggaaatggaaaatgggcaagaattttatctgagaagatccacaattctaagaattgggaccccactggctcttttgagacagggtggccatactacagtgggcatcactgggaaatgcccaaattggcctggacacactggtacaccgaatgcactaaggggttcaggtcctcacacagatgtcgggggctaaagagggcagtaaaagtctaatgctgaaagaatggcaagagggagaaagaggcactataaaaccacatattggttttcctataaccacagaggctttggtggccagggtggcgccatgttgtgtccaaagtcagggaaatccctcctccggggaagccaagaggaagtctctcaaaatctagaagggaaagtgtttctcccaataaatccagcta

SEQ ID NO: 562712 - DNA, 820 bp, Homo sapiens
  misc_feature (751)..(751): n is a, c, g, or t
  misc_feature (787)..(787): n is a, c, g, or t
  misc_feature (816)..(816): n is a, c, g, or t
actgtgttatgggagtagagtacttttgtccttcatcttacctcagagttagctgatcagggacaggggatatcacatctggagccaagatgtgcaggaccaccaggacagcgccattttctgtttgcaccacacaaagtcagcctgagtgtctcctccgtggatcactatgagggcatcattactcagcatctttgagtaatgagacatttgaggatgtcatgtgcagactggggtcagtctgacaaggtctaattctgctcccatttcagaggaagataagtgactcatgcagggtttgttcctcccctcacagaaagaatctccttggtttgtacccagataagaattgctccagttttctggttctttggtgaaaaatgaggaatctggagactcaaactgatcaataagctaattgcttctatttcatatgatcattagaaaaagacataaagcagtcatggtccctaccatcaaggaacttgcagtctagagcacatgaataaatgattgaattcagcatcgtgtgttcagtacaaagacagaaactgtatggagacttaagcttaatttgtgttacttcccttttattgttttgtgagttttaatgccaccatctgatcagctgttcattgacagaagagaaattgttgttattatttgtgttgtttttaccttgctaagaataaataattagcttctaatataattggtctagaaaaacataagggttttgggttaaattccntgttattgtgtgttataatgttataaaatagggggnattaggcctaaaatagggttaagggtacnggga

SEQ ID NO: 562713 - DNA, 963 bp, Homo sapiens
  misc_feature (2)..(2): n is a, c, g, or t
  misc_feature (90)..(90): n is a, c, g, or t
  misc_feature (106)..(106): n is a, c, g, or t
  misc_feature (146)..(146): n is a, c, g, or t
  misc_feature (154)..(154): n is a, c, g, or t
  misc_feature (157)..(157): n is a, c, g, or t
  misc_feature (160)..(160): n is a, c, g, or t
  misc_feature (177)..(177): n is a, c, g, or t
  misc_feature (212)..(212): n is a, c, g, or t
  misc_feature (228)..(228): n is a, c, g, or t
  misc_feature (241)..(241): n is a, c, g, or t
  misc_feature (247)..(248): n is a, c, g, or t
  misc_feature (262)..(262): n is a, c, g, or t
  misc_feature (282)..(282): n is a, c, g, or t
  misc_feature (309)..(310): n is a, c, g, or t
  misc_feature (316)..(316): n is a, c, g, or t
  misc_feature (323)..(323): n is a, c, g, or t
  misc_feature (347)..(347): n is a, c, g, or t
  misc_feature (369)..(369): n is a, c, g, or t
  misc_feature (393)..(393): n is a, c, g, or t
  misc_feature (396)..(396): n is a, c, g, or t
  misc_feature (415)..(415): n is a, c, g, or t
  misc_feature (428)..(428): n is a, c, g, or t
  misc_feature (431)..(431): n is a, c, g, or t
  misc_feature (437)..(437): n is a, c, g, or t
  misc_feature (439)..(439): n is a, c, g, or t
  misc_feature (446)..(446): n is a, c, g, or t
  misc_feature (455)..(455): n is a, c, g, or t
  misc_feature (460)..(460): n is a, c, g, or t
  misc_feature (479)..(479): n is a, c, g, or t
  misc_feature (516)..(516): n is a, c, g, or t
  misc_feature (556)..(556): n is a, c, g, or t
  misc_feature (564)..(565): n is a, c, g, or t
  misc_feature (594)..(594): n is a, c, g, or t
  misc_feature (597)..(597): n is a, c, g, or t
  misc_feature (615)..(615): n is a, c, g, or t
  misc_feature (643)..(643): n is a, c, g, or t
  misc_feature (680)..(680): n is a, c, g, or t
  misc_feature (685)..(685): n is a, c, g, or t
  misc_feature (719)..(719): n is a, c, g, or t
  misc_feature (732)..(732): n is a, c, g, or t
  misc_feature (840)..(840): n is a, c, g, or t
  misc_feature (894)..(894): n is a, c, g, or t
  misc_feature (925)..(925): n is a, c, g, or t
tnggcacgggtgtggggttttcaatttagtaacacaagttatttcttaaattccaaacattttctaaaatattattacagcaggagcctnggatattaaaacatanggggggaaatcattctctaaatagttaaatatatttgccnctgaaaanccngcncattttaattagggggnaattaaaatgtgtgctcaaatgcactaacaaactnggtagcggggcaactnacaactacaaatngggcanngggggccatttttncgtatgcatatatatgtttnttctctagataatccgtcttcttgaanntgctantaaaccntaaaactccagataaatgatttanagaaattgtaattcttcctacnacctagggggacatgtactattgngtntgtcttcatacagttactntttcaaatataanagncccgcncncttcganagaaaaaanttttngggtagtggttttaattgntttagtgagatgaaaagatagtaaagccctgtttgcnacttacgtgagaggggactttaaaaaatactcgctgcccnaaatgtannggggggggttgtgctgtgatattaatttnccncaataatgtttttcttgnctgttcgggagcaatttagggtttccgnggcaattttgttttcaaaatgccgatttgcgaaacanttgcnggcttcacgtttctgaatccctttaatagtttcnctgcgttgcagtntgtgagtttccttgtcgtgagcacagtcgataaataaagaaacccaggtgatcaatgttttcaatgcgatcagtaataaccatgtgctcatgaatcagataggactgnggcaaataggttccagccttgatgttaataagtaactccagtaggtttctgggnggcataacaatggaagtgttcagagggatcncatagcacttatccaggttaagatctaagtaggctgta

SEQ ID NO: 562714 - DNA, 1315 bp, Homo sapiens
cagcattccaaaacctggaacggttacgttcagcttatgccagctaattctggactgcatagaggttactatcaacatgaatgcgaagaaagcaatgtctcagattctgaaacttcaagccaagatgttgacatataatagtcccaagcatgcctggaccacctggaaaatgtaatgcaacaatcatgtacatgttgtttatagctatcgcttttatttataaggttgctccagacaggtaaatctgaaatgacatctatatatatatatatatatatagttttgtatgtttattatactccgtggacagagtgtgcgtatcctataattggagagttgtgtcattatagccattttacggaggatataaagtgagaaggtgagatacgtcatgtgacatagcctcttaaagagcaacaaagctgtagaacatgttaaattgtattcgttgtgatagagacagacagttatagggtgaacagtcacgtggtatatcaagagcaaagtcgtggctacagacacattttaagaaccacgctctttgaaagtggagtgggtgctggtcatacccgtgaatggatagatcgtgaatttcatatcaatgtgaccataatacacaaacggggtgataaaagcgtggcaataagagaataaattagtatggcggatcaatacgattaaataatattagaagcagggtgatataacaacatttatagtagagatacgctgcgctcacgatagcgactacaatactgtatttatacccaccgacgtgatagaaaaccgggatataatcacatgtggctcgccaaacaacaccacgagggatcgatggagtatcagaaacacgatgtggagaaaggaggattgggcaaacaacaacaaagtgggtgcggagaatcaaggagacattttaatacaaagcataacatagaggggtgactacccatccacctgggggagacagatatacagagcccgcggtggaacaaactttatcacgaggaaagagatagatgagggaaacagcgcggaaaagtccaccacgcagaagaacaagataatgcggggccccaagagggggatgaacagaacacagcagagatagggagagccagacagcactaatatctgaaaagatgaagggcaactaacaacgataagacggcaaaaagttcgcctataaataagaaacggaatatccatgcgtagtagagagcaacacatgcaggggcgcggagagaaagtagtccgacacaaagcaggggcacccaagaaacaggaggcgcccggcgagcagtatagcatagag

SEQ ID NO: 562715 - DNA, 783 bp, Homo sapiens
ggaagcgggggtatgccctctgccggcccactccgggctcaggcccccggacgccgagtcgcgccgccgtgtcggacgcagaccccaccgcagagtctgcagaggccgccccgccggcaggagcggcgccttccaactccggagcaaatttttcagaacataaaacaagaatatagtcgttatcagaggtggagacatttagaagtgtcttaatcagagtgaagcttgtgcttcggaaagtccacctcactcctcagcactcacagacacctagctctccaggttcctcatggatgaagacggaacagaccacatttaccctccgacaagtggcataatatgtgagcgcctcttaagaagactatgaagataaaattcgggaggagtatgagcaaatcctcaataccaaactagcagaacaatacctgaagtcttatcgtgaaattcacacatgatcagattatgcgacggtatgggacaaggccaacaagctatgtgtcatgacagctacgtcacatatctgggtaccaggtttgacctcacgagatggctgctgtacactccggccaacctggtcggatgtcacattctccagctccaacttcgccctcctgagaacactttaaagcgtttctgcaggtccatactatacaacttgaaagaccgaaaactttctggttgccacaagcatatctcactcgtctgctcatccataaacagctgtgccctactgtgatacatcttccaaacaaaacataccgagcagagttagccaacatatgc

SEQ ID NO: 562716 - DNA, 141 bp, Homo sapiens
cctaattcatgcttgacagtggcgattctgattttaatgatatatgaaattggaattctaaagatttgttttacatagataggcgttgtggatgcatgaagactagttaggaagtcattgcagaagtgcaggaaacaatga

SEQ ID NO: 562717 - DNA, 181 bp, Homo sapiens
tgatattgacaatgactagatcaacagcaggtaaaagcacgttccccgtctgacataatctcctctggtcccgctggtttgtcagtttatacctcccatgtaaggtatccagctccgcttcttccgaacaccaaagggcttgatgagggggctgggcttccagtcgtccatggtccgagcg

SEQ ID NO: 562718 - DNA, 240 bp, Homo sapiens
aggagatatcctggagtgctgtcatcgacgaggtcacatgctggacatcgagagcttctcttctcaaacgggcctggagagtgacatggcgctgctctgatcatggccaccaacctgtggcatcacgcgaatccggggcaacagctaccagagcctcacggatacccatagaactgctggaccggctgcttatcgtctccaacaacccctacagtgagaaagacacgaagcagatcctcc

SEQ ID NO: 562719 - DNA, 455 bp, Homo sapiens
  misc_feature (25)..(25): n is a, c, g, or t
actgaacatttcatgagctcatgtngccctttgacccacccatttcttaaggagagccagctgattgctgtccaggataaggagcatctcttcagccaggagggaggcctgttccctcctgagttagactttgcatgaagctcgaaagtattccctttggaacctcccattcttgttcaggtgacaccagctctgttgatggctctgcttctagggaacatttaatcaggagatgctctcaatgactaatttgtctaagtcttaggaaggaggttgaggaaagctggatttagacaagttcaatttagggagttctccttgtttgtggattaaaatatgacagattgcaaacagactactcttcaaatgtatctcaattgtgcagaagtgagctgtccaaaagtataagactaagtgataaactgtcttcccaccgtgggagttgttaatgagaa

SEQ ID NO: 562720 - DNA, 383 bp, Homo sapiens
tgcagaggtggaggaggatggggagcagaggatgcagaggatcagtaggatggggagcagaggatgcagaggtggaggaggatggggagcagaggatgcagaggtgcaggaggatggggagcagaggatgcggaggtggagcaggatggggagcagaggatgcagaggtggaggaggatggggagcagaggatgcacaggtgcaggaggatggggagcacaggatgcagaggtggaggaggaaggggagcagaggatggctgggtagaaggcctgacaagcttcagggcagcagtcgccctccttggaaatatcgttacagatgtgacaactagatttgtcttgtttaacgtcgacgcggccgcgaatttagtagtagtaggc

SEQ ID NO: 562721 - DNA, 311 bp, Homo sapiens
  misc_feature (20)..(20): n is a, c, g, or t
acttgacagggctccagaancaagtcaatactacgtcttccctgtttatagtcccccagttagactgctggtggtcttctcctattcatagtcccccaattaggctaacaatagaccaaagatatatttagttccttacatttttagaaagtaattccaaaaattccttttacacacactcctcgacttctgacgtattttttgcacttttctcccattggaagcatttttgcatgcttgccagaaaaaaaattgccataccaccaccaatgtataaatttgttttaattgtttttgagtttttttttatt

SEQ ID NO: 562722 - DNA, 362 bp, Homo sapiens
tggccttaggaaaagcagatggcactgtggcccacctttagggtagaagtgatgtaccatgtctggccgttagttggtggctggtacacctgctcctggcacacccttgcagaggtggctggttgctctttgagccagcttggccttgtccagcatgcacaagcttcagtgcaacaactgtgctacaaatggagccacagagaggaaacaagcagcaggctcagaaaccaggtgtgcgctgcctttggggctccagtccatgcctcaggggtcgtatggcactgcaggcttcttggttgccaagaggcagaccacaggacggggttgacacgcccgcgaatttagtagtagtagtatcgacc

SEQ ID NO: 562723 - DNA, 177 bp, Homo sapiens
gcaactccatcattacctcttcctaagagaggctggagagacagccacaaacattaagacatgccggtcctgaataagggaggtggtgtaagagcttgaaggaggatgaggtcctcaccggggtgccacctgtctctcggtctcatgtgcgcccttctggacggagctgctatgcgg

SEQ ID NO: 562724 - DNA, 1459 bp, Homo sapiens
  misc_feature (1)..(1): n is a, c, g, or t
  misc_feature (368)..(368): n is a, c, g, or t
nctctcttgtttaactggtttgattttgtgatatcttgtgttgttgattagtgatgttggtttgttgttgtgttagtatttgtcgtaacgagctgctgtgatgtacgagtagggaaatgttgtagtatccttgagattgaggttgcggacgtagacgatgcattgttacgtcgtgttttccatgtggtttgtggtctattgcttggtaagatgagtagttgtgttgctgcttgtacgcagttttgtcgatgttttttaaggacagttatgtatttgtgggttgcattgatctgttcgtttgtgtactttgcattgtttgttcccgcctgttgtgttgtctcctgtctcttgtgctttggtgtgatganctcgtgctacgtctgtgttggcgtgttatattgtgttctggccgctctgactaggtcgtcaccctgctgtggtggctcgtcgcgtgtgcgtgttgttgtgttgtggtcttctgcgtttgctccacttatctgatggggttcatgtttcctatattttgtaggctgtatcactcgcgatcgtatttcgtctcttgtttggctcccattgtgggtcaagtcctcactttatgcgtatctacatgcttgctctagctatggcgcagacctgctcgtgcgtggtgcgcctgtgcgatggtacctaattccttctggtgtttctgcgttgtgtggtgcatctctcaagtggggatgctcccattttgttcagcctgctatagtgtggctagtcgagtgttttctcgtggtgcctactgtgggcccggttgcgatgcgtgtcagactcttgttggggtctcgcgccgcgctctttgcgttgtggttagtgtatcttctgcgcctggggtgctcgctcatgcctggtcgaggtgttctctgtctacgccgttgcgcctctagcctgatctctttgtggtgcctcttctcttgtggcctcctcctatgagcccgctgccctatggtggtccctcggggcagcttgtcgggtctacccgtgctcgttctccacttctagcgtctccagttacgccggcactgatactggatatggatggatggtgccccctcgttctgttcttcttccgctcgacgccttatttgtgctcccatgaggggtttcacctcctggagtgggcacaggtggcggactggagggacaagaggggagagaaaaggggcgagacaccccacgtgacgagaatcttggccatgatggcacttgcacacgccagcgcatcagtgcacacttgacattccattgtcacccgcccacatctcgagccccctggatgtcccctgtcccccaccactctgcactccatggccaccccgtgccccccgtaggcagcctttttgctataagaaaatcgcagacgcagcagctgggacccctccccacctcaatgcctgcccatttaatccgccaaccagcccta

SEQ ID NO: 562725 - DNA, 173 bp, Homo sapiens
ggtgatctagaggatcgtcacactgggttcgagttcagtgtctcctgctgtgagaacaagtggatgtcctctccccggccctcctgctgaagtggcttgttgctctcagtgcccgtgcactgggctccaagactctggctcctcctgtcaggtcactgagctctgataggcct

SEQ ID NO: 562726 - DNA, 317 bp, Homo sapiens
cccgtactttgatcgcggagaataaagatgaggaaaagacaaaacatctctaaggattattctgtatagtatttgacgtttaacctatcttatttctgcaagccatatcccagcaagtatcattgggagtttcatccgttatgtggtgatactatgtccattttattctcaattagtatatattaccaatgtgctggctatatgctcaaggtccttttagagaagtgagttttgagcatctagataaacactacttgttaaagtataaacatacactcctataaaaatcatcaccctcattgctttagacgttttat

SEQ ID NO: 562727 - DNA, 198 bp, Homo sapiens
agtattgtcgtcttcgacgaaggacacatatactactagccagtaaccagccaaatgtccggtgacgatcccgtaccctctttcctagtctcatgtcgaatatctttatgtcaagggacttcctgacggtcttccttttgagaaggccatctacttacgtgcattcctcgcctgggacacggtagtcattactatgtc

SEQ ID NO: 562728 - DNA, 1271 bp, Homo sapiens
taattcacaggcccttttttttttgtctgaaacatcaaggcctttcctccccgtggcagtggcacaagggagggccaactctcctcaggaggcggccacgcctgccaccagcagcaggcccattggggtgtggcagggctcagtgggcggcaaaaacagcgcctctcagtttgccgtaacaggcgtggcaactcctcaggactccgtgggcttctcgataggactttgaccaagcaagcaacatttaaggaccacctttccccgttcgcagcttaaacccataaggctttgtgaataaccctcctgtgcgtggaatcttgcgtgtggccacgggcaggaccacacaaaatttgccagcattctttacccatgtgttcgtttcgcagggcggtttatctcccagagcctctcgctccagtggccgcccggaatttcctccggggcgggaaaaccgccttggattaaccctccggaaagagcaccaccctttttgttttgtctcaggcgcctacaaggcgccccggtttggggtcaaaaaggcggagaccgccaataagggcggttgtaaacgcttcataaggattcaagggagagggttaaattggaaaacatctccagagaaaataaaagcttttggccgggccgtgtgagaaccccttgtttaacccggtatatttcctgaaaaacactgtgggaggggggcctttacaaagaggcttcctaaactgcgcgatgcactccaagataaaccagggggggggccctcaggggtgtcccgaagattaattctcttcgagaacacaaccccacactattcccatttttttggcggcccaaaacccacacaccaggcaacccccctttaaaaatttcctctccggaaaatatttcccctagccgggcaaagtggccgcccacagcttatttacacgggagtaatacaacagacgatactcgtggcgtgactattctgacgaacaacacgcgcgattgaccacaactactattgttgcacccaataagaggacccttaatggggggaaaaaataccccacaaggttgatacacccccgttagtttcacaagggtgtaacaccttggggatgtaccccaaattagtttgcccccccaacaatcatatcctggtgatgcccccaccttgtggtgctatctttccccacaaaacaaacgggcaccgaaaatataagtgaaaaggcaagggaccaataaacaggagaactattcatttacaccaaagacgcttcagcaaa

SEQ ID NO: 562729 - DNA, 709 bp, Homo sapiens
aaccaacgtgatgtcacagtacagtttgcacgacatctacgtacaaacatagctcagtttttctggtcaccaaagcaaatatgtggttaggttcgtgtatgcagagaccatctagtaggagggccctataaggcaccctccacttatgcctgaggagatacaaaagcagaagtaattgtgcatctgtactatgggcacagagagggttgcagaggatccttgtgaaacactattaaaaagatgacgagtggggagaagtgcgaggaaagaaggaaattagtctgactggttttctggcctgcaccattgattcaatggagactggcgggaggaaatggaagactagggttggagatgggatgggtggggcaagggatggaaaggaaaaggcagacaactaatgcgttccatttataacaagtaatatatatcaaagacttaaaggagattaaagaccaatcagaataatttggcaactttaattcttaggaagatcaaagttccctccaaacctaatttgatgttttattactaaaagcaaagaccagtatggtacagtattactccagagaaattaaaggacaatccttagggcggcttcacccacattcattttatgaatggatacctcccctagctcagaatgcttagaggaggtactgctaccattacatggttccttattacattgaaaagtgctgacagttgg

SEQ ID NO: 562730 - DNA, 370 bp, Homo sapiens
  misc_feature (60)..(60): n is a, c, g, or t
atgtcgagatagggcacgacaaagcccctcggagccagtctttctgctgtcccatccccntttcctagcagagcatatgcgtgcatgcatgcgtgtgttaatagccacactcatggggaggatcaggtccttctgtcaccctccttcagagcttacacagctctgataagaaactatttgtcaaaacaaatgtcatttctgagaacacaattttacatgcaccgatggcctgtcacaatttttttttttttaaatggaacagtccaattttacttcatgagtaaatgcccattaaaatacagggccacctctatggcaacccaaggcagaaacttccataccggttaatttgaagcagtaagaaagacta

SEQ ID NO: 562731 - DNA, 949 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctgtgagtgaggccagggcccttgggccctgggagcaggaagtgagttggaggggtaagcggaggcaggcaggactcttgggtgactcctgaaaggttaagaagaagggatagaaggactgttgagtttcatgtggggaatgaatcgcttggggaaaagaggtggcttaccccggagggtgacagtgaacccttcaggatcacccttgggagtggattctgagaccctagtaatgtgagcttaaggtatggttccaatccagcttccctgtcctctctgtgcttctctttcttcatctataaaaccccgttttatagcctgggaaacatagagagaccctgtctctaca

SEQ ID NO: 562732 - DNA, 211 bp, Homo sapiens
actaacaaggcatgtcgtattgtgtttagctcatccaaaggtgttacctggtttcaatgaacctaacctcattcttgtgtcttcagtgtggctgtattagctgatccatctgtaacacaggagtgatccttggtgaggattgtatttcagaaccaccaactgctcttgacaattgttaacccgctaggctcctttggttaggtctacctgg

SEQ ID NO: 562733 - DNA, 4093 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562734 - DNA, 300 bp, Homo sapiens
ccaaagtgattacaggcatgagcacagtgtctcgcccaatagttttctgtgagtgaatataactgcatggtaaatttaatcaaagggattaaaggatttttcttcttttggaaaaaaattagggggggaatttattatatatgagatttccttccctatatgtgggtaaattgtgaaatgtagggaaggaaatgatgctctactctaaatccctatatatagagtatacgcttatatagggaaatatatctctgctgcacagcactaccacaatagcgcaatagtgttagaggcgagagc

SEQ ID NO: 562735 - DNA, 4063 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaacatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562736 - DNA, 84 bp, Homo sapiens
  misc_feature (4)..(4): n is a, c, g, or t
  misc_feature (8)..(8): n is a, c, g, or t
gggnatangcatccatgactatcacagatgaaaacaaaatagaatgtcattgggtcagttatttttccccactgaggtataaaa

SEQ ID NO: 562737 - DNA, 4199 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgagtagctgggactacagctgtgttctactatgcctggctaattatgtagaaatagggtctccccatcttgcccagcctggtcttggactcctgggctcgagcgatcctcctggctcagcctccaaaagtgctgggattacaggtgtgagccattgcgtccgactatgcttgattgtccaaggatctgatttctaggattgtggggccagtctctctccattgcctccgtcctgctgtctcttgcttctacagggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562738 - DNA, 331 bp, Homo sapiens
gagctgtggtcgctgctgtgatgtgtaggaggaagagctcacgtggatatggagggagctactctcaggctgcgtgctggggcagtgcctagggctctgatgtgtctctcacagcttgaaaagcttgacacatctgacttgtgagggactgaaatgaaggattgctttacgcttcccctttgagacttcaatagcctatggcttccctttttgcataggcacctgaatgtgcttgcgaacctgttaccataatgtgaggaggtggagagacagcccacctccgtgtctaccgggaccccagtacccatgctgacttgtgtttactccccat

SEQ ID NO: 562739 - DNA, 3368 bp, Homo sapiens
ataccttgccaggtaaatatgatgaaactcacagctgaggagcttagcaagtagctaaggccagagcttgtgtttgggtggtgtggctgggggcatggatttcaaggcaggaagacctctttatgcttgttgtccccatccctagtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562740 - DNA, 423 bp, Homo sapiens
  misc_feature (375)..(375): n is a, c, g, or t
gactctatgatgtatcccagctcgcttaagatgctcccgggaaagtcacttatgagaccaccagtttgccttgttggcttgaagctcctcagaggagggcgggaacagagtgaccgaggggcagccttgggctgacctaggacggtcagcttggtccctccgccgaacacccaaggataaccttcacggctgtctgctgattgacagaaatactcagcctcgtcttctgcctggactccactgatggtcagcgtgaccgttgtccctaacctggagccagaaaatcgctcagggatccctgagggcctctcaatgtctttatatatcaccgtcacaggggcctggccctggcctctgttggcaccaataaacatnagtggttgggcaaaacatctgcagagcaggttatcctggccgtctgtc

SEQ ID NO: 562741 - DNA, 3761 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggaaggcgggcagatcatgagggcaggagattgagaccctcctggccaacatggtgaaaccccgtctctactaaaatacaaaaaattagctgggcatggtgccactgccttccagcctggatgaaagagcgagactctgcctcagatctcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562742 - DNA, 112 bp, Homo sapiens
  misc_feature (21)..(21): n is a, c, g, or t
  misc_feature (45)..(45): n is a, c, g, or t
  misc_feature (67)..(67): n is a, c, g, or t
  misc_feature (70)..(71): n is a, c, g, or t
  misc_feature (101)..(101): n is a, c, g, or t
  misc_feature (112)..(112): n is a, c, g, or t
acccaccctccacctttaacncgaagtaacactgcaaatcgtttnatgaaaacactctcaaaactgnatnnatgtgttgataaaacagagaaaggagaaantagtagtcctn

SEQ ID NO: 562743 - DNA, 2593 bp, Homo sapiens
tactaataaaaataaatctgcctgtaaattatcttgaagtcctttacctggaacaagcactctctttttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562744 - DNA, 193 bp, Homo sapiens
cgatgtcacgacatcagtacttcattactcatttctgtatctcagctggtagcttttgtttcatatgtagtttaaaacttgtatagacctgactgcataaattttaatgttttttgataggcagtatgttaaatatattttctcaggttttcttctactatagatggtcccctttagaatagattttactgtg

SEQ ID NO: 562745 - DNA, 2979 bp, Homo sapiens
  misc_feature (2895)..(2895): n is a, c, g, or t
  misc_feature (2917)..(2917): n is a, c, g, or t
  misc_feature (2946)..(2946): n is a, c, g, or t
  misc_feature (2958)..(2958): n is a, c, g, or t
  misc_feature (2978)..(2978): n is a, c, g, or t
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctggtcttgaactcctgacctcgtgatccacctgccttggccacccaaagtgttgggattataggcatgagccaccgtgcctgggctgatgctggagcttttatgtgacatgggtgactcttaaaactgggggagggacgtaggagatgaggagttttcacncaccagccccatagggtggggntgtcaagacccctccggaagttttcgttnggcttaaggagnaggggcactttatttttttna

SEQ ID NO: 562746 - DNA, 3254 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562747 - DNA, 3207 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaaaatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 562748 - DNA, 812 bp, Homo sapiens
gactcaggactccatcttctagtcaaatcaaggcagatcatcatctcaccatccgagaacgcagaatcttcccaactgtcacactgtattgccacagtaagcctattattcccaccgatctacctgatcgtcttgtctatgctgttctgtggctgccctggaggcatggctaagtacctgtaccatctctcatcgctcaggttaacagagagactatgttcagactgcgaatgacatcacctgatcccatgagtttcgctccatgacgctgcaagtccacccatataaggtggtatttactttttttcttgtatggcactggatgtagtgtactctgtaagtattcaccgcgctacatactttaatccgctgaaaacatacgccagtagtggagaccttccggagaccatatatcagggaatagttggagtattgcgatggtagaagaagtagacttgaataaccactgcatgatggatacagtgcgctgcctcaatcccaagcataacctgtccttgtgagggttggatgcatctaacttgttgcttgccttgtcgtgtctcatgtgtaaaagctattcagttgccacggacccaagtgacgctcgctgcctatgtgcactgtcatgagatcctactctgatgttgtgatcctgggtacatgtgataactgcatgggtctttccttggaagcgcacatgtgaatgttcgtcctactagataatgacgtgagtcagccaaactgtcggctcctatctttctcaatccatttagttttctagcttgggttgaatggccctgatcacacttttg

SEQ ID NO: 562749 - DNA, 860 bp, Homo sapiens
gcggagttcggtctctgcaatgcttgtgtcgccctgggatggattcctcctcctcttcctccgcggcggcgtttgggtgcagtgtgacccgcagttgcagcagtttcagtcgacggtagagactcaaaagcagcggcttccatgcagctggtgcaccagatgactgaacttatgtggggagaagtgcatggacaagcctgggccaaagttggacgagtcgggctgaggccgtgtgatgtgaactgcgttgagcgcttcgattgatgacaagccagttcatcttgaatcgactggaacagacccagaaatccaagccagttgtctcagaaagcctttctgactgagtctcagcataaccccatttggaacacggaccggtagttcagagacactgaagatgctgtctgatgggatgattgacgacaacagctatgatgaggattggctcccatctttagttacctcttgggacatcctgtcatctgagaatgagcacagaccaatttatgtgtgtgaagcttaagggtcatatgttggcttgtatattgtaagtgctactcttgttgaccagtacttgacagcgcgactcgaaaactctatgcagaatgctattactcgtacatgggactatgctttctcaaaggccccattaacttgtttcctaataaagtttggagtagaggggacgactatatggttaaaatgtctctcaaatggagtggacggtcattttctggataccaggtggagaacccatggggtgatccacaaaaggggcaaagttatggggccagcaaattacgtgggggcccctagttcgcgtctgtctgacaggtcgtcagcaaaatctggtcacacgt

SEQ ID NO: 562750 - DNA, 463 bp, Homo sapiens
gcttccaattagaacacagaatatcattccatttatttgtgtcttctttaacttatctcatcaatattttatagttttctatgtacaagtcctttacctccttgattaaatttattcctaagtatattatttttgctgatgctattataaatgggattattgtttggatctctttgggggatagttcgttgttagtgtatagaaacgctaccacccttggtatgatgattttgtattccataacttaaccaaatttattagctctaacagctttttggtggagtctttggggtttcttttaatatacgatcatgtcatctgcagagacaatgttacttcttcttttccaatttggatgccatctatttgtcttacccaattgctctagcaaggacctccaatactatattgaatagaagtggtgagaatgggcatccttgtcttgtaccttgtgacgaatcta

SEQ ID NO: 562751 - DNA, 154 bp, Homo sapiens
cagctatgaccaccagagatcataggataccctcaaagcaaatgcttacttctactgaatctacactattgcatgtgtactctaggggcctctaaggaatacttacatgtaagtgacagctacagaccgcggcctcagctacagaccgcggcct

SEQ ID NO: 562752 - DNA, 412 bp, Homo sapiens
  misc_feature (34)..(34): n is a, c, g, or t
  misc_feature (67)..(67): n is a, c, g, or t
  misc_feature (69)..(69): n is a, c, g, or t
  misc_feature (243)..(243): n is a, c, g, or t
  misc_feature (375)..(375): n is a, c, g, or t
gtgcagtggtgccatctcggctcactgcaacctntgccttctgggttcaagtgattctcctgcctcngnctcctaagtagctgggactacaggcgcccaccaccatgcctggctaatttttgtatttttagtagagacagggttttgccatgttggccatgctggtctcaaactcctgacctcaagtgatacgcctgcctctgcttcccaaagtgctgggattacaggcatgagccactgcgnccagcctattattttcattttgaacccatctcttttattgccaaacacggcatttacttccgtgttcatgatggcatcattatcctatttcatctcaaagctggaaaccttgcagtcaatcatttaaatggntaaaaatacatttgagtacctcttgaggcaggggact

SEQ ID NO: 562753 - DNA, 742 bp, Homo sapiens
ggagagaagaggcgggagtggaccgtggttcagcccataccccgattgagcccctagccggatccgaggtgcgggctccgtcgacagccacagccccgtgcccctgcggcggcgcggcgaggcgaggcgatgggcaaggtgtcggtgctgaacgtggcggtcctggagaatccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccaagcagggagacacatgtttgtctttcagggccgacgcccccaagccatccctcatcccagagactgatgccgtgggtgtgactgtggtcctcatcacctgcacctaccattggacaggagttcatccgagtggggctactaccgtcaaacaacgaagtaccttcaaacccttgagactggcgtgagaaaacccgcccaatgcaagccaggatttcatcccaagctccaaggcggaaaccatcttgggccgtcggaaacccaccggggtgaacccggacttccaatatcaaactggggacaacaaacatggacagggctggaaggcatagaagaccaggagccctccctgggctgcggcatccaatcaactgcactcctatcaagggcttgggggctccctgggctggaatccctg

SEQ ID NO: 562754 - DNA, 844 bp, Homo sapiens
gctgatgcaggaactgtatagcacaccagcctccaggctggactccttcgtggctcagtggctagagacccacctgggagtggaaggaagaggtgctagacgctgtgcggaccgtggaggagtttctgagtgcaggagcatttccatgggtgaaagcgtgggctggaccagtgatgtgctgtggtgctgaaggtagtcaaggtgggctccttacgggaatggacacggatctacagtgagacaccagagacggtggcagctggtggcgtacatgagctgtaaccacagacttacaggaggccagcaagcatcacaaagatgtaactgaggctgatatggaaacacatgtggacaaagacaggaccatgctggacctcgggactcgaggacctgaggatggagcagagagtccccagatgctcttgaattaagcatccagaacagggggactgcgagagaccatgaaggacaacattgtgacctgcatacagagaccctggggcctaacatcttcacaaatcccagacagcccctgaggtactatgtagagcctgaatcaaggccatgaggaaggatacatggagaaatatactgaccaataccattcagacgagactggagaagaaaatatcagatgaaaacatacggccaaaactacagcctgaaagagcgctcaccatgcggccaatgcgtcgaaagcacatgtgtacccagggaacgtaactgtagaaaagccagagagtagcacacgaggagacaaattattggcagcactcattctaatagatactatgaaccaacgtaaagcaatcttatgccatggcgaactgggatcatgaagaaa

SEQ ID NO: 562755 - DNA, 291 bp, Homo sapiens
tgtcgtggctcacatctgtaatcccagctactcaggaggctgagtaggattactgctctttccaggaatttaagaccagcatgggcaacgcagtaaaattccaactctttaaaaacttttaaaaaattagccaagtgtggtggcataaacctatagtcccaacgacttaggaggctgagaggacagaattgctggagctcaggagcctgagcctgcagtgtgccatagtgacacctgtgaatatccactgtactccagcctgggcaacaacagagtaagatcccctctctt

SEQ ID NO: 562756 - DNA, 476 bp, Homo sapiens
  misc_feature (122)..(122): n is a, c, g, or t
  misc_feature (131)..(131): n is a, c, g, or t
  misc_feature (140)..(140): n is a, c, g, or t
  misc_feature (142)..(142): n is a, c, g, or t
  misc_feature (145)..(145): n is a, c, g, or t
  misc_feature (154)..(154): n is a, c, g, or t
  misc_feature (159)..(159): n is a, c, g, or t
  misc_feature (232)..(232): n is a, c, g, or t
  misc_feature (299)..(299): n is a, c, g, or t
  misc_feature (338)..(338): n is a, c, g, or t
  misc_feature (355)..(355): n is a, c, g, or t
  misc_feature (358)..(358): n is a, c, g, or t
  misc_feature (399)..(399): n is a, c, g, or t
  misc_feature (464)..(464): n is a, c, g, or t
ctgtctgtgtgacatgatgtgaacctgacagaggtgactgcagtaatctagaaagttatcacataaacttattagttgtcatccattgtaacttttcttattaaatataaacaggaagcganagactgtcnaagtgggtntnatntaaatattncagtnaccactagcttcatcagcaaaaacttctccttgcgctccaccagtgacacacatatgctctcagcatgcatcntaagctcctacccctgaataatatgttctgtagtgttaacttgagtttctgtaattatgtcactatnatacagcacattgacatatacatgaaatatcatacctanataactatgtccacttnatnactggatctaaatatcttttacacagaatacacacaatttntctagaactttcattttcctgcccagaagatatcaaacaaaatattgcttaagtgaacccttgtntgaaaattaaac

SEQ ID NO: 562757 - DNA, 1588 bp, Homo sapiens
  misc_feature (51)..(51): n is a, c, g, or t
  misc_feature (274)..(274): n is a, c, g, or t
gcctccccccccgctctcctcgtcgcgctgtgcggtcgggtgtggctgctnttttttaattatattacaactcgacgagtctgtctctttctcttggtatgttagggtactgcatctctccttcgtgtactgtattctgctctcccgttcggtggcgatgagacgtgccacggtcatagtagaccacgaccgacgccgcagttcgtgtgtcgtggttggtgttcgctcgtccgcctccctctacttgcgtggtgaggaggactacatcctcccntcggtgcgggcgggccggttgatgtgtttctatcatcgcagctctgctctcccgtgcgcgcaggtgcttttcggattgcctgcatcgtggtggtgttaccgcccggcgcgggtgtgcctgcgggtggttgtagcactcgctcgtgtgtcttctctctccacctccaccatccgtcgggttgtagtctccgatcctcctggtttattgtttgcctcctctcctttatcgttggtggcttcctccctttgttttttgctttgcgtgtgtgtgcgggcatctccacgtcttctctggtcggtcgcccctacagccttgttgttgtttgtttcttccctcctcactaaacgatgcctatcggcgtcggctgctcgggttggtgtgtcgcgcttcgtcgctcccgctcgatattttttcctcctcgccgctggtggggtttctgtcgtgctcgtgtggctgccgctaccgcatgcgctgctttctgtccttcgcccctcgcgtttcttgttgttgtctcttattttgtcgattatattactacacactacttcagtatatgccctcgtgtgcgcagtgccgtttcttgtggttgtgcagcagatggccccgcgctgtattatatctctctccgtcgcgtctctcttctgtgtggttgagcgctcgcctgtgcccgcgcgcgagagagagttttgtccctttgtgttgctctctcgcgcgcgtcgcgcgcgagtagagacgtgtgtgtctcgtcgctctatgcgtgtgttgatagagagagttgcgcccgcgctctctctctgcgctctcttctctcgctctctcgcggcgcgcgcatacagacgcgcgctcacctctctctctgtcgtctctctctatcacacaataacacaaataacatagatagtaggagggcgctctctcgctagatagttgctcgttatatagatgcgagacaagaagatatatatattagatagaataataggtatgggtgttgttttattacaccacacaaatataatagaagataatagggagtcagcccctgtgttgttgttgtgttgttgttgttgttgttgtgttgttgttgttgttgttgttgttgttgttgttggtgttggtgggttgttttgtaaatgtaaaaatgcgttatgtattgaccaggaccacttcttagaatgataccccaactccctggagtgggagtggggaaagcccttcttacacgtacacaccacctgttcttacctgtttgaattttttaatatgagccccacaattgtataatctttttttaataaaggggagaaaaatcca

SEQ ID NO: 562758 - DNA, 227 bp, Homo sapiens
  misc_feature (27)..(27): n is a, c, g, or t
  misc_feature (78)..(78): n is a, c, g, or t
  misc_feature (191)..(191): n is a, c, g, or t
cccttttttttcttaccgctccgcggngcgtcatttactagtcattcggttgttttttttttctatactttaggccgnggctggggggggtgtgggtgggggggcagggtagggggggccggggggcgctccggggggtgggcagaccctccgggggggccccgaggtcctgcccattcttattatgaggntgacctggctcccggccatgcgtcgccccctccgct

SEQ ID NO: 562759 - DNA, 450 bp, Homo sapiens
  misc_feature (254)..(254): n is a, c, g, or t
  misc_feature (284)..(284): n is a, c, g, or t
ccatgaatttggcacgatggaacgtaagacggacttagatattgcatacaaatttggactgtggtgagctgtgaaggctatgagtcctctgaagaccagtatgtactaagaggttcttggggcttggagtataatttagattatacagaatttggcctggagaaactggaggagtctgggcagcaccggtttgcctctttctctgaatattaatataagggggccttggcggattccctgaacatgagtggatnggataccatcgtggtacttcttgggatcgnctttgtagtctataagctgttcctgagtgacgggcagtattctccttcaccgtactctgagtattcttcatttttccaccgttaccagagattcaccaactcagcaggacctcctccccaggctttgtctgagttcacaggaccacaggatacttggcatggtgct

SEQ ID NO: 562760 - DNA, 237 bp, Homo sapiens
agtgctacctcacaaacaggataccaacaaatccgtacccagcctcaaaagtatatagtacataaagccatttacaagtacatagcacagttacagtcgaatcccttctcgtccccatggatgacccccctcagattggggtcccttgagcaccatcctccgtgaaatcaatatcccggagcgaggagagtagcactcttgtgcgggaggtagcactctgtttgtggaggtagcact

SEQ ID NO: 562761 - DNA, 213 bp, Homo sapiens
  misc_feature (5)..(5): n is a, c, g, or t
ccggntagagcggtctgatcctgaacaaatcattcaactcctttgactctctctgtgatgatttgtaaagtgaaaatgaaaataataacctcattccaaaggccactgtgaggatccagtgtaatgacataccagtgatttaaaatgcaaatgaaggagttcctgttgtggctcagcagttagcaaacccaactagcgtccatgaggacatgg

SEQ ID NO: 562762 - DNA, 109 bp, Homo sapiens
cgactctagaggacccctgacacacagaaaggcacacacagcacaaaatcacatacacaccctccccgcacagagacacaccattacatacacatgacacacaatcaca

SEQ ID NO: 562763 - DNA, 820 bp, Homo sapiens
agctattatagctaacatttactcatctcacttctaggaatacgtagtatatcgctgcactaacctcatatgtctccgcatactatgcctagacggaataatactatcgctgtccacttataactactctcataaacccttcaagcaaaccaactacgccgctatcagtcgcacatgattagtcgccatgattgctcagtagcataagtcgtatttgcacgacgtagctgcaactctaacggctcgggcacatacgccctgatctagtgctacaatctcacaagacactattggcactacgaagtatcggtattagtaagcactcaaaagcacttacctctcaactgacataaaaaaaccataaaatcagatcacacaaaacaaagttgactacttgaactacccgagctggacgattgacgtatgtcctataagatagagccaccaattaaatttctggaaatcgagactatcaaacacaaacctcgacccaggtccgttagactcttatatcaatgccactctgagttctccctttccgtaaccttcactttgttttatctcaaactcctacaacacttcgagagccacaagcgaaatcccttggagtgtttaagcacctttggatttgcgcctcgacaagaattcgccctttttaatgcgcgttaacttcgtaaatcactccccccccatttataatctagattctcgctcagcgcctttcgccttcacagttagcctcaaaagcattaaacccttgaaaatcgctaccccttaaaacatctccctttcctactcaaagtgcctaatgggggccaaa

SEQ ID NO: 562764 - DNA, 297 bp, Homo sapiens
gtcgactttttgttttagtgccctgtagaatagtgcttctcaaagtttaatgtgcatacacatcacctgaagatgtaaaatcagattccgattcagctgttggggcagagttgcgggggctttggtggggtggtgtcagcatttctaacaagctctgagtggaatatcaatgctgttgaactctggatcacccttagaaaagcaggcaggtgtttttttgggaattaataatgtttggaatgaataaaccagaaatcaaaaagaaaaagcaagagtaaaacatcgtcgacgcggccg

SEQ ID NO: 562765 - DNA, 823 bp, Homo sapiens
cttgagcataataaactcactcgatagtgtttatgttattaatctgaatgcgacagaacacaaaagcacaggcatgcacacacacacaaacccaaaccactaaaaactacctaaacactgacttagtacatacgctaaacacggtacatgtcgggacttctaaaccttgaactccattagccacgcttgggatgaaaggaccatctaaaatcatgctagtctaaaccatgctcttccacacagcctgtttaaaaaaccactggcgtatgaggaatatgctagacagacaatgttaaaactacattgttggctcacacttatctctctaataaataggaccattattactaccaggaaagtcttattctattttgcctgaaaatggcttaaagaaagtctcatgacgggatgggatgggctgcgcttctcactgaactctgaggccgaaatatttgccttggattctgtggattctttaaacctgtgtgctaataattcaaacaatgttgcattcattgtatacacgggttctcgtatacttttcaaacatctgcggtgtactgatccttgttaaaccatatattctggaaagggccatagcctttctacctgtgtagcctatttacacattattgtctctacccattccaccttgcgtgacaatgttcctaaccagcgttatgaggaaggggacaggagtggaccggccggagtcacacggatttgatcctgttggcaaggaaatccctttgcttagcattcagacccatttatgcacaccatttaaacaacgctaactctccgcggacctattacccccctc

SEQ ID NO: 562766 - DNA, 584 bp, Homo sapiens
catcagatctcatgagacttattcaccatcaccagaacagtatggggaaccatccccatgattcgagtatctctacctggccccggtcttgacacatggggattattacaattcaaggtgagctttgggtggggacacagccaaaccatatcaggactgaagtcacacttgtccagtttgcaaatctatttcttgttttcacaaagctgagccttccacatgaggaagccagagaaattgccccacaggaggtcactgccttctcctgttggccagaactggaccagagctgcagtacctacagggccccacctcaggccggttctcagagtctccggaatggcctggaaatgccgactctcacactgtgtctctaaacgggctctggagtcagtgagccttggtttaaatcccctatgcactctgtaactggctgtgttaagagacactatctcttaacctcactgtgcctcagcttcctcatctgaaaatggggacaataatagtgcctgactcgggtattagtgaggactgaaaatggtgcaacatcagtgtttaataaatgttagatctcattatctgta

SEQ ID NO: 562767 - DNA, 1322 bp, Homo sapiens
ggatcctccgctctgtgggaggcagcgctggcggcggggctggggccacatgaggaaatccatccgcgccgccggcgacgccgccgccgccgccgacgcctccgccgcggaggaagacagcgccgaccgagacaccgccagcagaccccgaccgcagagatcccaccgccacaggcctcggagccagacggccaggagcatgttttcccaaggagaggagaggataaaaacgaggcaagaagaaagaaaaaaaaagagacaacgaaaagagaacataaagaacaagcaaaataagcaataccagaacgatcgttatcacaagacaggcgaaataaataatacaaccacaaaatacaataaaaacacagatatcaaaaaacataataacaacaaagacaccatcaataaccaaacagccgagacacgacaagacgcagaaacgaaagagagagacacacagcaagagaagagagcccgcacacggcagaagacgcaaacacagacgaaagcaggcggaaaacaaagacaaaaagagaacacccgcagacgatcaggaacaagcaagagaccaaagagagagcccgaggccggaagaagagcgaaaagaggaaaagagcagcgacgagcatggagagcaaagaggagcccaccgacaccggcgaagaagcagaaagaaagcaagaccaacgaaccagagcagacaaagcaagaaggagaagacgacaagaaaacggcgacaagaacacacacgagaaggacacccacagaagagcagacgcaacacgagagaaaggcggacagacaacagacacaaagacacagaaaggaaagagccacggcaaacaagcagcaaaggccggcgcacccgcagacacagagagcgcacagggaccgccacagggaaacgccacaagcccgggacgacaagagcgcagccgacaagacggacaccgcacgcgcaaccgcgccaaccacagacaaacaaccaagaacaacaaaagaagaaaaacgaaagcaaacaagagcagacaaaacaaaaagcaacaaaacgaggagaagagaaaagaacagacagagaaaaacaaccacaccaaaaccaccaccaaacgcacacagagaccaaagacaaaaaaaacaagaacaacaggaaagaagcgaaaagaaaccagaccaacaagacgacgacgaacacacaacacacgacacatagccagccacaaacagaaagagaagccgagaagggcgaaaacacagaagaagaagacagaaaaaagcacaaacgaaaagagagaagagaaagacatacaagagacgaaacaagc

SEQ ID NO: 562768 - DNA, 673 bp, Homo sapiens
ggatcctccgagcgctgggggtgcttcctccccgctctcgcactcccactcgcgggcgggcggtgggctgtgccgccatgccccagccacaggctgctcacgggcctaggcgcggcggccgagatatggggcccctgagcctccgggggaggagagaggcagcgagccggcgctccgcccctccccccgggcgcgcgcgcgctcgcgtcccagctgcgggagaaggaggaggagcagagctccgggccggcgccgccgcccgcggaatttctgatttatttgcatccttgaagagcatctgtagaagaggaagtcacacgatgggtgtgaaaacatttactcatagctcctcttcccacagccaggaaatgcttggaaagctcaaatatgctgcgaaatgatggcacatcactgtgatatcactattcgtgtccaggacaaaatcttccgggcacatcaggtggtactaccagcttgcagtgatttctttcgcaccacacttgtacggccaagccgaggatgagaacaagaatgtgtcggatctgcatcatgttacagtgaactggcttcactacctcccccagaatatgcttacacccagccactctatcaattaacaccagaaacatatcactcgctgtctagcagccagccagcctatatgaccacatgc

SEQ ID NO: 562769 - DNA, 1524 bp, Homo sapiens
  misc_feature (1080)..(1080): n is a, c, g, or t
tgcctcggcgcctgttattttgtgcgtgtctatgtgttggcgcgtcctgttgtgtcattaatttttgcgcactgggggagtcaacacactcatattttgtccgactttccctcgcgtgtacatcgcggggggggcccccgggcggcacccctgttgtggccctctggatgttggggaaaccccgccccgcgtgtgtttctcctcggaaggtttttccgggccacgtggatacattctccgggggaccccgggggtttctccggcgcccctgttgtgatagcgggaggtcacccccgggggcccacagaagagcccccccccggaggtgctgttttcctgtgaaggggcaaataactcccggcgagggattaaacgggaagttgtgattgtcccccgcgggtcccccacacaacatgtgggggcccgcccgcattttgggtgtcccaaaaggggacctcattgtgtagagagttcgaaaagttgcccctcgtgggaagggggagaattctctatgtcgttctgtttcgtcgcccgttggcccccactttttaagggaattccagtagggatccgtgtgaagtttgtcctttccctgggggggcccctcttctttcaaaggtattgaggttttttgaaagaattttatagccccaggtgtgccaggaaacccagtacccccgtggcccgggccctcagcgcgctcatacacagggttcaaagagcccaatttttgttggtgcctatatctcgggggagacatatccacatggggcccacaccgtctgggtttttgtggttgtttataaggtgcgtccccacacaggaggggtgggcccacccccgcgcacattccctgggggcgccacacatctaaatctcttgggcaccaaagcggtgcttcccaacttcgtgtccacccgtgtggccacacaagagaggcttatactcttggggggggaaacacacacagagtttctcgttgcacaagcgcacgcacacacactggtgcgcctccttgcacaaaggtgtgaaacacaggccccgctttgcgcggtctgtctctgtgtgtctctggtaacncgcccttcaacatgccccctggcacacccaccaggggggcacactggcacattgtttctcggcacacctggtgctctataagagaagctggcgtcacatgagatggcgtggtatatccgaatgagactgcgtatacacacctcacagccccggggctgcacacatgccacaccctgggcaaacttcgccaaaggccaccctttgagatgccacatttttatagagacctatcacgctatcctgagacccccgagaccttctggaaaggagagagctgtatattcaccccaagtcctccctaatcacaggagagttcacctgagccccctcgtcacagagcccacccccgaggttctccgtgcaagcggagctccggctcccagctgtggcgtaccacacataagggtttttataaccagaaaaatataagtgaatttaagccgt

SEQ ID NO: 562770 - DNA, 290 bp, Homo sapiens
gtagaagcatctgagttcagcaattctcatgctcaacctcccaagtagctgggattacaggcaggcaccaccatgcttggctaatttttgtatttttagtagagagtggttttcaccatgttgtccaggctggtgttggactcctggcctcaagtgatctgcccacctcggcttcccaaagtgctgacaggcaagagccactgtgccctgccctctcattttttttttttagattctttctactctaaatatgagtgaatttgggcaaataaactcaggatgcttcttga

SEQ ID NO: 562771 - DNA, 762 bp, Homo sapiens
tggggaccccggggaaaaacacccccgggggggggggggggggggggggggggggcgcccccgggggggccacggggggggtttattgagagagagggagggtgttctcctcacctcttttgatgggcaaaacaaactactatcgctcgcgcccgctcgggcgggaaaaaaagatgaccgaacacagggggacgagggagacagcaaaaaaaaaaaaaaaaaaaaaagaaagaaaaacaaaacaagaggccgccaaggcataaatgacgtacagcaggcgggggggcacaccaacatgaggccccacccacgcgatactcaccacagcgagggcccaccatagtaggggggcaggcatacaaatataacaaacccagggcgagggcgagggccgggacgataaaacacaaagacgaagagagtggggaaggagacacacaccaccagaagacagagaacaactagtaaggaagagagggaagacaaaaacacaaaccaaagagaagcgggagagctagtagaacaacacaaggcgcgggacacaacgaccacccaccgcacgaaaggaagcacagcagcagcagcacccctgcggcgacagaacaccacgcacgcacccccaggaccgcgggacgaagacggagcgagaacaaccgaaccgacatagcacagacgcacggcagggaacagagaggacgacgccccaaagcaacgactacaagaaaagcagaaaagaaacaatacccgcccagaggacacaac

SEQ ID NO: 562772 - DNA, 461 bp, Homo sapiens
  misc_feature (375)..(375): n is a, c, g, or t
  misc_feature (436)..(436): n is a, c, g, or t
  misc_feature (452)..(452): n is a, c, g, or t
ttagctcttgtgaataatgctgctgtgaacatgggtatatctgagttcctgctttcaattccttggacatatacctaggagtgaaattgctaggtcatacggtattgctatatttaactttatgaggaactgccaaactgtttcccacagcagctgcaccattttgcattcctaccggcatgtatgagggttccagtttctccacatcctccctgggcacttgttatcatgtctctataattatagctaccctagtgggatgtgaagcagtatttcattgtagttctaatttggcatatttttgatgggctaatgcatatttctttcctggataatttgtttttgggtaaggaaataagccgctttttcctacgntcttccacactcctgtatggaaacagtagggggagagccaacctgccaggacatggactcnaaaagtggccagaggntgtccaccc

SEQ ID NO: 562773 - DNA, 330 bp, Homo sapiens
cgtaagatcctggctctgcttgcccaggcactggagtgcggtggcgatagactcgaggctctactacagacctccgacctcctgggtctcctgtgattctcctgcctctgccgcctgagttgctcggtgtatctgctgacgccagctcatccagctagtatctgtatgtttagtagagatagggtttcaccatgttggtcaggctggtctcgaactcctgatcctttaggcgatccacctgcctcggcctcccaaagtgctcggattacaggcgtgagccaccacgcccagcgaaacaatggtttttaaggcattggtcatcaggtagtg

SEQ ID NO: 562774 - DNA, 107 bp, Homo sapiens
  misc_feature (65)..(65): n is a, c, g, or t
gactctttaggatcccctcatcgaaaccctaaatctctcattgcgtcatcggaaaccctaacccnttttcacttcggccttcaaagttctcgtttagggtttgatga

SEQ ID NO: 562775 - DNA, 258 bp, Homo sapiens
catacggattgccgcatagatgaccagcgccccgagaaccgggacgggtatgtgagacagcacgttacggccgaacaaggcgactgctgacaccatcagcgccacggtgatcgaatacagttgcgtcttgccgccgactgcccgtgccaaactcgtgcgggatgcgctggcgctgaccggaaacgcgtggaccaggcccgcagcagcatttgcgattcccagcgcgcgcaattcgctgttcgggttgacttcctgatc

SEQ ID NO: 562776 - DNA, 425 bp, Homo sapiens
  misc_feature (118)..(118): n is a, c, g, or t
  misc_feature (249)..(249): n is a, c, g, or t
  misc_feature (265)..(265): n is a, c, g, or t
  misc_feature (285)..(285): n is a, c, g, or t
  misc_feature (326)..(326): n is a, c, g, or t
  misc_feature (355)..(355): n is a, c, g, or t
  misc_feature (357)..(357): n is a, c, g, or t
  misc_feature (371)..(371): n is a, c, g, or t
  misc_feature (373)..(373): n is a, c, g, or t
  misc_feature (386)..(386): n is a, c, g, or t
  misc_feature (412)..(412): n is a, c, g, or t
ttttaaggattaaggtaccagaggcatcagtgtataaggatggagtctggtctttaattacgccaagggtattggttacattttactctttggttttcaaaaagatttgacatgctgncaaatccagctcctcccaaattttgtttgaaggacttgtgggaagtgatattccttactattaggtcacgccccttataactacatgttaacatcccagccttttttttgtttgagtaattgtagggatanaaagtgaagcccccanagttaggtgcaagtatagcncccagctgaaaggcatcatggagtttaagggccttttacanaaggggcaatcctttgggttatttttggngnacccctgttttttntncctcggtccaacncccccttttttggacaaaaaataaancaagccccagccc

SEQ ID NO: 562777 - DNA, 1129 bp, Homo sapiens
  misc_feature (950)..(950): n is a, c, g, or t
ggtgatgcatctcttcttttttccatcgctcgtccttccgcggtattcccaactcttgtaggaagactacctctttgccccgttactatgccaaagatggaagagtgaccttccaaggcgctgggatgagtgagcgacggatgaggatgcaacacttcattgttcccgtgagtgaagctggtgtatcctgtggctggtgtcagggcggtcctgggatccgctttaagtggcattacactctttggcatcagcgaattacaggaggaaggaatgcatgaatgatggtgtggggtctcagcctgatatggtgaacaatcttttagtccctccagcagagtatggtatgcaacgagttctagtgaatgggacaagcctatcaacttcccccaagccgaatggcggcgtgtcctggaatccaaaaacgccgtatgtaattcactgtcagtgaaggacgacttgagacgagaaacggtccatccttctgtattgctcgacttgggctaatctacactttccatgaatgacccgtcggatatggcttcatagatttcccgacgaacatggctttgggccttggaagccaatcactttcgatccttgggtgtctgagaggaatccgagtgacgctgtgcttcgagcgcatggttctccaaggtggcccccacggtcccttcatggtaacctctgtggagggaccgggaggggacgcagagacgtttggagggctccatgctatacgcttccaactgattggttggtcccccagaatgttcgcgttcctgatggcgcaaaggcgtaggctttattcggtgtcgggcttcacctactttggtcccgtttggcatgtattggaacaattgcttggcgtcgtgggtgccgatgtcggtgcggccggatcttgggtaggtgccccccgcaagcgacggcgaatgtggttatcctccgggggnaggacacgtgcgcgggcccttgaggggcgaaccccctatgttggccctcccgtttcatggcgtccctttgggggagccccggtgtttccgatcccggtgtggttgtgggccgtgtagcgtgggacattgtgttgtgcgccctcggggaggcgtaatgcccatgtgggctgttgttatct

SEQ ID NO: 562778 - DNA, 1278 bp, Homo sapiens
ttttatactttagggcaacattcttatactatttaaatgaaaaaggtagataatctagtttgataaggtacaaacctcaatggcactttcgagaaaaaaagtatgtattctatataccagtaaataagcaaaatgggactctgaagccctaatacttcaaaagcgattcactcctattcccataaaaacctaggtattattcaggcaacgaggtactactacgggatttcacacacacatagcaacagcaagtctcatcttccacagtggtgagttcgttgtgctcttaacattgtgtacacacgtcacccacaggttattgtctcagttctatagacaccgcgggggattccaccatgggcgtgtgactccgaatagcaaacccacgcatataggattcttataaacagaaacaatcgttgtggccacggaaacgttcattgtgacccgtgagtacttttgtccctgcacccatatggacacagaacgctctggatctccacaaagtatcggcatcgtgacatattgtgaaacacaagggtggtgtatcgtggacgtgctctacatgtggcctttcgcacaagtggtgacattatcccgaaacaaggcaatatgataatacacaaccccgtgggggctactccattattgagagggttctttctccccacgaaaacacccgcgggcacgagacaacaggaaaccccagtgaccatcccattctcgtggaaccacaattgttgggcctttgtggagcgcacttgttgtacaaacctgtgggggccgttactgcctgggcaagaggtcttatcttccaccccgacaaatcacaaaggcgtctacctgctggatgtagggttggaaactagtgggtttctcaaaccaaggggcggacacaccttactgtacagaaatcaatttccgcccacttgttttcaaagcgcacaatgaaggtcgttcctctcaccataaagtctataaacaagggggacaccccacagatacacagaaaagagtgtttcccgccaatattaactcatcactaacgcgggaaaagccgttcctaatactcccacacgttggtgggggtttagtgtttacgacagttggggcttccagcccctgtgcctatatttccgaagggcaacccgggacacatcggccatcacttttcagcgattcaccaaggggtcgttctcccgggaacacccaagcgaagtgaacacagcgacgcagctgctcgcgggaggcaacctccaaaacactactttttaacgt

SEQ ID NO: 562779 - DNA, 1323 bp, Homo sapiens
  misc_feature (443)..(443): n is a, c, g, or t
ggttgcagctacctgcactgctacattcatcttcttgtgagccctgggcttaggagtcagcatggcaactgtaacgagttcagtcatcacggatcacaccgcacataccgaatagtatccatgctgctggaccagaacagcaacgtgtcccgtcgtggaggtcgggccgaaagagctacatccgggcgacggacaatgagagcggtactgtgttgcccccagtgacgcacgtggctgagccgctccaccaccagtgatcgacctacttgcagcacgctgagaacaaacacctgtgctcctcgaggaagtgcccaggaggactcgggatagacctagctctgaatagtacagacaagggacaaggctcccagagcatgtcagaccacccgcctggaacccctacggaaggattcccgtgcctggggcgcccatggagacccctntaccgcaccgtaggtacaccacaagcgggaagggatagactggcaaagaaggggtaaccattcaagccacgcgacgccgtgtccacgggatagagcctcctacgtcagcccccaaagcgaagcatgacggcgcattcaccagtacctaggaacggcgctggcgtaggccgtctggaccccaactggccgaggactacatagggcaatgtggcacgcaccgacacaggggtgccgctgcgcgcaccgcgcacgtgcatgcgcccgtgaagaccgtctgccaccgcgcacgcgtggagaaccccagagcccacaccgcgtcggacaaaatctgccgcaccaggtccgcgccgccacgcgtgcccggcccgtgccgcatgccggcacgcgtccactgaccacagcgcccgcccccccctgtcccactccaggaggctgatgcctagacccacgccaggtccgtcaccgaagcccagacggcctacacacgcgagggcagcacccgccgcaacgagcgcaacctccggtcgcgggctaacacccatagcggcgaacccggcagctcgacacagggacaacccacgcggggcaggcacccacggcgcggaacaaagcccacaggtgggcgcctcgagtcctgcgaccaccaccacccaaccaagccgacgcggcgcgtttcaccctctcccacacccaaacgcgggcacatcgccccgtcagccggacggaacacggcatcacactccgagcacaccgccccacgggccctcgagtcacgaccgccaccgcggccccgaccgcctataacccggccgacacacacgcaccaagcggaccaaagagccaaaccactaccccggctcctacagcgcagccttaacct

SEQ ID NO: 562780 - DNA, 380 bp, Homo sapiens
  misc_feature (39)..(39): n is a, c, g, or t
  misc_feature (53)..(53): n is a, c, g, or t
  misc_feature (121)..(121): n is a, c, g, or t
  misc_feature (329)..(329): n is a, c, g, or t
caagcaagggtgggtaaatccatgttctaaccatcgccntctggtaatgaatngctaagggcacacgagggaggccaaatgtaatgttactaagatgctaagactttctggcccggcacantggttcatgcctgtatcctagcactttggtaggccaaggcaggcagatcacttggggtcaggagttcaagactgccctgggcaacgtggtgaaaccctgtctctactaaaaatacaaaaattagccagacatagtggtgcgtgcttatagtcccagctactcaggaggctgaggcaggagaatcacttgaacctgggaggcaattagnccaagattgtgccactgcactccagcctgggtgacagaaagaccctgtctc

SEQ ID NO: 562781 - DNA, 798 bp, Homo sapiens
ggtctacttttttcaaggggaaacaatactgggagtaccaagttccagcaccaagcccattcatgagggatctgaaggcagctccctgtcgtctgtgtttgaacacacttggcccatgatgcagcgggacaaactgggaggacatctttcgagacttttctttctggggccagaaccatctgcctggtacccagacagcccccagttcattacccgggactggcacggtgtgcccagggcaaatggacgcaaccactggctggccggcatttacatctcaggcatggcaccccgcccctccttggccacagaaatccaaggttttggcattctgcaaccccgctcaatggcttatcccgtttaccagcgatggccaccacgccggtggccgcacaccacgtactcccgccggccatttccgcgccacatgtggctgtccttgtttctccacgtgacggaggacgcacacttgggaggcccacacacctattgagtgactaccacggattggactggcttgtgcctgccaccctgtgaaacccactcccgagtgttttctttctttctctggagacaacagtactaccgaatcacattttcgcacacggcgagtggacactgtggaccctccctacccacgcttcatcgctcagtactggctgggctgcccagctcctggcacatctgtaggagtcagagcccacatggccgggccactctgtagctccctcctcccatttccttcccccagccccattaaggtcccttagcccacgataaaagaaaaaaaaaatccta

SEQ ID NO: 562782 - DNA, 180 bp, Homo sapiens
ccttgggaaactgattctaccaatatcttatatagagattaatgtatcaggcatttttttgcaaaacgatatatacattcctcttatttattaaatccctggctttggtgttatgtaaagatatttgtagatctcagaacagaattcaatcactgtgaaaattacagcttaaaaaaaaaa

SEQ ID NO: 562783 - DNA, 358 bp, Homo sapiens
  misc_feature (4)..(4): n is a, c, g, or t
  misc_feature (22)..(22): n is a, c, g, or t
tttntcaagttttacaataatntttgacacattgaagctgtgcatgtttatgggggcacaatttgatgtttcaatacatgtatatgttgtgtaatgagcaaatcggagtacttagcatatctatcatctcgtgcatttatcatttctttgtggcgagaacatttaaaaatcctattttctagctattttgtaatatacactaccttactgttgcgaaccatagtcaccctactgtgcaatagaacacctgaacttattcctcctatctagttgtaactttgtacccattgaccccccttcccttccttccactctcccctccccagtctctggtaaccactgttctgttccctatgag

SEQ ID NO: 562784 - DNA, 102 bp, Homo sapiens
tatgtcttatttctaacataagacatttaccagaaatgatccacgttaagttattgcttatgctatgtatgtacctatgaccccgtgaagttttgctatgtg

SEQ ID NO: 562785 - DNA, 244 bp, Homo sapiens
ctacccacacgcctgggttactcaggtctggcctgggcggatgtgtcgagtgaccattaaaaaaaaaaaaacatcacaagtctgtggattgaggcaccaacatgtccattgtaacccttggctgggccccgatatgcctgcatagcttctcgttgcccacaggaaaccttagatctccctcggatggcatcagtagcctcccttacagacagtgcacgccccattgtgaagcgggggaccctct

SEQ ID NO: 562786 - DNA, 833 bp, Homo sapiens
taatccacggaccatccctcctgccgtaacccagcttttcccccaaattatcagttatataggccgatagttaattgtgtaacctcggcgcgcaactaagaggatagtagccgcaagggatatagatgttgcagaggtatagcccaaggcattattatagcaaagggacgtataccccgttagtaccctgttgtgcagtaatggattcaccttgcgagaataaacattttgcaaaggagagcctaaagccttttgacccccccgtgtacccactacgagctacccctaagaacaagctcaaaggagcacacacccgttctattgtagcgaaatagtgggggaagagtttattagggtagaggcgacatacctaccgtagcctggtgatatgctggttgtccaagatagaatcttaggggtcacatttaaatttgcccacaggaccctcctaatccccttgtaaatttaactggtagtccaaagaggacagcttctttggacactaggaaaaaccttgtagagagagtaaaaaatttacacccatagtaggcctaaaagcagccaccaattaaggaagcgttcaagctcacacccactaccttatatcccaacatattactgaactcctcacacccaattggaccaatctatcaccctatagaagaactaatgttagtataagtacatgaaacattctcctccgcataagcctgcgtcagattaaacactgaactgacaactaacagcccaatatctacaatcaaccataacggtcagtattaccctcacttcccacagtggtgtgctgggtcgtgttgtgggcgcggcgctgg

SEQ ID NO: 562787 - DNA, 198 bp, Homo sapiens
gagctcggtcctgctgtcgtgcggatcgcggcggacacggtgtgcgctacgaactgatggaccgcatccgtccgtggagcctgtttcacagcgccatcgagcgaaagctggagcagcgcgccttcgaggagggcaggccgaacccggtccgtttcatccccaccggcttccagcagtcgccgcgcctgttgtgcgacg

SEQ ID NO: 562788 - DNA, 244 bp, Homo sapiens
cggtttttggggcccccccccctttttttccccccgggggggggggcgggggggggggaaggggggccctttcccccccccccctgggggggggggtttttcggccccccctgggggcctataccggggggggggggcccccttttttgggggggggggcccccccttttccccccccccccccccccgcgggggggggggtgggtgggggggggggcttttttaatttttggtttccctttta

SEQ ID NO: 562789 - DNA, 157 bp, Homo sapiens
tcggtgtagacagaggactgggttatctgtatcagcatcctcgagcctgtgtctctcattgggagggttggattttgtcgttatggatggaactactctaggaaattgcccttatggatagtccaactagtgtgcgggatgactaactgcccctgcc

SEQ ID NO: 562790 - DNA, 938 bp, Homo sapiens
  misc_feature (5)..(5): n is a, c, g, or t
acccncacagctgtagtgacaatgaaagcacagaagggagagaggtagcctgtcctctgctggttctctaataactgttgggtggtcactttttccagaaatttgtctcgtcatgagtattcccccactaagcacactgtttcggacaatctcgttggccccccgtgttttgacccgaacgctggggacccaccatgtacattggggcccactcttccccgaactttttgtgcgtatcacacatgagggcaccacctttgtttcacattgcggtgcctctcttaccaggcgtgtgggcgtggccttctctcgtttttttgggctgagggcggggcgtacctttttggccggtgaacccgccactccacaatttttggctgctgttaaagacgcccacccctagcttttgtggccgggtgagcactcctcccgacagtgctaacgctgggtgcttcgggacgatgtaggcagcccacggtggttgcttttgtgtatcgattccggttcggcgatacattaggttgcaatgcccctgcctgatcaccgcaggctcccctggactgtgttgctttcaagcgacccccgcgcttttggcctcccgtaggagtctaccgcgcgcgttactttccccaaggaccgcaccgaggatgcgtgatccccacagtgtgtgtggaaaacattgggcaggtgcacaacttttttgcaatatatgtgaccggcaaagagacccgtgttatcattgctggatatctgttcgaaacaatctccgctctttggacgccaccaggttctcccgccggtattttgccgcccccacacgtgcatggatcgtagagtaaaaatggtagtgctccgcgggatgatagcgacatgactcacacccccgagtttagggacccctggacaggtaacaaaaaactcccccccccgaacaaaca

SEQ ID NO: 562791 - DNA, 1246 bp, Homo sapiens
ggccatctggcatcgatcactgtggagggcaggcgaaggtggctctgatggtccatggaccacatccgaggtgttggctaagctctaacctcgtggacctggctggtcacgtccgagagagcagaacaaggcaggtccccaacacatgcgggagtgtggctagccgagaccaatccgtcgtggtaggcagagtggaggtggcgagtaggaggcagtggatggtgcgttgctgggtggcagcagtaggccatatttgcaatggctctcccataaaatctaagctactcaattgatcttggccctgaggcgaacgtcgattgcttggccctgtgccgccagcaacaaggtgaagcagccctcgactacttcgccgtatcacaaggcgcacttcgccaaaaggcagtggacgcactgagcattgggcgtccccaagtggaactaccacgttggtgtggcgggggaacattgcacgagacgtagcacaagtacgaatcgtgataggactccactagaattggggggcacaagtctttcgtccaacctaaggcgtatcgaattgcacgcaaggctggtcctttcacaacaactttgggctgacttttttggacacctaaagacggtaagtcgctaaaggcataacgatattccatagggacaccagtaagtccgccacgcgtgggttgaacatccgaaggggaccgcccaaatgggaatccacacacatggtatcggccgcgggaaaaatcttacgaaacgacagtggaggactattgctcacaggtccaagggaaaaagggtccccccacggtcgtgtgcgcatgaaagaacggcaggcggtgcggtgaaattgaccctcgtggtgggtaaacagcctgcgcttgcgccacgtctgcaaagggggccaacaggtaccggccaaagcgacctcgagaccatcgtcgccaccaagtccacacagacggagcgcggtatgaccaggccggtcacaacatgctgacgcaccttgcgggcactaacacccacattggaagacgcgaacaccccgaagtagtgaacacgtaaggacaagcggcaccatgtagaggctgcgaccaaggcaacagaaagggcaagcggccatgtcgacacagaagaaaagagccagacaccagagcacgaggcagaaaacacggaacgcgacgaagcgcccgcgaaatacccgtggcagaagttccacgcgcgtagtaacaagaaagagcgagcgaac

SEQ ID NO: 562792 - DNA, 120 bp, Homo sapiens
gaaagagctgagatcagtcaaggttgtgtaacgggtcagaatgtagatatatgtgtacaggatatgtaccagcatcatcatttcactgggctctcatcactagtatgggctcagtactct

SEQ ID NO: 562793 - DNA, 1185 bp, Homo sapiens
gagtatggttgaagaacacatatgtccatagttacacgtgcctgtctgcgctaagtacgacgtgggagaagggagcgtggtagactatgttgctgagcattattttgaatgtatgagtggatctgactcggtagttgtgatatagaattcatatgatgagtctgaggttactaggtattgcattactggagaagggtcacgcgaacggactggctttccatgagtgctaggacaagtggaataggggttgggctattgagttaaatcctctaggaaggtctccatccattgctcatggatctgtcaggtctgggcagccaggccgccgacattgtctgcctacgtctgagtcgatttgcttacgtccaggtaggatgtgattctctcggcaatttatgatggaattccagtatgcccgtcttgttctacactctagcaggaagatgcactgtctgcgaactcgttacatttacgtatagtctgcatgtgagttgggttgtgcaccatagggtattaaaacctaacaaaggtcttatcttacttaaggacttgctggacagggaaagaggataagtatgaatcgtacgcggaggttggagataatatgacggtggacgcttgaccctttgttgacagtactattatttcacgccaatgctgaaggaaaacagaggtgaaaaaatacttatgatactgcggggggtaaggactcaaataaatataatgctttaagaaagggtactccacaaatttgtaggaagaactaccgcgtcatatatatttgagaactaaggacggggagttccccaattaggcgcgaggggtagaaaatgaaaaggggggaaagggccttgaaggtttggattaagttaagtaattacaggggacagagaaacttgaggtgtagggccacggggtttaaattttgtgggggaaacattttcggaagtaattcgacagcttcattgtgttacaagggaataatacgggatgttgagtgggggacaggggaatggctgtaagaaggtaatgtggagtggtttacagaagtggtgcttttgaatggaaagttaatgatggcataaaaagtggtggtggaaatatattgctgccgttacttccaggtggttatgaatagagttttgggtatgggaaggaatagaaggtttgggagacaaatatttt

SEQ ID NO: 562794 - DNA, 128 bp, Homo sapiens
tagactctgagccacatcatagaacacacacacaatgcaatagtcaccaccaccatttggagaaagacctattgacagcagtgcgtcacaaagaccaggggacagaacgtgtagacaagggacaggat

SEQ ID NO: 562795 - DNA, 168 bp, Homo sapiens
  misc_feature (27)..(27): n is a, c, g, or t
  misc_feature (30)..(30): n is a, c, g, or t
  misc_feature (40)..(40): n is a, c, g, or t
  misc_feature (60)..(60): n is a, c, g, or t
gcgacgcggagagcacgccaataaggnccngggcacgccncgagagaacaaggaggtggngcttcctcccacccccaaaatccacacgccgcccccttatccgcaagtcgaaaactttttcgcccatacaagtcggctaagtccccgtttctttgcatcctgtatctc

SEQ ID NO: 562796 - DNA, 1235 bp, Homo sapiens
tgggtcggctaccaccaggttgctagcgcttatatcttacatgccactcgggtgaggcagccgtgcgtgcctgcgtacatcttcctcggttcagacgtcgtcgctcctcgcacgccgtgtgcgcaaagggcctcacaggagcactccgtcggcgcacagaatatcgcgtgagtggaaatcgcgtcgtcacacagtctggaccaccgtttcacagaacactgagggcgcacggcgccaggcgatgcacgggcaccgattacttgtgctgcctgagtcgcgggctcgcgtgcttgcgggcccgtgtgtgtaccgcgtgcgcccgcgcttgtggagtctggggcttgtgcgggggggcctctgggtgtgcgccgttttgttgcctctcacctggttgggggtgtttcggcgtttttgcggccgcccgggcgtggtcgcgcgcgggggttggggtcggggggctgcgctgtgtcgtctgtgtctcccttcggtctcttcggggtctcgccgggcgtgtgggtctcgcgattgcggtttctggttgcccttgctggtgcttcttgtcgttctctcgtccctcttgttcccctggtccccccttgtgtactggaggcggagcgctggtgttgggggtgcatgctcttctttgacgtctgccgctgtggtgcagggtcgcctcgggttgctacgcgcctcgttggtcgcatgtctggtgcctcggtagtgaggtgtgtctatgttgtctgttggtagcagagggggtgagtcctggagtcccgccacagtaagcgtggttctagtgcctccacggggtcctgcttcttgtttcgctggtctgtctgtgttttctttcttctttgagagctgggtctcgcgtttgttgcaccaggctggagtggagtggcgtgatcttggcttactgcagccatttgcactccaccggtctcgagcagtcctgcactcagcactccggagtagctgggactcacaggttctatcgccaccatggccgagccaaacttgttgcatgttttgtagtagtatggggtctcacagtgttgcccaggctggtctcaaaactcactgggctcaggcgatccacctgtctcagcctcccagagtgctgggattacaattgtgagccacgatcgtcacagctggaagggtcaacatcgttttacattctgcaagcacatctgcagtgtagcccgaacccttcccgctccttcgtcccgttg

SEQ ID NO: 562797 - DNA, 356 bp, Homo sapiens
  misc_feature (349)..(349): n is a, c, g, or t
cacaagtgtttttgggcttctgactcccatgacctaaaacttaccatttgaatcttgagaaagtcagataatctctaagcctcagtttcttttcccattcctttaattaaccattattgggataaaaatcccttattgtctcacaggattgatgtgaaggtaaacaaaaatcaaatgagataatgggtacaaaagtgttctgaaaaaaattcaccaaacccattcaaaggcatgtatggtgactatcatcccccaggaaagcaaagttctacccctctgagccaatttcagttttcattttccttgagtccttcttctgattggccacatgcccatagagtttgttaanttttcct

SEQ ID NO: 562798 - DNA, 339 bp, Homo sapiens
tccctaaccagcagtgtaaaagttggtctctttacaccacattccattcccacatctatcgtgtttggacttttaaattaaatgatggcattcttgaggaggaaggggggaatggcttggtggattcattggcgtatggctaatgataagcgatgttgagcattttttttcatatgtgggtgggcggttggtatatctggaaggagaatggtctattgatatccttggcccgcttttggatgtaattataattttaatttttttctggtcaatttcttcgcgacattttcttgcttgggtcattcttgaaatgcctgtaactcagcggtcggactcccg

SEQ ID NO: 562799 - DNA, 471 bp, Homo sapiens
  misc_feature (97)..(97): n is a, c, g, or t
  misc_feature (349)..(349): n is a, c, g, or t
  misc_feature (468)..(468): n is a, c, g, or t
tagccgagcttgaaccgtctcgccgatgcgaatcgaacctgcatccggcttctcctggccggtgaaaggtcttgaacagcgtcgtcttgccggcgcngttcggaccgatgacgccggacggaatcggccgcggcagccggaacgacaggttctcgatcaaaagctcgtcgccgaagcccttgttgaggccctcgacctcgatgacgacattgccgaggcgctcgctcgacgggatgacgatctgtgtgtcggtcggcttgcggttctgcgactgctcgaccaattcctcataggccttgatacgcgccttggacttggtctggcgcccttgggcgatgactggatccanctcgcgtcgcgccagatcgacttctggcgggcgttcgtctcgcggccttcctggatcaggcgcttggccttggcgtcgagatatttggtgtagttgccctcgtaggggaatgccgcggncgc

SEQ ID NO: 562800 - DNA, 1433 bp, Homo sapiens
cacctctgcgtcgttgctctcggctcgcagcccccggcgactcgcgcttagtgttgtcgtgtgtgataattgtcacgtccgagccccctcctggttctctcattgaagaccggtctcctccctctgttttttatggcccgggctgatactctttctcctaggggccagtttcccgtatgccctgttttggggccaccttgtggccgatggtgcccaaaaaaccccgggtggtatccgtctccgtatctccccggggattctgcgagcccccacggttccccggttgattttagcccctaaatctctggcgcattctacaagcgcccaccagactggggtcccccctttagccaagacagtcccccggcccttcttcagggttagaacgttgttgtgcccccgcggttgtcgtgccacaatgcgggtcccccgggaggggacaccacagttgggtccttcaaggcggattcacctcggtttcggcttgggaccccttgtcgtcccctgggttgggggccactcccaggttcccaccaaaaccctctgttgcttccgccgggaatttttctttcttattacaccggcgtgcttcccctggaaaaaggggttgggcacccacagtgtggttcttcctacccgctttgaaggtaatttttggtggaaagcccggtatattgacgtggcacagaagaagaaaaaagtggtggccaatgccccccccacgagaggggctttgtttctcccacaagttatcttcggagcttccgaaagttttgtgcgcacaaagtattgcaccacactctaaagtgggaccccaagagtggtgtctcacccactccacaagtgaagctctcttgtgtttctcgttatagggcgtggagagagagcttctgctcccacagagatatatacacactcgagaagcacacgttttaagtgagcccaattttctcttcaagccacgctcctctctctttaaggagagagggtgatacctcgtttccgagaataactcttcttggggcgctttctcgtgttctcgagaagtgtcctcgtttgccacaaagacccaagaccgcaaaggatataaggagaaataattttttgttaagggtgtccttctatttgcgaggcacaattataatctgagtgagaacactataaagcttataatcacgtgagaaaactgagatcacccttccttgcacaggcggagtctgccacattggagtcgtatttcacgttttttgggtcacaataatatgaacacaatgtgtgaaccacgaaacgtattggtatttgacatccaagctattgtcttggcaataatgtttaatgttgaataataacttgaaattcactttaaatggagaatgttaattacatcgacttcttactataaaaaattaaaagttattgtcccagtgccacca

SEQ ID NO: 562801 - DNA, 248 bp, Homo sapiens
ctcccctctttgctctctccccgttgataccattccatgcctgcatcttcggtggccctgcttgtgagcacccccctgctctgttgctggaggctcctgcccaccctctgttccaaccagcctgagtgattaggcacacgggaggcagggtcccatcactcatggaggctatgggagaaatcgttctccgtggaggtgctgcaccttgtgacccagacatagtaggactttttctcctaggacccgca

SEQ ID NO: 562802 - DNA, 946 bp, Homo sapiens
ccaggaagtgaagtgcgaccctccaccatgccgtctacactccatcggtatccatgtggtattacctactcgatgtgggggacacgtgcggggtctgatgctgtgagtgccagaaggtggctccggtgtgtgtaggtggccgtgctgggtcaggagcctgggctgtagtcgttcggctgaacagcacggcctgactgcgtcacgggcattattaatactattaaggatgtccaagagtcaccttggtttgttgaccaggtcgaggcacgtttcatgttactcccctattggacgatgataacgtcaggcgttgtgtctgattccggagaaactatcaaattcaattcagcgtgttcatgtggcgtggacgaagggtggtagtattgaccctgctggaagcgatccttgggcacttccgaggcatgtcggccgtggttgggtggggcgcacggacgacacggggtggcgattgtccccttgtgcgtgttactcagcacgtcgttggctgctattgacacatgtcaccattatgtaggatgcgttatggctgtaataataaatcgcacgaaaaccattcgagtcgcactaaattggtacacatactgcgctcaaggaagtccagttgtcggagtactccgttgtagcacacggcaaggaaatggtgcatgacccgctcggcacgtaaagacaatgaggcataattgtccgtatgcaccagggactggggaatgcgaccattgtccaagccagcgtcgctaaagtctcggtcacacccaatcggtgcggtataccgatgtgaacgccgtaggggaaggataaggtgtgcaaagcattcagcatgggataggcggacatctcgtttgttatgtgttgggccatgtatgcacgatcccggtgggaaacttgggcttgggcatctaaggggtgctcccgtggcttgtcacag

SEQ ID NO: 562803 - DNA, 311 bp, Homo sapiens
  misc_feature (83)..(83): n is a, c, g, or t
ctcggttggaatcggcagctgctcgtaggttgactcatccatgaagatgtaggtgtcgccatcctgatagaggtactgcatanggcgacgatcgacctcagccgattcaatcttgacgtcggagttgaaggtgcgatcaacgactttcccgctcagcacgtgcttgagcttggtgcgcacgacagtgttgcccttacccggcttatggtgttggaaccagatgaccgtccacagctggccgtcaaggttgagaacggtgccgttcttaatgtcattggtggaaataaccacaggtcgggccctttcggagc

SEQ ID NO: 562804 - DNA, 135 bp, Homo sapiens
tcacccctcagaggtggttgagtaccgccatggtcgtcaggcgtcaggtgactgttttcctagtgttaaaagagagttttactgacgggaggggcagtgtcctgtgtggaaggtggctgacggtgtggagggctg

SEQ ID NO: 562805 - DNA, 968 bp, Homo sapiens
ggtggcttcttggctgcttgacgaagtgtcgtgaataaacagaaaggagaccgcagaagtaaagaagtggggagtttaggtgtctgctttaggggcagagtttacatcgagaggctatgcagcagagttaggctttcctagcaactgtgcttggcagctctagtgatcttctcggacagttcaaccgtgcttcagctggatcctgatgtgcagaggatgctgctcaggaggaagcaccaatttgaaaccaaaaacgctgtatgcaggagctatacttgaagtcacgcggatgaaaacttgggcacggttccctcaagtccaagctattggtacaggcagtgatacaacccaaacgtgtacagaggacctgcaaactcacagttatgtcccgaggttcagaaccctgttattaacagctttaggggacgacaaaggggcacacatggctgcacgaacttggagcaattctcaaaacggaacacagacagtgtaaaacaaattcctggcgtgacacgttggaacgcatattaaattcttagccgaacaattctggacctaatcgctaaggaaacctttatcacactgcaattattacaagaagctaagaacactacattacagtttgggctaggtcccattggctccaggtctataacttgaggccacagaacgtactctgaaataacatcgagacaactgagcaggaatcagaccgcggacactcatacagaagatggacaaccattgaagaagagcccaaagaaaaatacaaatgctccacagcctaccgggaattgggatgaaccccactaaaaaaaacagggattgggaaaacaaccatgcgcgtaacacaatgcaaactgaaaagacgggggaacatgaggacaccaatagagtcaagaaagaagtcgcccaacaccgcggaccaaacacagacacagagcacaaagaaagagcgcacaaaaaaa

SEQ ID NO: 562806 - DNA, 1378 bp, Homo sapiens
ggcgggacctgacgaagagcgtggatgtgctcctctctccgccatggcgtgtgctcgcctccgactgatatcgagtgtaactccgataatagagtggagagttcatcttgggcaaatagatgtccaactatatgtctgcttgtcattcagaggctccttattcgatcagattattgtgaacatgtgttacacaccgaaacttgaacgctaaaataggaagctgacagtcctaatatgctgtcagtgaattgagcgaaggtcatcaagcagtacgtgcttgagtacttggggtcacttggcagagctgtggcgtcgaattcccagaagattcgatggtggatagagggaggtcacacgagtctggcacagtggatgctactttagaggaacaccattgtgctccgttggaggctcgcaatgatattgccaccaaagccaataaacgctggatgccgttggacgatcgattagagtgaacacgaaacccaagagagacgcatacagccatcatgttctgaccctggacatgccatcagcccgtaccagtcgactgtgtcaatgtctaagaggtcaatcgatatatgcaggaaaggttaacctgaaaacttacctgtatgcgtaggttgaacgataacagtagagacgggctaccaaaggacaggaccacaaggcacagcgagaaaatgcatcgcagaaagcacaacactgaaacagaccatgggcacaaggatcaatcgaacacaagagacatagtgacatcctagcagcgaaacatgaagaagcgtgggaaaaagggcacaaaacagtcagaacacgggaagcgacaacgaagatccaacgcgccagggagacacacgagagcaatccataacataaaaaaaaagaaacgacgacacacagcggaaatgacagaccacagggaaaccaaaacaaaaaaaaagcactaccgcagaggaaaacaaaccacaaggaacaaacacatgaaaagaacaaaagcatgaaaaaattaaaagcaaaacaaaaggataccacttgcgaagcgacccacatgagagagcacagatacaataggcacaaggaaaacaagggaaaagaaggaaatagaacaggaaaagagaagaaaagaaaatgagaacacaggagaaacataggaaccagataaaagagtgcagggaacacgcaaacacaagacagacaagcagaaaacagcaagcagcaagacaagcacaagaaaagcagaatacgacgaacaaacgaggaagaaagaaccacaaatgggaaaagaacacacgaaaagtgagaaccagaagcaaggaagaggaacagccgagaaaggaaaggcacaaacagaagagagaagacgacagaagaagaagac

SEQ ID NO: 562807 - DNA, 235 bp, Homo sapiens
gcactatacagtacattgttatcaactgcaatcaccgtggtatacattagctcctcagaccttattcatcttatagctgaaagcttgtaccttttactaacttctcacccatgcctaatcccctggccactacttttctatgctgtatttctatgagttcttttttttttttttaatcccactttggtgatgccatgtagcattggtctttcttgggctaagaccgctctaacgg

SEQ ID NO: 562808 - DNA, 627 bp, Homo sapiens
  misc_feature (107)..(107): n is a, c, g, or t
  misc_feature (179)..(179): n is a, c, g, or t
  misc_feature (291)..(291): n is a, c, g, or t
  misc_feature (352)..(352): n is a, c, g, or t
  misc_feature (359)..(359): n is a, c, g, or t
  misc_feature (418)..(418): n is a, c, g, or t
  misc_feature (448)..(448): n is a, c, g, or t
  misc_feature (494)..(494): n is a, c, g, or t
  misc_feature (509)..(509): n is a, c, g, or t
  misc_feature (526)..(526): n is a, c, g, or t
  misc_feature (569)..(569): n is a, c, g, or t
  misc_feature (571)..(571): n is a, c, g, or t
  misc_feature (607)..(607): n is a, c, g, or t
tacacttattatctcacaaatagaaaatggtgaaggatccaaaaatcaaccacaattggccttggaggaaacctatatttaatgttctaggaaatcctgtgaaagtnaaaaggatctctccagtttccccatcacaattatctgcttaattcctctccattctactcttgaaatatggnttatctcttagactaatataaagcagagttacattaaatctcccttggagcagttagggcagttaagcatttgggtttcaaaggaatgcagccagtaagcaaaattaacatnaaaagagaaagccagatgtcaaaatactgagtaaaatggtgctgtcaataatgaaatcagnactgcantatggagaatccccatgccaataacctcaaggtaaatttgaaaataccatggtttcagnatacaaactttcttcatcccttcatcttgnggaccctaatatttttttccttccacccacttacatccctcttttnattaaaaaggtaacnaccaaagggggaaaacnggattttttgtcaaaggtggagacttaatccaccccagcttgncntttcaaccaaggatatcattcatgacttaagctttnataatggacttcatcctttt

SEQ ID NO: 562809 - DNA, 178 bp, Homo sapiens
  misc_feature (124)..(124): n is a, c, g, or t
gacgctaggcatacttgtcttgtccagtgttagggggaacactttcaacttttgcccattcagtatgatgttggctgtgggttcgtcatacgactggctcttattattttgaggtacattccgngatgccttagttgtgagagtttttcatcatgtttgggatactggaatttttaaa

SEQ ID NO: 562810 - DNA, 482 bp, Homo sapiens
  misc_feature (39)..(39): n is a, c, g, or t
tacagtgaagtgtggtggatagtgtcaaaggtgggtttnccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatacagaccccatgc

SEQ ID NO: 562811 - DNA, 982 bp, Homo sapiens
ggaggagaggacagcatagaacctgcatgaagatggatgtgggcagtaaagaggtgctgatggagagccctgctcggactacatccgcagactccctcggggtccgaaattggcatttcccttgcttgcccagtgctatcgtgaaacggccgtttcgtaatcagtggacggtggtgagtgggtccgtcatcgtacgtggatgattgtagggagcccgtgctgcatgtggtctccaaaatggaggccaagaacacataaaggtacatggttctggagatgagcataggggcgccggaagccccagtaaaggctggagcctgaggtgagccatcgtggttacccatcttgctatcttctctcatcggctccactggtcgctcgaggtggtatgacctaatccaggtagctgctgatcgatctacaagtcctagcccctggcggcctgctggctacatgcgatgaagatagctccagaggaggcatcgcccagatcttgaggctctcattagaaaaagtccatgacttccagatggtcttgctctgtgtagggcaggtcgcgtaggtgccataacggtctaaagcgcggcacagggcagagggggggcgaggagtgcaggtgtcagacaacggcctccccggaaggggggaacccaagcgcctacacgtggaagcagtggacagtagacgacagcaccctgtcggcagggcgaagggtagccagaggctactagcatgcctaaggaacggccgtccgggtgaagcagggatccagggggaaaaagccccaaggggtacagggtagacggacccgggacaaacggggtcctttggacagcgctccggccagacgggcccatgaaggctgggttcagggcacgacaccaggagaggaacaaggccctggaggaatgggaggctggagtgagaaggacggacgaagggcagaggttgctgcccagggccgaggaagtcccgaccacaa

SEQ ID NO: 562812 - DNA, 423 bp, Homo sapiens
gctacatagagcggatcatcgctaaggcgtagggatagaggagatggtgcattctttttatttatctactttattattgtaagtattcgcaaagagacagaggattgctctgtcgcccaggctgaagtgcaggggcatgatcatgactcactgtcgccttgacctcttgggcttaagctatactcttgcctcagcctcccaagtagctgggactacaggtgtgcaccaccatgcctggctatttatttctatagagatggggtctcacatgttgcttatgctggtctcaaattcctggcctcaagcaatcctgccttggcctcccaaaatcctgggattatagatatgagtcactgtgtccagtacacttaaaatacgtgtgcacacacacacacacacatgtgagccatatgtctcaccact

SEQ ID NO: 562813 - DNA, 101 bp, Homo sapiens
gacgcttactagcctcgcaggtgtctagcctcgcgtatgtctagcctcgcaggtgtcctagcctcgcagtgtctagcctcgcagtgtctagcctcgccagt

SEQ ID NO: 562814 - DNA, 444 bp, Homo sapiens
  misc_feature (1)..(1): n is a, c, g, or t
ntctttggtccagtaggggtcactgagggttaggctctcaataagagaaacactaatctaagtgataaatgagctggattccttgtctattgtgacatctttgtatattcagtactatgttttttaaaatattagagcagaaacaaaaggcgtgaacttgtattaagaactttatgggcgaagcgcagtggctcatgcctgtaacccgaggcgggtggatatcacctgaggtcaggagttcgagaccagcctggccaacatggtgaaaccccgtctctaccaaaaatacaaaaattagcaagccatgggtgcatgcgcctgtaatcccagctactcaagaggctgaggcaggggagttgcttgaacctgggagacggaggttgcagtgagttgagactgagccactgcactccaacctgggcaacagagcaagacttcgactca

SEQ ID NO: 562815 - DNA, 511 bp, Homo sapiens
  misc_feature (10)..(10): n is a, c, g, or t
  misc_feature (217)..(217): n is a, c, g, or t
  misc_feature (298)..(298): n is a, c, g, or t
  misc_feature (339)..(339): n is a, c, g, or t
  misc_feature (347)..(349): n is a, c, g, or t
  misc_feature (351)..(351): n is a, c, g, or t
  misc_feature (362)..(362): n is a, c, g, or t
  misc_feature (366)..(366): n is a, c, g, or t
  misc_feature (378)..(378): n is a, c, g, or t
  misc_feature (380)..(380): n is a, c, g, or t
  misc_feature (384)..(386): n is a, c, g, or t
  misc_feature (395)..(397): n is a, c, g, or t
  misc_feature (425)..(425): n is a, c, g, or t
  misc_feature (428)..(428): n is a, c, g, or t
  misc_feature (434)..(434): n is a, c, g, or t
  misc_feature (455)..(455): n is a, c, g, or t
  misc_feature (494)..(494): n is a, c, g, or t
attggttaantcttcaaagaagagatcattttcaatgctatttaaactcttttcaggcaatgtatagataacataaaggaaacttttaaatttattctccaaaaccaacataatacaccaaaacctgacaatagcaagttcaacagaaaaaaaaaaattacagatcaatatgccttatggtgaaacacctttgtaaaatgttcagtacaatattaanataatgatatagcattgacaagtagggtttatttaactaagactatttcaaggttaataagttggttactttaattaaccncattaatgtgtcaaagagtaatatataatcctctcaatggntgccaaannncnttttgataaanctcngccatcattacngntaannncttggaaannnacccaaatcatggttatctatttctccnttntcctcnttcccattgatatcagacatngggacgcccaccaacaccacttttgtttaaccttgttcnagaagtacccaccactt

SEQ ID NO: 562816 - DNA, 570 bp, Homo sapiens
gggagcaggacctgtaccactgccatcgccaccgtggccagcctcctgctccgcatcggagaggtggggaagaagttctcaggcccgcatcaggcgaggaagcccaggactgtgccactgaggaggacgagccaccagcacccgaactgcatcaggacgcagccagggagcttcagtccccagctgcatggagacccctgaagccgaatagcaggcggagacacacacctcggaacagtcccacaggagagccaggtggtggtggaggggggcagtggcgagggacagggctcaccctctcgcaagctgcgtgtcgtgactgatgagacaccaaaagcacgacggtgtccgtgttctcctactcggtggtcagtaccgggctccctgctatgtgaagaccttgcagactgacacggtgctggtgggcggggaggcctgtcagccccatcgagcgcgcactcggacggacgaccgtgctgacatgcagactggtgtcatctcctttgagcacgatcctggcctccatcctgagcggagtccgtgctggtgaacttctttgagaagagagtg

SEQ ID NO: 562817 - DNA, 466 bp, Homo sapiens
gagtacaaccggcgtgggcaggagaacgcttgaacctaggaggcagaagttgcagtgagtcgagattgcaccaccgcatgctaggctgggtgccagagagagaccctgtctcaaaaaaaaaaaaaaaatctatttactcacactggtacctaatcggccttctggccaactaacttcagcaactggccggggtttccaaaccatccctctgtgacctgggccccagccgggctttctagccctgcttgtggctattctccaacgagtactggtagcccagttggtcctcctactacccttagcacataagtcttcgggctcacataagggtcgaaaagggtttggactggaactggcttgtatccaagtggcccccactttgcccctttgccctctccctctgtcccggctcccaggccatccgagctatggcagggacacagcaagaaggcctttcttatcctct

SEQ ID NO: 562818 - DNA, 413 bp, Homo sapiens
  misc_feature (31)..(31): n is a, c, g, or t
  misc_feature (86)..(86): n is a, c, g, or t
gaaaatgccatgttccattgttttaataatnccataataccatatattgagagaagtgaagagagcctattccctttccccatganactgttgtgaaaaaagtagttcctaggcccaggtatggtggctcatgccctgtattccccagtactttgggaggcccgaggtgggtggatcacttgagtcccaggagtttaagacccagcccgggcaatgtggcaaaactttgtctctcccaaaaaaatacaaaaactagcccaggtgtggtggcatgcacctgtagtcccagctacttgggaggctgaggtgggagaatcacttgagcccaggaggttgaggctgcagtgagctgtaattaagccactacactccagcctagacaacggtgagaccccgtctctctacaatacaaa

SEQ ID NO: 562819 - DNA, 851 bp, Homo sapiens
ccctcaacacccactccctcttagccaatatgtgcctatgccatactagtcttgccgcctgcgaagcagcggtgggcctagccctactagtctcaatctccaacacatatggcctagactacgtacataacctaaacctactccaatgctaaaactaatcgtcccaacgaattatattactaccactgagatgactttccaaaaaacacataatggaatcaacacaagcacccgacagcctaattattagcatcatccctctactattttttaaccgaatcaacaacaacctatgtagctgtgccccaagctttcctccgaccacctaacaacgccgctcctaatattaactacctgagatcctaccctcacaatcagtggcagccaacgccactgtatccagtgaaccactatcaacgaaaaaaattctacgctcttctatactaaagtctccctagaaatctccttagttataacattcacagccacagaactaatcatatgtatatctgctgcgaaacacaagtatcgcaactgggtatagtaccgagaggcaccagacagaacgcctgaacgcaggcaggtagtttctattgtacacacgtagtagggccgtccctactcatggagggttaacatcaaaactaggacataaaatacaatagtacacgcaagcagaagatcaagcgagcagagagttgacacctacaagctgaggaggacgtagggcaagatctagcggcagccacgggcagcaacggcacacaaggtggaaagcagatcccgaaggccccgatagggaaacagcgacaagcgtacaacggacgacggatagctcaccccacacggcg

SEQ ID NO: 562820 - DNA, 189 bp, Homo sapiens
ccgcgtacaatgtacattcctctgacagaggtgctgttgcttactcccttccctccttcttcctgcctcgaactgtggttctaatggcttgagtaccaaaaactactactatgactatgtggcaaccttgaggttagaagccacatgccaatgtatggcacttggatggagtaccacacacgaggcaat

SEQ ID NO: 562821 - DNA, 453 bp, Homo sapiens
  misc_feature (276)..(276): n is a, c, g, or t
caactagatttgggtggagagtgggagggattggtgtatgctactcttaagattcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggccatgttttgcctttttgctttttctttgggaatctacaggatcacctgtcccctcactcccaaaagtactatntatgttttgaacaacagtggaatactatatcaaaggtttggccaaccaaccacaaagctacaaaacaagcaaatcccaaatccttcaattgatagcattcattttcactaccaacaaatttattaagaaacaagtagaaaataaatcagtggtcgacttggggaccgtaatggcttc

SEQ ID NO: 562822 - DNA, 557 bp, Homo sapiens
tgaaggtgcgtggcctataatgtggtacctgccactatgagtgccagctttgacttccgagtggcaccagatgtagacatgaaggccttcgagaagcagctgcagagatggtgccaggaagcaggagagggggtcacctttgagtttgctcagaagtttacagagcctcgaatgacacccacggatgattcagatccctggtgggcagctttcagccggagcttgcaaggcaatgaacctcactctggagccagagatctttcctgctgccactgacagccgctttatccgggcggtggggatcccagctctggcttctcgcccatgaaccgcacacctgtcctgctacatgaccataatgaacggctgcatgaggatatatttctccgtggggttgacatatatacaggcctcctctctgcacttgctagtgtgcccaccctgcctagtgaaagctgaaccccagggcttccaactcttgtactctcagtcctaccactgccaaggatctgtttcccctgcccagtaataaagccagcattggatgggatgttctt

SEQ ID NO: 562823 - DNA, 799 bp, Homo sapiens
  misc_feature (2)..(2): n is a, c, g, or t
cngcacgagagaaaatcacctgagggccacagtgttccctagccctggtgtttaggggcaggattatgggtgagatttttgagtctctaagttgacccctacggctctgaagtgtatgttgagaaattcagctgttatcatcctaggtggacttgctccctcctatcctcctacttcaaatgcagaacttcaatcgtttacaaaagaagactgaatcgtataatagaacacacccttattcattggctggcttcaccaatctcatggctgaacttgtaaaaatacaatcttagccacatacctatgaaatgtatatgtgtgtgtatatatatacatgaatttgcttctgagattatggaggctgaaattcccaagatggaaggaaagctggatacccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaaaaaaaaaaa

SEQ ID NO: 562824 - DNA, 118 bp, Homo sapiens
tcggtctaccttgtttctcggctctactgtctctcgcacacccatgacgcactgctcacgaactacgggctgctctactgcttcagtgaaggacatagacaagggggtaccgacgctc

SEQ ID NO: 562825 - DNA, 733 bp, Homo sapiens
  misc_feature (2)..(2): n is a, c, g, or t
  misc_feature (647)..(647): n is a, c, g, or t
  misc_feature (653)..(653): n is a, c, g, or t
  misc_feature (684)..(684): n is a, c, g, or t
cngcacgagagaaaatcacctgagggccacagtgttccctagccctggtgtttaggggcaggattatgggtgagatttttgagtctctaagttgacccctacggctctgaagtgtatgttgagaaattcagctgttatcatcctaggtggacttgctccctcctatcctcctacttcaaatgcagaacttcaatcgtttacaaaagaagactgaatcgtataatagaacacacccttattcattggctggcttcaccaatctcatggctgaacttgtaaaaatacaatcttagccacatacctatgaaatgtatatgtgtgtgtatatatatacatgaatttgcttctgagattatggaggctgaaattcccaagatggaaggaaagctggatacccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccttgatatggtgttcactgnttctcnactgagtatatgtcctagacgtgcaaactanttataagcatatatgtcttatggtggtatgtatagacctactaaaacaa

SEQ ID NO: 562826 - DNA, 745 bp, Homo sapiens
  misc_feature (2)..(2): n is a, c, g, or t
cngcacgagagaaaatcacctgagggccacagtgttccctagccctggtgtttaggggcaggattatgggtgagatttttgagtctctaagttgacccctacggctctgaagtgtatgttgagaaattcagctgttatcatcctaggtggacttgctccctcctatcctcctacttcaaatgcagaacttcaatcgtttacaaaagaagactgaatcgtataatagaacacacccttattcattggctggcttcaccaatctcatggctgaacttgtaacatgaatttgcttctgagattatggaggctgaaattcccaagatggaaggaaagctggatacccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaaaaaaaaaaa

SEQ ID NO: 562827 - DNA, 410 bp, Homo sapiens
catgtaagaatattgatctattcctcatattatctacttatatgatagtactctattctgtcacagacactcaatacacttcatgttctggtccatcagtctaagtctagctcatccatcgctcgagtaaggggactctgccaggtcatcgtcgtacctctgtgcgttccacggtctccttcaatgatcagccaaattacgagccacctcttgcgtacttcctatctgcctcttctgccatgtgcttcgctcctttgagttggattctctggacgtccttcttgtcttcgatcttttgtggcccggttttcgataacctttatatctttctcactctcttcagcagattttacagcttcttccagcttttgcaggcctgtggccaggcgctcctgtgctcggtcctgttc

SEQ ID NO: 562828 - DNA, 933 bp, Homo sapiens
cggttctgtaaataattgcccgccggtccagaacctctgggggcaccctggcgtggcgcccttccgggacggggtgtcccaggctatgtccaaatgggccggttcgtagaagtgctcccccccctgttgaggcgctccggcgattttttgggtaatcccccgctcgggtttagactgcgcccctccgccgggtgcgtggtcgacaacggcgcttctccgcgccggttctttttttcccctccgttggcccaagcctggcccaactcccccggcataatagcgttctgaatattctgcgcccaggggcctggcccccaatattgccggggagatctttcccgactgtgtgcgagttcccgaagtcttcgcgataatttggggggccccgtcccccgggcagagtgaaccccacaacctgtgtatagcccgcgtatgtaacaacgcttctggcccgaaggactctgtaaaaaattgtggacgtatgacgcaccgcccctctttgtcgtctagtaaacaaaattggtgtgggggggaaaacaacaacacgacaccggcggcatgggggtcacacacaccacattgggggagagaagaaatgcgctctcgaatcattttagaaggtcagagcacagtccaggccactactttcacttgttcaaaaatgtttgataacgcctctccctagctcttcattggtagagcactcctatgcttgtctaatccacccctcagggggagcagatgggacaacctctcagcccactccgccgactctttgtaatagtcggttttcgtaacataaccacagaaggaggatatctatgcgtgattgttaccctgctttaaatgagaaagccacgttgtctgctccacccccggggggcaaataacaaagataaaataaaaaaaaatcccccaatttctcaaacatac

SEQ ID NO: 562829 - DNA, 762 bp, Homo sapiens
aaaataggctagtagagctgagtattcaatcgcacgaggatgcacaacctcctgccggcttgcccagggctccaggagcaggctgcctctgtccctgcccagcctcctttacccagtctcatctggtcactatcctatggactctgctgcctgaggagtggtcgcctgcagaggacatgcccctccatccctcccaagaaaactccatttgccccggcggacatacctgttaagggcccacatcctcttccctgaagccagaccgtggcattatgtctgcacgctgcatgggttcagtccctttaccatttatagtgaccatggggttgccatcattccccatgacaccacccctctgcatgaggaagtattcccctatgacccctgtactcagactatgagataccttttacctgctagctacacacaaagcctagtggtagccagggttcgggtgccctacattgtcaactagcagagacccattccccgaacctacacatccgtgatacccttgaccttacccctacctatactcaatgatcatagaacttggacatctactgccaggaccaaaccccaaggactggaacactcctcagaccatttctccattgcggcttcctggactgtagactcaggttagaggtgaacccagaacacctgaagactagacccaggatggatgggtgctgttgaatgtgaatgacgtcccgaaagtggatccttggagtgagcaatgatcagactcctttacatcca

SEQ ID NO: 562830 - DNA, 115 bp, Homo sapiens
tcacggtagcagagagtcaccggcatctgatggcagctatgactggatctcacggcacgcccgcttctccaccagcttcaccttgtacttgcgtctgaccttggctctctctcgc

SEQ ID NO: 562831 - DNA, 127 bp, Homo sapiens
atcatggatgtacctggggtacatgcgccctcatggcgaggcaggacgtaggctcatgactgtgcatttaggcatatatgtgaccaagaagaaagagagagagggaaaacactggagagcagaaagt

SEQ ID NO: 562832 - DNA, 303 bp, Homo sapiens
  misc_feature (271)..(271): n is a, c, g, or t
cacgaggcaccttaccaccagacaaccttagccaaaccatttacccaaataaagtataggccgatagaaattgaaaccttggcgcaatagatatagtaccccaaggaaagatgaaaaattataaccaagcataatatagcaagggcttacccctataaccctctgcataatgtaatttaactaggaatgactctttcgaagggagagccaaatctaagccccccgacaccaaaacgatctatctaagagcatttaagagagcacacccttnctatgtagcaaagtagtgggagatttataggt

SEQ ID NO: 562833 - DNA, 486 bp, Homo sapiens
  misc_feature (485)..(485): n is a, c, g, or t
ctgtttgttggagaacctgtgtggacaccatacaaccggccagctgaccattttgatgcccgtgtacagtacatgagttttttggaaggaacagcatagcagtgctcctcaaagagaaaactgcactgtgtgaatctcctgctgtggtaaccgaatggaaagttgctcacttttctgcttttgtatttgaacttgaggctagactagctctctttgctaggattgtgagatcagtgtcttttaaatgaaagcctctctaaaagtgagttttacatggaagccacaaaaatgtgaaaaagtgaccttaattttccctaactgtcaagacttagaggtataggagccctggattggtatgtgcattcatgcatggccaatcttcatctcccagatctttaggtgtctgttggtgtgaagctatgcctcctgcaagagggcagttataaccagcacaactaaccagatgacgtttttctcctttgccng

SEQ ID NO: 562834 - DNA, 434 bp, Homo sapiens
  misc_feature (22)..(22): n is a, c, g, or t
catcccagaggaggaggcagantggttgggcctcacgctggaggagcccattgagaagcagagacttttggaggagaaggaccctgtacccctgttcaaagatctgtgtgccggagctgatccagcagctcagcagcaggcactgtcagagccggcggtggtgcagaagagaccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccgggccagcttggcagggatccccaggaggcctgggcccccagaggctcctctcagctgggccccgacgtttgcggcagtgttcctttggtccgtgggg

SEQ ID NO: 562835 - DNA, 111 bp, Homo sapiens
ttaaaaattacgataaatatccaacattcgattgaaacatgaacttaatcccattattttattatggaattaaaataattcatatttaaagattttttatggggttgctat

SEQ ID NO: 562836 - DNA, 712 bp, Homo sapiens
gccgccgagatgatctcttagaagtccccttaactaatcctgaccttaacctatatactgatggaagttcatttgtggagaatgggatacgaaggttagtgatgtaaccatacttgaaagcaagcctcttcccccagggaccagtgcccagttagcggaactagtggcacttacccgggccttagaactgggaaagggaaaaagaataaatgtgtatacagatagcaagtatgcttatctaatcctacatgcccatgctgcaatatggaaagagagggagttcctaacctctgtaggaacccccattaaataccacaaggaaattatagagttatgcacgcaagcaaaaacacaaagaggtgggaatcttacactgacaaagccatcagaataggaaggagaggggagaacagcagcataagcagctggcagaggcagcagaaaggcacacgaaagagacaggaagtcaaagaaagagacagagaggaagagacaagaagttagagagaaagagggaccgacacagaaagtccacacgagagggtaaaaacagagaggaagagacaaaagaagaagtcaagagagagatggaagtagtaaagaaaaaacagggtacctattcctttaaaagccaggataaatttctctctaccaagccagcatatctcttagtggtcttaacccatattgctccaagtggagaatatggacc

SEQ ID NO: 562837 - DNA, 844 bp, Homo sapiens
gctagtaaaggatatgttgctctgtccagcagttctaaaaatgctgaagtaggggccaggtcactggtagttatagtatggaatgggagaagtgaaagtgcagttatagaactttccatacgttccagagtttacgtgcaagttttctagtgcttgagagagatgctttcgtaatataagacttgatgtgtggagttgtactagagttgtactgtacatctattaaagccttagattattacattacgggttggacacccataccaagtgtacactttcaatcgtgttacgacagtcatggtgacttcacaatgtactgtagttagttacattatagaatattgacttgtttctctctgtgttacctagtgtagtgtttcatgtcctacatttattagattttcagtttgctattaacaatgagaataccagtttcagcttgatagacttgtctattcagatgtcaccaatgaatttgtcaaaatacaagaaaaagtagttttgccttcataacatactcagttttgactgacatgtagtgtccctgaatattcgtatggtgcactacgtgattcatatgtccactgtgtactattccccggtacgagtgtccgtcgtgtcaagtcctgtctaagttgtccttcaaaagaccgagcatctttcatatgggtatctactaagcattacacccatgctaggtacacagaaaatggggcatgcgagaacctggccacagccacattcggcgacaccgggcgaccgaatacaccgagcacccaacacaagggtccaccggcccgaggccaccggaccgacagacagcccacaccgcacacaacaaggg

SEQ ID NO: 562838 - DNA, 507 bp, Homo sapiens
tttgtaaaatgtaagtgctgtagaaatatctttgaattcatctggccatggcactcaccagcttaaaattcttcattggctccccagtgtcctcaagattaaggcccctgaccacgtggtccttagagccctccagccataagaatccagttccctatcctcctcacccatgcacttgcccctcaatcctacattctaaagtctggccatataggcacttctcaagtagctgggcttttattgccatttaggccttttattagcaaactgttagaacagtaacatccacacagccaaaagccctcactacactcccttaggtggatgatgccaatctctatgaggagctgggcagcaggaaccattttttacccacatcatggttttcatcatcttggcaattgtgtgtgcactatatagtggcaataaataacaaatgctttggaatcaactacaatttgataaatgtttgtttaattacattaaactacaggaatgatgcagata

SEQ ID NO: 562839 - DNA, 685 bp, Homo sapiens
ggactctcacgggatgcatttctaggatccgtctggccccgtctctctcgtgtcttaaaccttgagtaactcacgaaagtatgaatggaatgcagttcgccatccagcgcgcttaccccgatctcctttaaggtcatgctgagcaagacctctagagaccctagagactcgactttagtccttccccgccatggtcacagtgggagatacggtgtcaataggggagtgtcaacggacaggaggtaggatcctgccgctcgcgtcttagtgctttctccctcaagactattccttcatgtgtgtgttgtcttgtgcagtattttacagcccctgcttgtgtgttcttgcctcttgactttgcatcgtgacacacaccagcagttttaagggtgatgtgggtatgaactaagaaggacccttggcgcgcatcactttgcactgaattcgttatcagggactgggattggctttgagctgcacaatatgttgttggtggggatgggtacggtggacttccattctcctctacaactggagttattggtcggtaatcgtaactaagagtaacctctgggagcctggaaacctgattggagcactgagggacaagggaatgaaaaggcagactcatctgtacgtttgatgaaatggactcttgtggaattaacacgtgctattcactgtg

SEQ ID NO: 562840 - DNA, 507 bp, Homo sapiens
  misc_feature (31)..(31): n is a, c, g, or t
  misc_feature (63)..(63): n is a, c, g, or t
  misc_feature (92)..(92): n is a, c, g, or t
  misc_feature (115)..(115): n is a, c, g, or t
  misc_feature (139)..(139): n is a, c, g, or t
  misc_feature (142)..(143): n is a, c, g, or t
  misc_feature (145)..(145): n is a, c, g, or t
  misc_feature (155)..(155): n is a, c, g, or t
  misc_feature (183)..(183): n is a, c, g, or t
  misc_feature (191)..(191): n is a, c, g, or t
  misc_feature (196)..(196): n is a, c, g, or t
  misc_feature (202)..(202): n is a, c, g, or t
  misc_feature (209)..(209): n is a, c, g, or t
  misc_feature (213)..(213): n is a, c, g, or t
  misc_feature (221)..(221): n is a, c, g, or t
  misc_feature (230)..(230): n is a, c, g, or t
  misc_feature (234)..(235): n is a, c, g, or t
  misc_feature (237)..(237): n is a, c, g, or t
  misc_feature (244)..(244): n is a, c, g, or t
  misc_feature (252)..(253): n is a, c, g, or t
  misc_feature (256)..(256): n is a, c, g, or t
  misc_feature (274)..(274): n is a, c, g, or t
  misc_feature (288)..(288): n is a, c, g, or t
  misc_feature (291)..(292): n is a, c, g, or t
  misc_feature (294)..(294): n is a, c, g, or t
  misc_feature (298)..(298): n is a, c, g, or t
  misc_feature (305)..(305): n is a, c, g, or t
  misc_feature (308)..(309): n is a, c, g, or t
  misc_feature (313)..(313): n is a, c, g, or t
  misc_feature (317)..(317): n is a, c, g, or t
  misc_feature (333)..(333): n is a, c, g, or t
  misc_feature (342)..(342): n is a, c, g, or t
  misc_feature (358)..(358): n is a, c, g, or t
  misc_feature (369)..(369): n is a, c, g, or t
  misc_feature (406)..(406): n is a, c, g, or t
  misc_feature (419)..(419): n is a, c, g, or t
  misc_feature (460)..(460): n is a, c, g, or t
accacaggggattggtagcagaggagcagtntgcgtgatgggtggctggaaaatagctaagangagacatcaaggtcagggattctggaganaccctcgtaacaggatccttgcngggggtgggtgagagggtttgttnaanntnaaaggtgggngatgaggaatatggtcagatagaaaggntgggaatngtttntacaantgggttngggnggagagangatggggcntagnnangcctagntggagggnnagnggcgcgagcggggcgttnggtcagggaggagngtnngncagnggggagnggnngggngggngaggcgcgaggggggncgcgggggnggcgagctgggcgcanggaagagcggnggcggaagagtggcgtggacgcggcgtgcgagggtcngtggaggcgagcnggagcgtgggggcaggggcatttgctgggcccagggtcccnatgctttggagggaggggagattgcgttctcaaagaatgaggcgtgc

SEQ ID NO: 562841 - DNA, 367 bp, Homo sapiens
tcatacaaatctgcaacctctcgttggtgccgttgatatacttgcagcccttgagcaaccaactgtctttgctcgatgaatgagctaatactgcgaccgctcttcagtcaccattaatgtgaggagcatgggcacatgcgtaggcttgccatagagttaaattgcctgtcaccaggctatgccgttcagtatgttcccaacacagaagctttattgatacaagtgagggacagatctcaggtacacatgtcgggtcagagatgcagaagggtccccaagtatctgtcctgattctagcctgtgtcagcataggattcccacggcacgtgtttactctacgtctagagctgcgtccacagtggctcac

SEQ ID NO: 562842 - DNA, 360 bp, Homo sapiens
cgcacacgatggtggggaagttgagcagctcaggatgtggccgtggtgtgcgtgtgaaataccaccaccgagaagtcatgcccttgacctagcctcatgacctcggcagtagctcatggtctcatcgatgccgggaaatgcgctcagtgtcctcctgcatcatcttcttgcccatgctcagcatgttgtcctcctcgaagaactcgtcaggcagctccgccacgcccaggggggggtcgatctccatagcatagaggttgtcatagcttttgcctgaggtaggcacctttgagaacttctggtcaaaagcatctgagatgttgtgtgctgggtctgtggagatgatcagaacactctcac

SEQ ID NO: 562843 - DNA, 612 bp, Homo sapiens
  misc_feature (594)..(594): n is a, c, g, or t
gcgaattcactagtgattagagactgcgagaaggagacacatggaatggagagctgggtccttatgtatgaattgaaggcagtgggcagcagccaagcagaaccttggagtcagcgatgggaattaggattgaagctcaaggcccaaggacagaccctggcacctggaatcatctaccacctatttaggcttgcatatcccacctgtcccaaaccctatcggtgccctgtggagctacctgtctgcaggcagacagtcccctctcctctttttccctgagcctgcactccctgcttgttccaatagcacctgcctgttgcccatggtcactgtgtggcagcagctctcacaggctgctgtggtttctctaacgcaccaaacctcagggtgtacagtaaaaaaggtgtctttgcttctcatggtgccctttagaccacctctaacatccccacctctctgaagaccgcaccatcagaacacacaaacacacacctgcagcctcctcctttggccccatcactccccctccatccacacaactctaggttcagcccctctactccttctcgcagtctcctaatcgaattccgcggncgccatggtgtgcgggag

SEQ ID NO: 562844 - DNA, 200 bp, Homo sapiens
gcatatcgccgacaggcccggtgccctttgagcgtggaatttgcaggtcatggctccctgctatcgaacaccggacacgggtcgtgtgctgcacctggcagttgcaggaccgacaccctgcaatgccttaagacggtgatgactggccttccagtgggcctggctggcagaccactttgggggtaccgacgctcgacatt

SEQ ID NO: 562845 - DNA, 407 bp, Homo sapiens
agaaataaatcctcagagcgcttatctacttatggttgcagctctgacttctgggtggggtgtgcatgcttaccttaaacgcacagcctttattgcctattttgtaggcagcccaagagtatgccttggagtatgcattgttgctacagtagcagatcaccgtgttctttgcacaccacatgcaatggtataagaagtccatgctctttggggtatgtaatataaaattcttaccggggctatgcttctgtgtaacatgtacataatagatacttaagaaatgtgctgaaaactacaatgaactggtttccccattactttcctatgggcttgtttacttaaagggacaagatagtttcttcatcctgctattgcaaatgatttcctaaggacctctttcacagtag

SEQ ID NO: 562846 - DNA, 293 bp, Homo sapiens
atggatgaactcatacaagcctgaagaattgttcaacgctgatggttcattgaaggacgaagtgaaggcacttgcacctaagggtgacaagcgtatgtctgctaacccaatcactaatggtggtcgccgtcgcggtgaagcacctaagacattggacttgtcagacctgcgctcaattcacaaacgacattactaacgaaaaccctggacatgaattgtccaaagtaacgcaaacatggacatgacaactctttcgccatactgggaggaggttacaaggtgataccccacac

SEQ ID NO: 562847 - DNA, 232 bp, Homo sapiens
actcagaaaggagggatggtaggtcggtaggtggagaataagggagacagctgagactggactcccagcacttgagaggcgtggaggtgggtgaatcagttgaggtcgggagttggagaccagcctggcctacatggtgaaaccctgtcactactaaaaatacaaaaattagctgggcgtggtagtgccacttgtatatcccaactactggggaggctgtagcgtgcagtgg

SEQ ID NO: 562848 - DNA, 864 bp, Homo sapiens
  misc_feature (134)..(134): n is a, c, g, or t
  misc_feature (302)..(303): n is a, c, g, or t
  misc_feature (318)..(318): n is a, c, g, or t
  misc_feature (339)..(339): n is a, c, g, or t
  misc_feature (403)..(403): n is a, c, g, or t
  misc_feature (424)..(424): n is a, c, g, or t
  misc_feature (436)..(436): n is a, c, g, or t
  misc_feature (439)..(439): n is a, c, g, or t
  misc_feature (459)..(459): n is a, c, g, or t
  misc_feature (462)..(462): n is a, c, g, or t
  misc_feature (490)..(490): n is a, c, g, or t
  misc_feature (501)..(502): n is a, c, g, or t
  misc_feature (561)..(561): n is a, c, g, or t
  misc_feature (574)..(575): n is a, c, g, or t
  misc_feature (585)..(586): n is a, c, g, or t
  misc_feature (596)..(596): n is a, c, g, or t
  misc_feature (598)..(599): n is a, c, g, or t
  misc_feature (616)..(616): n is a, c, g, or t
  misc_feature (620)..(620): n is a, c, g, or t
  misc_feature (637)..(637): n is a, c, g, or t
  misc_feature (665)..(666): n is a, c, g, or t
  misc_feature (674)..(674): n is a, c, g, or t
  misc_feature (690)..(690): n is a, c, g, or t
  misc_feature (697)..(697): n is a, c, g, or t
agcgggccaatgtatttctatttatttatttatccctcaacagtcctccctccaatttaatatatttcttggcagaggatagtaaatgtttccatggatggattccttggtggtggtgatggtggtttgttttntttttttttttgggggcagggtcttgctctgtcgcccgggctggagtgcagtgggcgcgatctcggctcgctgcgacctctggcctctcgggttcgagcgattctcctggcctcagcctcctgagcggctgggattgcgggttcgtgccaccacgcccggctgatttnnggtattagggtaganatgggatttcgccacgttggncacggctggtctcgagctcctggcctcaggtgatccacccgccttggcgtcccagagtgctggnattgcaggcgtgagccaccanacctggccggtngtnatatatttaatggtcttttnttncactaatgaggaccaccttgtaaatccngggcattttcnnagtttcctcttccatgtgaatggctccagctaacttaatattagttctctcaagggttngtgtagacctggnnttggtctctnnccatctgttncnnctctttccctttaacgntcanttgcctgaggtctatanggccctttaaggttgccagcccagagcnnaagagatnggtgtccctgaagttnagaaagncaccttgcctacagaatgggtgtccacacgtgttgggtgtgcaagttccaccagctttgactttgagatccaccccgggcgccctcacagacacttttcctacctttccagaatcatcagaaaggtcctatcctcagtagttgcctccctcttggcaagtgtgccac

SEQ ID NO: 562849 - DNA, 359 bp, Homo sapiens
agagaaatggggccatatctgtgagatttctatatatatgaggggagttgtcagaagttccatgtgtatgggatctttacaggtcagatcttgtgtacaggaaatttcaaaggtttgggagtggggagggaagctctaacagtgaggatcattttatcacattagactggggcagaactctgtcaggatttaagaatattttcagaacacattttagatattatttctatccatatattggaaagaataccattggcaatcttatttttttttaatgtgtgccgagtctcaccaagctcaaagaccctggttgggggtggagggtgcgcacaggggctgtataaggcaagaagactcgg

SEQ ID NO: 562850 - DNA, 432 bp, Homo sapiens
  misc_feature (425)..(425): n is a, c, g, or t
tcttttggaaactggaaatcgattttaggaatatttctgggatagaacaaaacaagtcatttggaggcagaacccagggtctaaatgacgaacctttctaccccacccaagggattcatcacagcagcctacagaatcatttattggaaactcacatcttaaaaggggtatcctcacagaatcattcatttacgcgggggaaacactcacttggagcttatgaaggttagtcacgaaaagatgttttttgcaaacacctacaatgcattatctaaagctgctaagcaccactgttctatttgcagcaggcattaaggcattatcctttgtcccatgctgtggacaaatgaatggtgcaagaagtactggctccaaattaccgtgaaggggagaaatacctttctttaaaattttattttcatttntaatttt

SEQ ID NO: 562851 - DNA, 433 bp, Homo sapiens
ttcgggcccggggtccacctgctgccccccccgtgggagaagttggcctttaccaagttggttccctttaggtgcttggcacgcggtttcagccccagggacgttttgtttccttggttccaggggtcccaggagttgccccccgaaaggtccctttcttgggcttcccggcaggggcccagccggggcccccccccttttgttgtgcccagcattttgggggtggcacccggggtttggaaaaagggggcccccttttccggcatggtgggccccggggcccttccgttggcttttccccagaagcccttggcccgtttggggggtaaccccccccctgtcattgtttttgttttctggggggggggggggggcccctgtttttgacccgcccccctgtcccccccccttatttacccccttgttcccccca

SEQ ID NO: 562852 - DNA, 890 bp, Homo sapiens
ggctgactctcttttcggactcagcccgctgcacccaggtgaaataaacagccatgttgctcacacaaagcctgttggtggttcttcacacggcacgcatgaaatttggtgccgtgactcggatcgggggaccttccttgggagatcaatcccccatcctcctgctcttttgctgtgtgagaaagatccacctatgacctcaggtcctcaagaccgaccagcccaagaatcatctcaccaatttcaaatccgctaaagactgacattgcccgatagcctcggaagccccgtagacccatcaacggatgccggggctttagtgtaaccctcacagttgaagaagcacaggaatgtcaggcctctgagcccgaagtaagcaatccatatccccttgtgactggaggtacacatccagatggccgtttcctgcctcaatgatgacattccaccaaaaagacgtgaaagtggcctgctcccgcccttaatctgatgaccattgtctttgtgaaattccttctcctggctcaattctggctcaaaaagctccccttgtgagcactttttgtgacccccctatctgccaacaagaagaaataaaccccccttttggagttgtatttttccttttaatccagccgaaattcctataaaattggggccaaccgtttattttccctttcgctgactccctttctcggacttcaagccacttggcccagggtgaattaaccagccatggtgtcaccaaaggagaagtcacaaacatctgtcgtggcgccgcccagaaaagttaaaccttggtggccggccagcgatacaacgaacgcgtcaaagcgggagacgggttcccaaaaaccggggggtgaaacagaggtggtggttaagcccga

SEQ ID NO: 562853 - DNA, 155 bp, Homo sapiens
tgacatctctacataaccacaaagacattgcaacaccataactattattctgcgcatcagctgtagtcctaggcacagctctaaacctccttattcgagccgatctgggccagccaggcgaccttctaggttacgaccacatctacaacgttatc

SEQ ID NO: 562854 - DNA, 774 bp, Homo sapiens
  misc_feature (569)..(569): n is a, c, g, or t
ggaaatagctaccgtgtgtgtcccttcctgctttccactattccttttgcctttttctcggccacgtggttagtctccaccagttgtcttctgcgacaaagtatgtgcttctagtatcatcctgatacattgtataaagaagatgcgagaatgtcatgtgacgtgctggttggcctcagaattatgctgtgagtttgacacatgatatatcagcttctccgatcaagtttatggtaccaaagctgtcatctagtagcgacatagatgtctgtaaccaataatgtagcagttctgcacttggaccacaaggtgtaactagaccattttgacatgtcagtcgacgattatggctgtactattgcttaaacaaaactggaactgatgttgaagtccactagtccaatacatttacaggcaatctgtgtactgaacatagtagatcgacgtctacttcaagattacaagatctgttacattctaagtgtgttcaggcttctgcaaggtcacacgggaccgctggatccagaagctatggaaccagcaggttgattcttgtattcctgattaanctacttgtaaacttgaaagcaagaccttgattgcggcaagaggtccagagtatgagtgcaagcaaaagcagaaattctcatgcgtgacctgagcaggacaggctgggtatttaaccaggtgcctcgtgttcgagcattaccgctgcctttaatgttaacacagtctggcagttgctaaatttgtgttcccattttaaatcgacca

SEQ ID NO: 562855 - DNA, 249 bp, Homo sapiens
  misc_feature (59)..(59): n is a, c, g, or t
  misc_feature (86)..(86): n is a, c, g, or t
  misc_feature (96)..(96): n is a, c, g, or t
  misc_feature (124)..(124): n is a, c, g, or t
  misc_feature (129)..(129): n is a, c, g, or t
  misc_feature (165)..(165): n is a, c, g, or t
  misc_feature (169)..(169): n is a, c, g, or t
  misc_feature (177)..(177): n is a, c, g, or t
  misc_feature (187)..(187): n is a, c, g, or t
  misc_feature (200)..(201): n is a, c, g, or t
  misc_feature (213)..(215): n is a, c, g, or t
  misc_feature (222)..(222): n is a, c, g, or t
  misc_feature (234)..(234): n is a, c, g, or t
  misc_feature (236)..(236): n is a, c, g, or t
aaaaaaaaggggggggggcccccccccccggggggggggttttttccccccaaaaaaangaaattttggttttggggggggggccngttttttccnaaaggggggggccccccatttttccccnaaatnaagggttttccccgggcccgggggcccccggggttngggnttgttttngggggggggnttttccccccccnntgggggtttttnnnttttttnggcccctttttnanggggggcccccca

SEQ ID NO: 562856 - DNA, 111 bp, Homo sapiens
gggtccccaagtcggcggggcttagaatctgaatggtatcattacctggatgaggggatcggggtagcggatggtgcgggcatcagtgagtcaccagatgagggattcctt

SEQ ID NO: 562857 - DNA, 383 bp, Homo sapiens
aagcacagaagaaacagaaatcacgatttagggaaggtgggtctggcctccctcatccccctcttcctccctctctgctggcatcctccacgcgcgtcgtttcctgtgaaggctccgctggcctcccataaggtcaagcaatgtggggctgctgggaacatgagctccatggtatacggcccttttcagaagggacagaatctcacgagcatctacgcagcccctccgctcctatctcacttgggggagtttctctcaaaagctcttctctcctcagagagcatttagcatttcatcaaaccatggaaatagagctggaatacacaggagttcttgagtttgctctttaggccatctgtctatcccataatcgggtggggtac

SEQ ID NO: 562858 - DNA, 234 bp, Homo sapiens
gtagggtgtttacatgtgtagcctatgttgtggtccatcagcccctcacattcctaggggttttaaatgctgtaggtggtatgtgacaccaaaaccccctctgtcatttgttgggaagtctttttttggcaaaaaccttgggtatatttgtatattacccatttggacagaattttggaagattttcagtttagttgccaaatttgggtcctttacaaaaaaaataccttgaga

SEQ ID NO: 562859 - DNA, 202 bp, Homo sapiens
tgtacctctcgtaattgatggccatcgcctaatatccttgctatgaaaaccgtagtgatcacaaccacaacaatgactagatcgaactcatgctcaaaacaaatgatagccatacacaacactaaaggacgaacctgatctcttatactagtatccataatcatttttattgccacaactgacctcctcgaacgacctaccg

SEQ ID NO: 562860 - DNA, 882 bp, Homo sapiens
  misc_feature (882)..(882): n is a, c, g, or t
tgggagcccccggaaaaattataaccagggtccacaccccaaagggggggaaaggggggccccaaactctttgcccccgcggggaaaatttggggggttcgcacccttcgggggccgttccttttaagcccccggcttattagccaaaaaatattccagcccataagtagtctatctacacagaactatagataccgtggtaggcactaaaacagggagggtcccctctggggagccatctcacctccgggaggagaagaccggcgtgattattcttctcatcacagagtatcccgggagatcactgtgtggggaggtacaaaaatctccttatccccggacgcgaggagagcattcttactagagaagagagcagtcttatgcaagacgacaacgaaaaaatatcagagaagcgagcagacatcaccgaacaataaagccctctatcaactcacccgcgcgtgtgtgggggcccacctaccccattatgtgggcggtgggggaaaccactgtggactaggaaatgtggcggcggggaacaccaagagcactgtggcgagaaccagagataacacacagtctgtgggagaccacgacaaatcacaagtcgcgggcgctgaggagagcccacagcattaatcccaagagggggcgcatgagagaggaagcaaaatcttctcccgggggagcgacccaaagacatttctccactacaagcacttcccaaggtgtgggccccccttctgaagacgagagaagaagagggcgcgccgcaaactatggaggacacgacagagaaaaattagccgtcagaaacagggggccccgaaaaaaccgggggtgtgcccagcattcacaagaagaggggccactcggcgagcn

SEQ ID NO: 562861 - DNA, 197 bp, Homo sapiens
gcgagcccatcggccgacgctgagaaccggacgcaggctcccctggaaacggccggcaaggctccgcctccattgcgccgcgcgccctcggccattaggggcaggccatccgtggggccaggacgcgccctgcgggtccggggagccatcatcgtgccgttcaccagcctgatcagaccgctcgccgtcctggcgat

SEQ ID NO: 562862 - DNA, 220 bp, Homo sapiens
gtcgatactgtctttacgatccatccttctcacgttcagacggcgtctaccaagcactaccccacatggcccacgtacctcaggctcatgtacagatcaagagaatgagttccttctcatccaactgacccatgcgccaagtgcatgctaactgacgacactagctcaccgcgtcggtccccaaggccgaccctcgcatcaatagtgcacgtacagccca

SEQ ID NO: 562863 - DNA, 289 bp, Homo sapiens
tcagcatgtcatacataactggcttctgcttgtccatccacacaacaccaggacttaagacaaatgggactgatgtcactctcgagctcttcatttattttgactgtgatttctttggagtggcggcactgtttttacagaaaaacatgtcattctatggttgtacacccactacaatgacgagaaaatacaaactatgcatccaacaaaggtctaatatccagactctataaggcatctccttcaacaatcaaaaaacaaccccattaaaaatgggccaccggacatg

SEQ ID NO: 562864 - DNA, 263 bp, Homo sapiens
tgataagcagttacggtactgatttactgtaattgacgtatactgagtatagtaaatctcaacagagtatacattttttatattgagtgtgacaaaaatggaaaagagggcagtggtcatgctgtaatcccagcactttgggaggttgagacgggaagactgagatcaggagtttgagaccagcctgggaaagacagtgagaccccgtgtctattaagaaaaaatgataaaaatttaagtcaaaagtggggaatatggccggg

SEQ ID NO: 562865 - DNA, 1434 bp, Homo sapiens
  misc_feature (1)..(1): n is a, c, g, or t
  misc_feature (895)..(895): n is a, c, g, or t
nctgggctttgatgtgacgcccatgttgttgtggtgcggccatccgcagtcggttgggtgaggctttttttcttggggcttctataatagtcggaattagtactttcccactgtgggcgcttttttctgtatatgttgaaggcttgtcgcgctagagtggtgtccccacaggatgtttgaaagaggcccatcttcgcgagatattgtggcgcccggaggcatttccacgttggggcgcacagaatttaattagtggtaggtaggttgtacaccttttggtgggaacgttcaaccctgtgttgggtcacacgcctcgtggtggcaacgcattttgtctttggggcccgccacgggtatgtcaaagacagtgtgagcggcccgattttcttggttgcaataaagataggatgtttgtggggaagagggcggacgccggtgtgtgccacgagtaattgataaccgccgccgcagctgttgttttgttgaaccacgcgtctggagaagaggtccacgccacccccactggtagctgtggaaattatcttctctgcggttggtctcgttgaagttgttcttatgccgcaccggtttcacgaaagtttcacacgaggggctgtgttctatccgtggtgaactcgtgctttttcacacccttggagccacacaattatcgctcgaggaaagagtttctcgcgggagacactttcttttaaagggagagaatttatagggccgcccaacagctgtttaaggtgctggcactgtttctcatagggggagacacatgagaacattgtgggagagttctcttccttttctgtgtgttgtatacaaaaggttgggcgcctcgagattgtgcccacctgttatttgttaagccctctctcgggggggngtcacaacaaatagagaaggggggctcttcgcgggtgtctcgggagaattaatagccaccacgttctgtcttgcacgtatagatggagagccactttttgcgagaagatccgagcagagaggccttcgctttgtctctagcgggagagtggccacaaaggaaaatgttgcacttctgactttaaagggggcccctcttgtggggcaccacacgggaggtcttcacaagatacaccccactggagagttctctaaatgagacgagtccactgctaaatgtttcgctggcgttacacttctactgggcgatatttacaaagagagtggcctacagaaattgttgccaagggtggcagcagacccatagcaggagtgactgaaacacaccaaggtcatattttgactgacaaatcctttctgcaactgcgggggcgaccgccaccaaataataccggtctttgtcgcttgtcttttcagatggatggttttaagagcttttgtttgcattttttaaaaaagagtaataaaaaggatttttta

SEQ ID NO: 562866 - DNA, 356 bp, Homo sapiens
atacagagagatcccgcgtacaatttacccagtttcccccaatgcatcaatttttaaaaccagtaaaaccaccaacagaatagtgccttctgaggttggtgaaaccaataggaaagaaacatgacgaggggatgctgaatcagaaatgtcaactttcctctcaaccttttgtatatatgtccactaaagtacttactctacattgtgattctttgtttttgtgaatctcttcttcagcagtgcatgagcttcctcacagcagggactgtgtcttattatctttgtcttcccagtaccagcgaagggcctagcacgtagtggaggaaggtgaggaggcaatggtaggggacttatca

SEQ ID NO: 562867 - DNA, 813 bp, Homo sapiens
gtggcgacatgcgacgactggcagcgatgtgctggtgtgcggggccagccccggtgactcccgtgggtgcagtgaggaccctgtggtccctgggtcctggtctgctgtgcatcccctgtggcaaaaggcggcgatggaactgcgttgacgcgaacatgtgacgtgcgtgagatggccctgtttgagcatggaagttctgggggctccatgtacctggaatcccaactgctgtgcctgcgtgtgcccactgtccccacttggtccccacagtagaagcgatgcagtgtcccagccggctcctgtgatccgcccaattatcgcgactcaacacatatccagcatgtgtccaggcagactctggatggcccgagcatgctgctgcagccacagtaggttcctcccatggtggtgtggccctccttttgtaggccctgttggctttggccctggtgatcggagtcaccttggacaggccagaggctcggagaagccatgttcctccggcgggcagcttgtggcccccagagggccctatcctgcgtccagcgcttcgtcccccacgtgctacaggagagcagattccgatctcttcctcatgcatgcaagtcccgggttaaccgcagagacaaataacataagaaacataaacaaaacatacacataactccaaagttaacatcctactcttccatcaacaagtcaatgcaaaaataacacacacaaatcaataagctaacagcatattactatacaatatgaggctctcacccaccaagtgtacaacacgactgaggttcaacaaatgacaagaca

SEQ ID NO: 562868 - DNA, 1099 bp, Homo sapiens
attagccccctaataaaatacattaaccactcattcatcgacctccccaccccattccaacatctccgcatgatgaaacttcggctcactccttggacgcctggctgatcctccaaatcaccacaggactattacctagccatgcactactcaccagacgcctcaaccgcctttacatcaatctccccacatcactcgcagacgtaaaatgatggctgaatcatccgaataccattcacgccaattggccgcctcaaatattctaatatctgcactctaccatacacatcgagcgaggcctatattacggatcatttatatcataccacagaaacactgaaacatcaggtcatttatcctccgtgacgtatggaaaacaatagcaaaaagccattcataggctatgtcctcccgtgaggcccaaatatcatttctgaggggcacacaagtaaattacaatcttactatccgcatcccataacattgggacaagaccctaagttcaatagaatctagaacgaggctaactacagtaaacagtcccaccccatcacacgattacttataaccttatcacttacaatcttgccctgacaataattcgcaagaccactatgcaagcaacctccacacctcctattcttgccacgaaacagcgtgcatcacaactaaagcccccctagggaagtcaacccatcacccatatcacgagttaagattcagcctagtcaagcacttgagctaacgacgaagtcagagaaacgcccattcgggattagcttgtcattcccttcatcatgctttagtgagcatagaaagaataataactccccacacactacgctaagggaccccagacacatatacgcctagaccagcccgtgtaagaacagtcccaataatacgaagattcagaacgggcacacatgtcggatccgactaagaaaggaggcgctgccactgagttcactctcaatcggaaggatgccagcggaattcgagaacagaaattacgacccacaatgtttacgcgcacggcaacacgttcagtatgagacaaacacacactgagcgcgagtgaaatcgaccatgacaaaaa

SEQ ID NO: 562869 - DNA, 206 bp, Homo sapiens
taagtgcggtagtttttaaactgttggtttttaaacaaactatagaactcttcatggtcagcaaagcaaagagtcacgtgcatcaatgaaagttcaagaaacctccgtggtacttaaacacgattcgcaacggttctgttatttttttggtatgtttagaatgctgaaagtgttttggaagttaaataaacgagtattacattttt

SEQ ID NO: 562870 - DNA, 104 bp, Homo sapiens
ctgaccagtgtgtttgtagattttctcaacatgtaaatagctgctttctaatttcctctatattcattcaatgcaactacaagctcatagagatagattaaaaa

SEQ ID NO: 562871 - DNA, 410 bp, Homo sapiens
  misc_feature (66)..(66): n is a, c, g, or t
  misc_feature (78)..(78): n is a, c, g, or t
  misc_feature (100)..(100): n is a, c, g, or t
  misc_feature (108)..(108): n is a, c, g, or t
  misc_feature (175)..(175): n is a, c, g, or t
taaaaaaaggggttttaaaaaaattcggacgcgcggtcccatctcttctccttgtacctggtcaancgagcgcgaggnagttcaggttaacagacaaaanttaattanacacgtattgagtagcgctagggttcacctatgccgaatccactgggtagcggacacgcacaagccnaccgagctttatagtgtgcctgcatagattttaaacattcctgggcacccactcaagagtgctctttttatcaccttctggaaatccgcaaagttgcaggggcctctggagtgtctcttctctagagagaattggtgggaccccccgtcagtagcacgtggcccctaactacgtggacgggagcagaggacttacagtcacgcatggacctcgaacatgaacatggcgtttccca

SEQ ID NO: 562872 - DNA, 348 bp, Homo sapiens
  misc_feature (348)..(348): n is a, c, g, or t
gcatggctcatgcctgtaatcccagcactttgggaacatgaggcagatggagtgcttgagtccaggagttcgggacctgcctgggtaacatgacaaaaccctgtctctacaagaaagaatacagaaattagccaggtgtggtggtgcactcccgtggtctcggctacttgggaggctcaggtgagagaatcacttgagcctgggaggtcgatgctgcagtgagccatgattgtgccactgcacttcagcttgggtgacagagcaagaccctgtctcaaacaaacaaacaaacaaacaaaaaaccccaaacatcattttttaaaggaggatcatctggcttgttttgtn

SEQ ID NO: 562873 - DNA, 109 bp, Homo sapiens
gaggttgcaggcgttcggactgacacaggcatggagtccgagcaaaaacctggcccttgcagggggcaggactcatggcacgctaaataaagaccggattgaagatgca

SEQ ID NO: 562874 - DNA, 187 bp, Homo sapiens
gccccccccctttttttggggggggttttcaccccccccttttttcccccggggggggggggggggggtttttttttcccggggggccccttttttggggggcccctttttggggggcttttgccccgggggggcccccccccccccataaaaaattttttttttttttttggcccccggcgtttta

SEQ ID NO: 562875 - DNA, 1313 bp, Homo sapiens
  misc_feature (479)..(479): n is a, c, g, or t
  misc_feature (714)..(714): n is a, c, g, or t
  misc_feature (810)..(810): n is a, c, g, or t
  misc_feature (837)..(837): n is a, c, g, or t
  misc_feature (973)..(973): n is a, c, g, or t
  misc_feature (979)..(979): n is a, c, g, or t
gaaaactcagtatatccatacgtattgcttgctgtcgtggcttccagtcacagttaacatagacaccgtgattccataaacatcgttcactcatacagaaggactacctcatgtgctacattgagcatagatgccctttggtactaactccattctgagtaaataaaagactgattcctgcgttgctttacactcggtatgccgattacctgccaaacaaagaatacaagaatagcgaagttgcgagtagaggctcatgtacctgttgttccagttcgttcgcgagaggtcctataactgagattctcatctacagcactttactgtcgcggaaaccaaggtccatttgggatacacacagagaaacagactacgacctggggacaacattgcaacaacgtttcacaaggcgcatcgacatttcactagcaacattttattgtttctccacaagacgctctagaacaatgcccactatntggcgtagcagcagccaccacatctctttatgacacacgctcttcgaagcacagggtgggaacactgaatcccctttcccaggatatattctggcagtccagcacaatacagtagagtatttcttatattcaagacaatatgggaacagcccctattcccccgaaagatggatttttcttacatccattgcgaacgcgacaacaagcagcacactttgcgacatatacgctttgnacgattctgacacgacagacagcaaacactacaaccagatatagacaagaactccaaatgtggctttctccctgagacattaatctaacgtgattntcgttaacaagggcacaatccccgatnacttcgactcccacgctatccacaatgggtcctttaaaaggcacccattgctaccccttattcggcagcttttaaaactactgcgtgggccacactttggaaacagtccttatatacggcacaacaagaaccaganacgaantccttgttaacattcttccccacagagaattgagcagcctggctggcaggcactaggtatacctgcgagacttacaagacaatagatcataccacttacacgtctcttataaatccaacatattttaaagtgaacccacaggctaacgtaagagacatgacaattggccccatgtagcaacggcgaaaaaaatgtagtatgtaatacatgctatatacaccgggtcacagcgaaataaataagcactcagaaaacaataacacagcgggaatatcaaagacaaaacatataacggaaaatgctgcgcacttaagatacagcatatgacagacaa

SEQ ID NO: 562876 - DNA, 291 bp, Homo sapiens
  misc_feature (21)..(21): n is a, c, g, or t
ggggggggggttccccccccnccccccggggcggggaatttttttggggggcccaattttccccccccccccccccggggggggggggttttggggggggggcccccccccccccccccttttttttttttttttttttggggggggggggtctttccagggatttttttctccgggcccccctttccgcgggggggggggggggggggttttttttttttgggggttttttccccccccccccccccccccctttcttttttttttttttttgggggggggggggggtga

SEQ ID NO: 562877 - DNA, 656 bp, Homo sapiens
agagagagagagagagagagagagagagagagagagagagagagagagagagagagagagagagagagagagagagagagagagagagagagagagagagatagagagtgctagacactatgttgtttttgaatacaggcatgtacagtaaaggtataaaacatgcatggaaagcaagtttattataaaggccagttactgctggagagaatgaaatacattgggtttgaaatgcctatggatggaattatacgtatatcattaatgtgatagtgagtatatcggtgattatattattgacactatattttggggattctagaaatattttatgtaaaatactaagggattgtcttgaagtatgattcagtttgcttcaaccaactatttatgtatatttctaagtaatttgaattacactgatgttaacattcttacacctgtgcatgaatcaggtatctgtatgtcagtgctgatttggataatagtgctgtataaagcagattcggcgtacttaatatgattgacagtactggtatttgctaaagtgaagcttaaactggttcttctacgagaactgcgcttaaattggaagtaaaccggggttgccctaactgttctgtctccttaggcgggatcagagcagatatggttct

SEQ ID NO: 562878 - DNA, 751 bp, Homo sapiens
gtggcaccagcgaagggagtgcgagtatgtgttgtgtgtgtgtgtgtgtgtgtgtgtgtgtgcgtgtgtgcacgttatggtgtttctccctctcatctgtctgagagtttagttgtagcagaggggccacagacagaagcctgtggtggtttttactttgtgcaaaaaggcagtgagtcgtcgtagaagcctgggaagttggccgatgtgtcttaaggagtgggtggacgtgagacatgtggctgtgtgtaataagagaaggacaaagggaggagaaagcacgatgtgctccagtgagtcttcgtcactctgtctggcaagcagattgatatataagcgtgattgtctctgggtttgtacttctgaaatgtagatgactgcttttgtgacaaacgagagccttctctctcccccatcgccctgtgttcttgggtaggagtgggacaaaggggcaatctacagagattgttggggcgcgggaacgtcacaagctttcggagtgggcgggtggcttgtcacagaaagacatttggagcgcatcttattctctctgtgttctctctcccctcgtgcgcggtcgcaccctgaaatagcactcagtgcctctgggtgtgccattgtgggggaaatggggagaaagaggggccgcgagtgagagctagaggcaggcctcggggtccgcaatatggagggcccgactcagggcgaaatgtcggtccggatttgtcggacggtttggcacggtaaggga

SEQ ID NO: 562879 - DNA, 95 bp, Homo sapiens
aaatcaacaaatgtgaaagcccagaaaaatatattcgtatttctggttttgctggatttttacatttttaaataaagaacgtgttcttttgagat

SEQ ID NO: 562880 - DNA, 945 bp, Homo sapiens
  misc_feature (26)..(26): n is a, c, g, or t
  misc_feature (81)..(81): n is a, c, g, or t
  misc_feature (83)..(83): n is a, c, g, or t
  misc_feature (96)..(96): n is a, c, g, or t
  misc_feature (103)..(103): n is a, c, g, or t
  misc_feature (110)..(110): n is a, c, g, or t
  misc_feature (121)..(121): n is a, c, g, or t
  misc_feature (157)..(157): n is a, c, g, or t
  misc_feature (186)..(186): n is a, c, g, or t
  misc_feature (190)..(190): n is a, c, g, or t
  misc_feature (198)..(198): n is a, c, g, or t
  misc_feature (207)..(207): n is a, c, g, or t
  misc_feature (217)..(217): n is a, c, g, or t
  misc_feature (229)..(229): n is a, c, g, or t
  misc_feature (232)..(232): n is a, c, g, or t
  misc_feature (234)..(234): n is a, c, g, or t
  misc_feature (242)..(242): n is a, c, g, or t
  misc_feature (247)..(249): n is a, c, g, or t
  misc_feature (261)..(261): n is a, c, g, or t
  misc_feature (271)..(271): n is a, c, g, or t
  misc_feature (275)..(277): n is a, c, g, or t
  misc_feature (280)..(281): n is a, c, g, or t
  misc_feature (289)..(289): n is a, c, g, or t
  misc_feature (297)..(297): n is a, c, g, or t
  misc_feature (303)..(303): n is a, c, g, or t
  misc_feature (311)..(311): n is a, c, g, or t
  misc_feature (319)..(319): n is a, c, g, or t
  misc_feature (342)..(342): n is a, c, g, or t
  misc_feature (344)..(344): n is a, c, g, or t
  misc_feature (351)..(351): n is a, c, g, or t
  misc_feature (364)..(364): n is a, c, g, or t
  misc_feature (379)..(379): n is a, c, g, or t
  misc_feature (405)..(407): n is a, c, g, or t
  misc_feature (412)..(412): n is a, c, g, or t
  misc_feature (419)..(419): n is a, c, g, or t
  misc_feature (434)..(434): n is a, c, g, or t
  misc_feature (437)..(437): n is a, c, g, or t
  misc_feature (479)..(479): n is a, c, g, or t
  misc_feature (485)..(485): n is a, c, g, or t
  misc_feature (506)..(506): n is a, c, g, or t
  misc_feature (512)..(512): n is a, c, g, or t
  misc_feature (517)..(517): n is a, c, g, or t
  misc_feature (530)..(530): n is a, c, g, or t
  misc_feature (855)..(855): n is a, c, g, or t
  misc_feature (927)..(927): n is a, c, g, or t
gtcacccttttcctgcacaacaacgnggtcttccatgatccccacatcgctgactcctggccgcagctccaggaccacttntnagctgtggagctngtggggncggaggnggctctgagcncaggcgaggccagggacatggccatggacctgtgtnggcaggaccccgagtgtgagttctacttnagcntggacgcngacgctgtnctcaccaacntgcagaccctgngtntnctcattgnggagnnnaggggggtgatngctcccatgntgtnnnggnngggcaagntgtggtcnaacttntggggcgncctgagcnccgatgagtactacgcccgctcngnggactangtggagctggtgnagcggaagcgatgtnggtgtgtggaatgttccatatatctnnnaggcntatgtgntggggggtgataccntgnggatggagctgccccagagggatgtgttctcgggcagtgacncagacncggacatggccttctgttagngctttngaganaagggcatcttcntccatctgagctatcagcatgaatttggccggctcctggccacttccagatacgacacggagcacctgcaccccgacctctggcagatcttcgacaaccccgtcgactggaaggagcagtacatccacgagaactacagccgggccctggaagggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatnccacatgaagcaggtggggtacgaggaccagtggctgcagctgctgcggacgtatgtgggcccatgaccganacctgtttccggtttaca

SEQ ID NO: 562881 - DNA, 873 bp, Homo sapiens
caaatataaaactgggaaaatatttgcagttcatatcaaaaaaagggctaatattcttgtcccagaattcctacagttttttaaggccagtaatttgatacattagtgtgtaaaggatatgaccagacagctcacacacagacacacaaatgtgaaaagatgcttgatctcactgataaagcataaattaaaacgatgtcatttttaaaaatcagattcgcaaattttaaaagttgctaacactggaatggccagagtaagaggaaacgtgacacaggcacagattgctggtagacatataagttggtacagccctctctatgtaattttgtgtttgtcaaaattacaaatatgtatgcccttaacccaggaattccactcctcattatatatcctacaaataaactggtctcgttatgacacaatgtaatgaatacatagataagtactgaaatacttggttatcatagcgtaaagatggtaatcaacccaaatgactattaccagaatagaaattaaacaaagtatgatatatccataaaacacaatactatgcagctgttaagcagaatgagacagtcctctatatatcaatatggataaagagtaagtgaaaaaagccaggagagaatgttgtctataatatgctgttgttgtgtacgggaaaataaataatataaatacctagaatatttgtgaaggtacagccaagaaactactatcactgattgtcttaaggtactagatggggcacaggacaggacgaaagatttacttcttattgtttcttctgtataacttttgaattttatgctgttaatgtaatttttcaaaaaaatatataaaaatataaaaacatgaaaaacatgaaaa

SEQ ID NO: 562882 - DNA, 385 bp, Homo sapiens
  misc_feature (66)..(66): n is a, c, g, or t
  misc_feature (86)..(86): n is a, c, g, or t
atgccctatccatccaatccaattagattagaacagaagaaaattggattggatggatagggcatnacattgaaagaaacattctnttcttacgtttacttgagttgtccatagcaacctgtcctgaaagattgtccgtttaaagtaagcctctcaagactgtgaccaccacccaagattggtgtttcataccgtcttgatacaaacagcagacatccagtcattcagctgcgttaggatcactatctctttatcagaagaaagaagagaaaggtagaagagggatttctacttcataattgaatgttctttgcttattaactgtggaagcaaacttgaaattctgggagagaaagcactgatggggcacacattgtctgtggtg

SEQ ID NO: 562883 - DNA, 363 bp, Homo sapiens
tgctgagaaggccctggggaaggcggcatccacatcagaagcatcaagaatgtgacagagctcaggctttctgacaaccccgcctgggaaggagataaagggaacaccaagggcgacaagcatgatgacctccagagagcgcggttcatctgccctgtggtgggcctggagatgaatggccggcacaggttttgcttcctccgatgctgcggttgtgtgttttctgaacgcgccttgaaggagataaaagctgaagtgtgtcacacgtgtggggctgccttccaggaggaggacatcattgtgctcaatggcaccaaggaggatgtggagatgctgaagaagaggatggaggagaggaggctg

SEQ ID NO: 562884 - DNA, 126 bp, Homo sapiens
ctaataaaacgcagaagaagaatcagtcatcagtattagaggtttgaattgggtcacatcaggtgtgtgccagagctctgtcaactgccccaccggagttggtgcaaatgtctatttactggaaac

SEQ ID NO: 562885 - DNA, 3362 bp, Homo sapiens
  misc_feature (3274)..(3274): n is a, c, g, or t
  misc_feature (3362)..(3362): n is a, c, g, or t
acccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcaagtggaggtcaccaattgcttttcagtgccgcacaatgagtcagaagatgaagtggctgttgacatggaatttgctaagaatatgtatgaactgcatacaaaagtttctccaaatgagctcatcctgggctggtaagttggggaggtgggggctggggttaatggaaggtctcttcgtgattgccggtgtcttttgctactggactggatcttatactcttccttttggaggcaagagtattgcaagtgtattactgactgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggaatttgaagttgcagtgagctatgatcatgccttgccactgcattccagcctgagtgacagagtgcgaccctgtctctaaaaaacaaaaggaaagtgtgttacctgtaggaactgtgaattcagtgggttttgctggtggttctgatcctgtggggccaggatatttcgaattaccttgtaagtgacttggaatttttcatcagcactaagtcagcctttgattttatttgacatagttttcggtgtgtgtattgctcttggcagttggtgtcactaggtgtcctaccgtagaagtgtccggtaccctgaagacacccatgccactgttgtgtttgatattgacgccacatatagacaggagtccaccactgtgttccatttcacaggtacgctacgggccatgacatcacagagcactctgtgctgatccacgagtactacagccgagaggcccccaaacccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagcccccaacagaggtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcatgtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttcccccatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaccaacaaagaaatccaaaaaacacaataaacaagaaacatcataataaccaacaaataacaaaacgaaacacaacacacttctttttaaacacaacaagacatgaaaaccaaaaaactgttgttggtgcggggccgcgccccccccgaaaaagattttttataccaaccccaccttgcgtgggcgggaccgggagccgccaagaagttgagtagagacaaacagcgtgctgctaagtagagtggctggttcccaaagcagagaacccggctgcgtggaagcacgcacacagacgtggcgggggtgcgtgtctcccccacagaaaagagaaaagcggggcgccgcgggagaagaaccagcgcagctggtgcgtgtacggaacaaaccccgagaaggagcgagcgccctgccagccggcgacacagcgaaggggcgaggcgcttctaacacancacagcgaaggaggaggcaggcagaccggagcagagcccagagtaaataaaaaaaaatagcccccgcggcaagcgagggcggagaagn

SEQ ID NO: 562886 - DNA, 239 bp, Homo sapiens
agggtgccgaaatgagaacaaggcagaaggagaggaagtataaagcgtgagctcacgccttatacttcctcaacgctttatactttctcaacgctatatacttcctcaatctttatacttctcaacgctttatacttcctcaatctttatacttctcaacgctttatacttcctcaacgctttatacttcctacaacgctttatactttctcaacgcttcatacttcctcaacgcttta

SEQ ID NO: 562887 - DNA, 1995 bp, Homo sapiens
  misc_feature (1907)..(1907): n is a, c, g, or t
  misc_feature (1995)..(1995): n is a, c, g, or t
acccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcaagtggaggtcaccaattgcttttcagtgccgcacaatgagtcagaagatgaagtggctgttgacatggaatttgctaagaatatgtatgaactgcatacaaaagtttctccaaatgagctcatcctgggctggtacgctacgggccatgacatcacagagcactctgtgctgatccacgagtactacagccgagaggcccccaaacccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagcccccaacagaggtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaccaacaaagaaatccaaaaaacacaataaacaagaaacatcataataaccaacaaataacaaaacgaaacacaacacacttctttttaaacacaacaagacatgaaaaccaaaaaactgttgttggtgcggggccgcgccccccccgaaaaagattttttataccaaccccaccttgcgtgggcgggaccgggagccgccaagaagttgagtagagacaaacagcgtgctgctaagtagagtggctggttcccaaagcagagaacccggctgcgtggaagcacgcacacagacgtggcgggggtgcgtgtctcccccacagaaaagagaaaagcggggcgccgcgggagaagaaccagcgcagctggtgcgtgtacggaacaaaccccgagaaggagcgagcgccctgccagccggcgacacagcgaaggggcgaggcgcttctaacacancacagcgaaggaggaggcaggcagaccggagcagagcccagagtaaataaaaaaaaatagcccccgcggcaagcgagggcggagaagn

SEQ ID NO: 562888 - DNA, 219 bp, Homo sapiens
atgctgcggcgtggacacttggcattcagggacatggccatagaattccctcaggaggagtggaatgtctggaccctgctcagaggactttatacagggaggtgatggtcggagacctacaaggaccctggcttctctgggaaatctgtctcccgaccctaagtgtaatctcctagttggagcaagcaagataccccggattcgcaagtcaatgtgaat

SEQ ID NO: 562889 - DNA, 331 bp, Homo sapiens
gtcgtatcgcgctgacgtgcacacggctgcccgggagccaggtccgcttctggtgggcctctggcgcgggacactctcgtgtgggacacaccctaccacaccgtctggtactgcgacttccgcactggcaagatcggctggttcctgtgaggccagttcagtgtctctgtcaactgcttggaccagcatgttcggaagtcctccgatgagcgttgctttgataatatagcatcccaggctgggtgcagtggctcaagcctgtaatcccatcacttcgggaggccgagacaggtggattacctgaggtcaggagcttgagaccagcctggcc

SEQ ID NO: 562890 - DNA, 1767 bp, Homo sapiens
acccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcaagtggaggtcaccaattgcttttcagtgccgcacaatgagtcagaagatgaagtggctgttgacatggaatttgctaagaatatgtatgaactgcatacaaaagtttctccaaatgagctcatcctgggctggtacgctacgggccatgacatcacagagcactctgtgctgatccacgagtactacagccgagaggcccccaaacccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagcccccaacagaggtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctacctctccgtaaactcaccaccaccccaccccgccctgcccaacggcggcccccccacgcgtcccccctgcaggctgcccccccctcttttacctgttctcccccgcttcctcttctcggtccacccagcagtggcccccccttatctatgttttcgcaccctgctttctcgctccgctcctatgctgctcttctctgtcttcgcctcttttttattaacgtccgtttttggttatatagtgggacacacctcgtgtaacccttaggcgggaacattttgtggcgtacgtggtcacccttcttctctggcgtgttgttgcccctacat

SEQ ID NO: 562891 - DNA, 2115 bp, Homo sapiens
  misc_feature (698)..(698): n is a, c, g, or t
  misc_feature (2027)..(2027): n is a, c, g, or t
  misc_feature (2115)..(2115): n is a, c, g, or t
acccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcaagtggaggtcaccaattgcttttcagtgccgcacaatgagtcagaagatgaagtgagtgggaatccaagctgtccctctgcagtntttagctgttcatttgctcggctcccctcacggtccctcccacactcataactagagctcctgtagccaaggagcttcttcccatttgtggctgttgacatggaatttgctaagaatatgtatgaactgcatacaaaagtttctccaaatgagctcatcctgggctggtacgctacgggccatgacatcacagagcactctgtgctgatccacgagtactacagccgagaggcccccaaacccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagcccccaacagaggtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaccaacaaagaaatccaaaaaacacaataaacaagaaacatcataataaccaacaaataacaaaacgaaacacaacacacttctttttaaacacaacaagacatgaaaaccaaaaaactgttgttggtgcggggccgcgccccccccgaaaaagattttttataccaaccccaccttgcgtgggcgggaccgggagccgccaagaagttgagtagagacaaacagcgtgctgctaagtagagtggctggttcccaaagcagagaacccggctgcgtggaagcacgcacacagacgtggcgggggtgcgtgtctcccccacagaaaagagaaaagcggggcgccgcgggagaagaaccagcgcagctggtgcgtgtacggaacaaaccccgagaaggagcgagcgccctgccagccggcgacacagcgaaggggcgaggcgcttctaacacancacagcgaaggaggaggcaggcagaccggagcagagcccagagtaaataaaaaaaaatagcccccgcggcaagcgagggcggagaagn

SEQ ID NO: 562892 - DNA, 352 bp, Homo sapiens
  misc_feature (350)..(350): n is a, c, g, or t
cccttatcctccctaagataaagagaattacaagggtggttgtgaggatttgtaaaaatgctttgcacactcccctgaatcctaggatacagagaaggcctctgttcaaggagtgagctcccaggtccctgtttgattcctcaggagaagctgactcccaaagggacttttcccatctctacaaaaaaattaaataactagctggacacagtggtgcatgcctatagtcccagctgctcaggaggctgaggcagaaggataacttgagctcaggagttcgagattgcagtgagccatgattacaccacactgcactccagcctcggtgacagtgtgagactctgcctccnaa

SEQ ID NO: 562893 - DNA, 472 bp, Homo sapiens
tttctacgatcagaaacatctaccaccagtgtgaagatggaaggaaaaagagctccttttcctctccctcccccaccacctcctccccaccaaaaaaaaaaagaaaaaaaagagaaagccagaaaaaaccaaaaatagcctatgtgagtctgcttctaacagccaaaggatgtgtgcactataagcggatcccttgcaaggtgtgtcatagtgagctcaaacatgactatttatggtatgttcacggagtgaatggacacaaaacacgaaccagacacttatattaaacccaaacgtggcttttaacgagctcggttcctccacttttattggccacaagacgtcccctaagtcagagctacctgtggatccttccagcagtaatgtctcctgacttgctggccccgagttgcattgactccacctcactggcctcccaggcttgctgcgttgtgcctctccatgcggggat

SEQ ID NO: 562894 - DNA, 101 bp, Homo sapiens
acttctttttttttattaattggggaatggagtggactggctctgatatggagagacctgtaagtctggtataataggtgcccagcgtgaaaaaagcatct

SEQ ID NO: 562895 - DNA, 645 bp, Homo sapiens
  misc_feature (123)..(123): n is a, c, g, or t
  misc_feature (253)..(253): n is a, c, g, or t
gagacgttcttctgccgagatgtcgtcggggtttcctgcttcaacatgtgcttggacggaaccctggcgctctgttcccccacccctgtgcctggccgcccaatagccatgccctcctgtcancctcttcacctgcaccctcggactggccccagaggcccccgccggccggttccagcgccgtgcggcagaccacctggccggcctggccgccggccattctccttttaggtcgccgtgccatttgactggngagatccgtgtgtacaacctcttcggcaaggtgttgcccgcccaaagagaaattttaacaccagacccaaagggggcaccttttcacaaaggaaaatggggaggccacctgtggcccacctagtttccaaaaaagccccggggggggcccccctaaatggaggcaaatttttcaccaaaaaaagctcacctcttgtttttgggggtaaaaaaaaaagggggaagacccaccattttattagccacgacacatattttataataaacaacccacatcactcattcgtctctcctacacaaaaaatcccaaaccatatattagttcattctcatcaacaaagcaataacagaaaaaagatatatatattatcaataaaacacgacaaagtcatg

SEQ ID NO: 562896 - DNA, 1119 bp, Homo sapiens
catgtgtgcaaccaggggtgtactggaaccatttttagaaggaggtttcccccccgggtgttccactcccggcctgtgggaagaaatatcccccgttgtttcggcgcgaaggtgaacaaccagtgttctaatttatagggaaagaattagaaaatttggtgcattgtacacttgggtcccatgggaccccgcccgtttatggtctcccgtggttgaccacaaccttgtgtttgggggggatttagggaaagttattaattctggccccggagtttgcaccctagtgtgatgcaccccccatcttgtcttaattaaagcccaggagttttttggaagatttatgaagttgaaacagagacccactattgttgtgtcccccccggaaaaggtgaattttcttccttagatatagaaaattgagaagatgggacattttaaagagggtattatctcccacagttcgctttgtggaaaggggtgaatgtaagaaattcccacaatttcttgtttaaaaatattcccacctctaaatcttttttctaagataaagaaatacccccaaaaatattttcacattctaagagatataataatttccacctcttaaatatattgttataagaacagaggtagagatattatattgggtggcctgaaggtctttcttttgtaacaatgtgcctataacaggcgagaagtgttttttctctatatgggtataatgcggtctgttatccggagatatatataacccctccaaggttataaatggagaattatatcttatatgggaacgctgtgtgtttctcggttataactataaaatttatacaccacgtataaccacctcctcgtatgtatacccacttaccacgagaaaatatactttctggccttataaaaaatattgaatatatgcccacgaagaatgagttatgtgtttttttgacgcttggagacccttttaaaatgcctcactctgtgtgtatctgagaccacaattgaaactcgcacatgcacgccactataaaagggacaccagaaaccacgagaactgtttaactaaactttgggacatcccctggagtttttaaaaataaataaatatatatatatata

SEQ ID NO: 562897 - DNA, 140 bp, Homo sapiens
  misc_feature (94)..(94): n is a, c, g, or t
  misc_feature (104)..(104): n is a, c, g, or t
cgagccggtacccccaattaacctcattaaagtgctgggattacatgtgtgagcacgcgcctggctaggagtagtattagtgggccaggcagangcacatattnagactcggaagaatgaagatgaaatgtggggagggg

SEQ ID NO: 562898 - DNA, 965 bp, Homo sapiens
cgatgtcccatgtcgggggaaccccctgccaccgggtgaccaagggtcccccccccacatgtcaatcgtcaccgacaagaagcttgcgctcctaaaaggctcgttccaagttagtacccctgggctcccaaggaggaacccttccgacgctcaaggcaaccggaaagggtgctccctcggtgcaacataaaaaggacgctgaaagaatgatccccaggccaccaccatgttgggtaccaaaaactgcgaatctgtggggcaccccccacgcgaggagaaaaccctgtgctttcggagccgcccacaaggagtaaagaagtcttggcaccaccacgggggattatatcaagacacgagtggcgggcacctcccccttgcaagtttccctccgtagttcatcctcccatggacaagcaccccgctccgcgggggcgattgaaaacgacacacaacaaagacactcggcgcaacattcccatgatacagtttgcccgccccaaccgtacatgtcttttcacccgcgcgtggccgaaaaaacgaatctttttcaacgcgcacgcagggaggctgtcaccaaatacaataacaagaacacacaggttagggtatcaaaagtttctggcacaacgccgctcgactgaaggcgctagagtagttcgtacagccaacactgtcatctaaatacggtagatgaatctttaaacaaatatggactagtagtacacttctttacacactcaccaagtactaatagcaaaatgcaaatacatactattaatgacacatgtcggtgctacaccacgcatccacccacagggatcataatgattataggctgtcgatgatctttgaagcacagagggtgtctttgctgagggaccacagtgttcatacgtccaatgcctatgtattgagctcgcccaattatgataacaaaaaaaaaattccacaaccaacataacgca

SEQ ID NO: 562899 - DNA, 310 bp, Homo sapiens
tgatctgaggatcccgtctagacgctgaactatgtggatgcaggaacaggaaggatgttccttgccaagtaggatgcccatccagaatgaggggcaaggaaaatcctcatggatgatcatgacgggagactctggagtgacagcagtgccccaggccagtccaactgaagtggaagaaggctcagatagagctaaaatagcaagaatgggtgcaattggatggacatatttttacagagctgttggaagatgtggaaaagtccaaatacaaaaacaagtcaggaggctgggcacatagttcagcgtctga

SEQ ID NO: 562900 - DNA, 367 bp, Homo sapiens
  misc_feature (24)..(24): n is a, c, g, or t
  misc_feature (34)..(34): n is a, c, g, or t
  misc_feature (38)..(39): n is a, c, g, or t
gggggggagtttgtttgacgtacnttcggagggnccgnnaaaacttggcctattttaagggaggagctctggtcagtgggggaaaaaagggccagaaatctttattatttttctatagcaaaccagatattggatcaaccctcttgaaaaggcatagaagaggctgggcacagtggctcactcctgtaatcccagcactttgggaggccaaggcaggcagatcatttgagttcaggagtttgagaccagcctggccaacatggtgagactccatctctactaaaaatacaaaaattagccaggtgtggtggtgcacgcctgtaatctcagctactcggaggctgaggcaggagaatcacttgaacct

SEQ ID NO: 562901 - DNA, 259 bp, Homo sapiens
  misc_feature (72)..(72): n is a, c, g, or t
  misc_feature (180)..(180): n is a, c, g, or t
ggccgctgcaggacgagacccttggtgtggcgtccgtgcccctcgcagtggagggccgtccagggcatcctnagggagacgaaaagttgccagacggccagcattgccactaccagtacatccacccaggccaggaatcatgtagacgcccaggtgcagacgagaggcccccataactantcgcgtgcagcccccgccccagtacgacatacccaggctcgcagccttttattcggagagtggaggccatggtcatccg

SEQ ID NO: 562902 - DNA, 758 bp, Homo sapiens
aatggccgtgaatttctaacgcataatatactgtgatacagccattccgtacatgtgtgaagtcctgcataatttcgaacttgtcaaatgtggcactaggagtcattcagatctaggcttcatcattttccagtgagaagcagagacccaaagggcctgtaacttgtgcttggtcaggggacctgtctgtcatgcctggaggctcttcgagcacacttccccatctttcccttctgccactgtggcttcaagcacctctgtcatagagcgtctctgaaatagagtctcggtcattgacttatcccgaagtagagcaagtgtgttccctctcatgtgtacgtctccaggaccttggccagtacaagctctggccctaggctgcgtccacgttaatagtcataattcctgaaacagatgttgattgcatctatagaagggggtacaccctatggggcgtcattccactgggttgggccacattaaaacgaacggtgactccccgatatatttggagcacaaacgaaacaacatctacccaaacacgacgcaaaccacacctcgcacccattgtttatgaccccaacgtcctctgcctctccgtaaaacacagacttctcttacagcacaccactcgtaggtaactgagaccgcgcgcgctccccccctacgaggcaccacaaaccgcgtcgcagcacacgcgcgggtcaacaacagaaaacccgtggagcacggcaacaggtcggagagcacgcccccga

SEQ ID NO: 562903 - DNA, 143 bp, Homo sapiens
  misc_feature (5)..(5): n is a, c, g, or t
tgcantatgaagtgattgatcacagaatggattgtacgctgtgagaagtgcgacaccgaatttccaatttcaagtacctgcatgatccttgtcagtaaatatttgcagattttcaacgagaatcaagtgggtgaacttgtttc

SEQ ID NO: 562904 - DNA, 990 bp, Homo sapiens
agcggggtggagcgcgcgctgctctggacgacgagacacactactgcgcacgcgcccgacgggagctgcaccgtggtagcccacgcggtccgaacccgtctggtccggccgagcctggtagtattgctcgtaacgctgtaattcttgaacgattgggcggtgatgctgtgtgagtgctgggtgaacgacaattgatgacgctgattagataacttggataagaaagcacagtgattatcacggacctgaccctggatatagcagagctttcatgaagtctaataccagagtcgattggccacgtaccataatttaatacattcgcacaagaaaatttctggagagacgagataaatcgcctttcaatataaagggatctgttgggctacttgggtagagggctactaggtaagagcaatttccatccatcgtgcaagccccacccagtggcgactccatcttcatggaattaggtagattaagaggtaattgcccttcaagacatggacatagcgttggaacatttcatatccgatctacgcagaactaaggtcgaataaagtcttatcgtaacgatagtttttcgaactttccttgttgaaagcacttgtcccgtgtattgatttaactggggggatatttggcacctcggacggattttctcccgggaatatgatgtctcatgtgatcgattcaggtcgataataacttgtgggggcatggcctgtggcgaggataaggagccatgtaaagaagggtaacattgcaaaggaacttcgttcatcgaatagtgtgggggcaaggggatcccttttgttcaatggccagcttgtgataggaacgaaagttatgacctttcaagactaaacaaccgcgaccatggtgtccttgcaggggttggggagagatccaagaagacgaattctatgcttgatatctttatggctccttctgaatccattaccctgccaattcagagtcatgaccaac

SEQ ID NO: 562905 - DNA, 454 bp, Homo sapiens
  misc_feature (400)..(401): n is a, c, g, or t
attcgcggccgcgtcgaccgaagagggtggcatcggcttcgtggtcgcggacaatccgaagatccagcaggaagtgctggtgaccccgggccgcaacgccgacgcccgtgtcgtcagttcgtcaaggtgaagatcacccactggccgacgccgcgcttccagcccagggcgatgtgatcgaagtggtgggcaactacatggcgcccggcatggagatcgatgtcgcgctgcgcacctacgacattccccacgtctggccgagcgtgctcaaggaagcggcgactcaagccggaagtcgaggacaaggacaaagagaagcgcgtcgacctgcgccatctgccgttcgtcaccatcgacggcgaagatgcccgcgacttcgacgatgcggtctactgcgaanncaagcccggcaagctgcgcctgttctccggcgtcgacgcggccgcgaaattgg

SEQ ID NO: 562906 - DNA, 267 bp, Homo sapiens
atcccacagttagggaggctatggtgggaggatcacttgagtcagagtacaagaccagcagggcacatagcaagacctcatctctactttaaaaaaaaaaaaaaggtagctggtatgggggcccaaccttgtcgtcccagctaactcggcaaagctgaggggggaggatcattggagcccaggaaatcaccccggcaggaagcaatgatcatgccacggccttctagtaaaggcggcagagtgagtccttgtcctcagaaaaaaaaa

SEQ ID NO: 562907 - DNA, 245 bp, Homo sapiens
atgtgaatatgaagctcacgtagtacaagatcctaaccaaaaagttcccagcgtttagaccagggcttaggcttcatttttactttcagctcattaacaggaactttttggttaggctcttgtactactggttatattccatcaaagtgtattattcagtcaaggggcgtctcgctgaagtattagcaaggctcatcaatccgagcccgtttttcgccaacatttttgtcccggacccgaggtcg

SEQ ID NO: 562908 - DNA, 327 bp, Homo sapiens
  misc_feature (323)..(323): n is a, c, g, or t
ttcgttcgggacggatcgaaacccttgtgtaggcaataggaaatatcattcgggcttgatgtgtggaagggtgtttaaggggttggctagggtactaattgtctggcgtcgcctacgacgtctggctgagaatagtgttaattgctcctttacggagagcactgacgagaagtcaagccgagggtcgctctttgattgtgtattaagggtggaaggtgattttcctcggaatgcggaggtgattccttagggggttgtttgatcccttttcgtgctacactaggaggtggactgctgctagggctgctacctcctttatgatncacg

SEQ ID NO: 562909 - DNA, 589 bp, Homo sapiens
  misc_feature (267)..(267): n is a, c, g, or t
  misc_feature (296)..(296): n is a, c, g, or t
  misc_feature (371)..(371): n is a, c, g, or t
  misc_feature (480)..(480): n is a, c, g, or t
cacccgcccccaatctgtctcaggatggaatgacaccacaaaatgtctttctaagtcttagaactctttgtcgtattctctacctacgtaaccaaaagaaactttctaaacatcaggatgtttttcaatttatgtttgtctttgctcacacgacaacaaaaaaaaaattagaaacaaattaagacaaagtaaaaaaaatttcaatcttatgttaccggattgcgtgtcaggagagaagtatatgaaaaatacatcagcaaaattttnagctggttcagtaactatagttacagatnggaaaagaaaatgaaaaaaatttatcgagttgccaaatcttacattctgacatattaacagaagaaaggattttngtcccacaagtttaagacagaggctggggattttcttatataaaaattttcaaatcttggacacatttatcacaaaaattatgcttttaggacttcacatcatgtattnctgatcaggcatgatcctaacagcaatggtttaataaaaattttaaaaaccaaaaaccaaaaatgttttgaaagaaataagtaattagtatcccttccctaccctaaaa

SEQ ID NO: 562910 - DNA, 339 bp, Homo sapiens
  misc_feature (26)..(26): n is a, c, g, or t
  misc_feature (63)..(63): n is a, c, g, or t
  misc_feature (69)..(69): n is a, c, g, or t
  misc_feature (82)..(82): n is a, c, g, or t
  misc_feature (95)..(96): n is a, c, g, or t
  misc_feature (100)..(100): n is a, c, g, or t
  misc_feature (102)..(102): n is a, c, g, or t
  misc_feature (111)..(111): n is a, c, g, or t
  misc_feature (121)..(121): n is a, c, g, or t
  misc_feature (147)..(147): n is a, c, g, or t
  misc_feature (154)..(154): n is a, c, g, or t
  misc_feature (169)..(170): n is a, c, g, or t
  misc_feature (174)..(174): n is a, c, g, or t
  misc_feature (202)..(202): n is a, c, g, or t
  misc_feature (212)..(212): n is a, c, g, or t
  misc_feature (260)..(260): n is a, c, g, or t
  misc_feature (326)..(326): n is a, c, g, or t
ctgggggggcttacattctaaaaggnaaaatacaccttttttaaaatgggatttttgtttggngttttntggaaagtactgngggaatattttgnnaagngngctttgggnataacttagncccatcattatttagagaatagaggngggaganagaggaggggttttnnaggnggagaatgacagagcattcagggtaggnaggggtttanagggagataaacacagtctcatcaactaaggagagatttgctgcagtnaataggatgagggaaatagtctgtgggatgcaagcaaaggaagcagggtgccttagacactgagtngagccagaaagat

SEQ ID NO: 562911 - DNA, 412 bp, Homo sapiens
  misc_feature (346)..(346): n is a, c, g, or t
agcaaaggacccattggtaggggtcagaagggcagtgtaagacggacgggagcccaccagggagagatgtgtcacgggggctctctcttaagtcaaattcggcacatggcatgtgaccatcctcgtgggctcacggtgggtgcctgaggttcctggaaggtggtatcaggatctcaaggtcacctccgggacacagcatggatagaagggggcagggttcatgcccgggaggtggaaaggcaagcagctcatttctgagaagcagggtggccgggggggctcataacaccaagggccccacagggtgtctccaattaacctacggtgagcaccattacctccccanagtatccaggatgtcagaaacctaggggcacggagaaacttcccagcaatctttctttagaacaga

SEQ ID NO: 562912 - DNA, 133 bp, Homo sapiens
atctcctcatttagacaaacttgacgtgcacgccttgcctggggtgcccactgttgtgcttcatgcaaggtgtcttccaggtagctgtggtggtccgtccaggccatgcttgccttcggagttttcccaaggg

SEQ ID NO: 562913 - DNA, 354 bp, Homo sapiens
tactgcagtcgcactacacaccccggtccatcttgccagcatcagcatgcacaataataggccaagcacgcctcctagtttgttagggacggatcggaaattgtgtagcgaataggaaatatcattcgggcttgatgtggggaggggtgttacaggggttggctaaggtcataattagcctgggtcgcctcaagcagtctggtgcacacatcaatgttaatgtcattaaggcacacaaagcaacacaagtaagccgcaggcgtctttgcattgtgtagtaagggtggcaagtgattttatcggcaatgggcagtgattcctcaggggttgtctgatcccgtttcgtgccaacaa

SEQ ID NO: 562914 - DNA, 913 bp, Homo sapiens
aggtgtgccgtcgaatgtcgctcctgtttacttacgtcatgactacttgtatctgttcctgtcctctatctttggtactcatctgctttgggcaacctcggttcttggctgccaacctatctccgcaagacttcttggctgggatcccctaccactacagggctgcctctcgaatcttattggtgtgaacccctctcgggtggttccctacacgttgaagaacgaatcccacgtcgggaggagaccctagcgccggccttagccatgagtacaaagtgcgcgatcttcggtcccgtcacaatcgcccatatggcctgtctacaatgacaccctgtcgcatgcatgacgtcctaatatgtactcgcctgcggtcacatcatgtgatagacaccaagcccctaccatgcccacattacttgcttaagaattcctagcttcagggacgctttacgatggataggcccttgccttcgatatatgcgttctgtaagctggaccctgaccgttgcaacttcggtatgtaccacgaatcacataagcaaccagtgcaatttatccttccattggagcttagccggccagactttcatactcccctgacggctcccacaatcgtgcggtgacctccaagcagtttaaccatagctccataggcaaagaggacctgttgttatcgggatggagcacgtcgtggatccgaatggactctcatacatcgctcacgcagctcactaagcaactcatctgtgcaaatcaccagagcactatcagccttccccgccttgcagcatgtcagctttctggggctaacttctctgcccttgaggttggaggcctgaggcctcgttggaactcatagctaacctggttcagagaccaggaaggagacgtgcacagttttgaaagcacagta

SEQ ID NO: 562915 - DNA, 225 bp, Homo sapiens
gcaagtctagccagaactcacttcttaaactgtgtccagtcatcttcaatatgtggacgaccttcttcttgcagacctctctaaaagactctcaaactcacacggcactgatctcttaaactttctcgctatcaaagggtatagggtctcaccctccaaggaccaactctccatctccatgatgacttacttaggaatacaactttcccctgaggcatgacaaga

SEQ ID NO: 562916 - DNA, 260 bp, Homo sapiens
tgggaagggggcccccttttgtggcccaaattagggaacgggggaaaattccgggcccacggaaacttcggtttcgggggccaagggaattttctggcttaagcctccgggggggccgggttaaagggttttggccaccaacccgggcaaattttagtttttccagaaaaaaggggttttccccaattgggccgggggggcctaaaactctggccctagggggacccccccccctgggcctccaaaggggtgtggtttac

SEQ ID NO: 562917 - DNA, 147 bp, Homo sapiens
ggaggcagttctatctacaaaaacaatgtcccctcttttagagtaagcaggatcgctatggtggagtcttcataaattttgaagacaagtccccacgccatacttcttttagagatgctaaagctgctgcttaaccgagcgctacca

SEQ ID NO: 562918 - DNA, 976 bp, Homo sapiens
  misc_feature (1)..(1): n is a, c, g, or t
ngtcggcgcaggggcgcgtccctttggctcccgggccggtttgtggaccccttctcgcaactttgtttggcgccgcaaaatccgttttccctttccgtggttttgccccgggccatggttggttccccccgcgcggggttgtttctgcctccccctctcgcgggagctatacgtttttcgactcctggtctgccgccggcgacgcattcttctcctccaggccttaggggccgcttcgtgggccttgttaggcccctccccctccgctagcgatggcgtttcccagcccggtacttggttatagggcccccttcccacaggtctctgtaccgagcggacgtgtattccccccccatcaatgggctcctattccactcggggggctccccccggatgtctcaccggcggcggaccacttcctgcgcactaagcctggacccccacgatattcgctcggtgtcaagcaatgtttaatactcttacggcgcggaattgacataatgcatttggttggccaccgcgacacacaaatggtctgtctcagcgctttatactctcctagagaggccgccccgccctggtggaaactccggggggtaccctccagtggctactgcacacccccccgtagtgcactcgcccctacttaccactcttctgtggtccactacaatttttgtacacacccgaggaatacttaacatagtatctacctcattgttaggtaccactcttcctctttgaagagacctcaacatcaactccaatttttcaagatacaccccccccatccgccctcccgagggaacaataaaattgagtaccccccccccccctccccaccattattcagaacaccctatgaatactaacatatattcataccccaaatcaagacagaggaatactaacccccccccatgggggtttcagcccaaccccagggccccccaaatattttcccccacaaaaaaca

SEQ ID NO: 562919 - DNA, 538 bp, Homo sapiens
  misc_feature (160)..(160): n is a, c, g, or t
ccggcgggggaattgttcctttcccccaattatgggcttccccggagattttttttggcgggggttgtttggggccccattgccccccggagggttgggcttcccaaagggaatttaaagggtgggggcccaattttttttcccacaaaggtctggtttnacaggggtgtccccgggggggaattttcccccgaggggtttttgtttcgggtttttttccccgctttttttgaccggggccccccagggccgtggtttaagggggtggggggggggtggttttttccccccggaaccttgggggtttttttttttttttttttgggggcccggggggaaatttaacccggggccattcccccggtttcccattttcggcggggttgaaatacccccgcttttctttgggggggggggggccttttttccccccccccacccattttcccgcggggggggcctttgggtttttccccttccccccgggcctgtttccttgccgggttttggggggccccctttttaacccctaaattta

SEQ ID NO: 562920 - DNA, 313 bp, Homo sapiens
aacagaaaactgcatttagttttctcttcaaagaaggcacttaacgaggccagcgcggtggctcccaaagtgcctgtaatcccagcactttgggaggcctaggcaggcggataacctaaggtcaagagttggatatcagcctggcaacatggcgaaaccccgtctctactaaaaatacaaaaaattagccgggcgtggtggcaggcacctgtaattgcagctactagggaggctgaggcaggggaatcactttgaacctgggaggcagaggttgcagtgagccgagattgcgccattgcaacacggtctctca

SEQ ID NO: 562921 - DNA, 246 bp, Homo sapiens
cggataccccttggattgctcaggtcttcaatgccatgtcttgttcacattagtagacttcaccagcgggtgcgatcttgtgtaagtttgtgccggggcattgtggggaagaggtggtgctcaatctggaagttaaggtgtccactgaaccattcgttcaagaaggactgctccatgttgcacgttgctatcagctggctactgaaccagtcacggtaggcctcctggagacctgagcaagccagg

SEQ ID NO: 562922 - DNA, 546 bp, Homo sapiens
cccatagacatcaggctggagtcttctctgtgttgagaataataaaagctcattatttattttttaaaaaaaaaaaaaaaaaaaaaaaaaaaaaaaaaaaaaaaggggggggggcccaaaattttccccgggggggcccaagtttcgggtccccggtttttttgtacagaggggggcgcctaatgagagagtcgtatatttataagaggctgaaggacagcgggcgcgtggtttaaaaaaacagtgtcggtaagtgggaaaaaggagaaactgggggatattctggggaggagaggacatctataatttgctggggggagaacatcaagagggacaaattaacctctaagaggatattttaagaaggcctctatcgaggggtaagatataataaactatttttaaggggtggttattagggggtgttaaaacataagcgcggcatttatgagtggcaggattggaaaaagtttgggggctataggggagaattatgtatttttggtaaaaattattttatacacagaggaacatgagtaaaaaacc

SEQ ID NO: 562923 - DNA, 108 bp, Homo sapiens
ccttttagtgatttttccccaaaaccgagggatggatttacctttgcaattgggaaatttttctaactgaatcaattgttccatgaaaaataaatctttatcccccca

SEQ ID NO: 562924 - DNA, 516 bp, Homo sapiens
tgttgcgataactgacagtatctctgcaagtcctgtcaactttacatgctactgtctttaccattttatgctctcttgcattttttccgctttgtcttattcttctatagataatgctatataactcattatctttttatctcttctgttattattgttttaaaggaaagcatcctatgttcataggaaccaaaaaataatgatcggcagaagggggggaatagccacaggggacaaacctttaggcattatcagtgaccttatttctgcttttctgagctaataatggtgctgtatggttaagtccgagacttttgccacacactatatttgtgaaaattatacgagatgtggaatgagaacctcagtgatttctattccctagtgaggcctctgagggcctccacactgcctggcataacattccactgaactagtatgtgctagaggagggcacgaacatccgctccttccctaggcctgttggctctggttttctgtgcagatgattcattg

SEQ ID NO: 562925 - DNA, 902 bp, Homo sapiens
agaactcctaggctcaagcgatcttcctgcctccacctctggagtagctaggactataggtgcatgccattgtgcctggataattttttttttttacgtagaggaagagtcttgcgatgttgtcaaggcgggtcttgaactccgggcctcaagccatcctctggcctgggtctcacaaaaggctaggattataggtatgaaccacaggtgccgtggccaattcatagggtttaatgatcaagttacattaaatatcacctcgtatgggtatggatccttttagactagttcgtgtgtgaaacacttttggaactccgtgacaaagcacacataggggacgtacctctcttaaatttttatgccataagacattttcaacaaaagctccgggccataaccgttcttgtcttatacccattcacattgttctcccagacactaaaagaattcagtgagtgccaacgtggggaaatccgtggtttcaattatcaactcagtgtgggcacagtgactaagtgataaccagacggtctctaacaagtacgggcatgcagatttgcgccatctggtcatctactgcaggcaaagcggggtaaggccgtcacttttcaccacgaatacgggcagcaatggaggggctctcggaaaaacgagttaacggataccactccaatgtgcagcaatcgggccaaatggggcgccaaacaacaaagtaatataatacgacaagctccgacagagtacactactaccagcgggacgtccctgggaccaagtgagcggcacaaggacgccacataagagaagactatcatagactccaccaggccaacatggagggacaggggcaccacaggacggaaactggcaaccacgaagcgatacaggagaggcgcacagca

SEQ ID NO: 562926 - DNA, 577 bp, Homo sapiens
tccactagagtaggcataggtttggtcagaagctttcctacttaggtaggcagaagaaaccccatggctcccagacaagccacatcaagcagtatgagagagccactggatgccaggaagggctggatggcatgccacctccctcagtgacagaaacaagagacagtaaaactcatgctgaataagagttccagacagtccaaaaagataaagccgcagagttagaaccacagtggctgcctcttccactcttccaatatgtgaccgagggcagggaggggcacatgagtgctcagcatggaaaagacagtgactccctctgatctcttgtgactacctaggcaacacaaacaggtagtatcacttgtcagcgggtactctctggagcaggacggatgactatgcatttagtagcatggcccaaataggcacattgaagttaggtgtgtatattttcccttacatggactgagatgaaactaatacagagacatgattgaaagccacagtacttaccatttcatcaaacacgtctaagcagaagctataggcgtgttctctagtagccagctgccat

SEQ ID NO: 562927 - DNA, 957 bp, Homo sapiens
cttcccagcaagcccaccagattgctcgcctggcagaaggtagacaggcgtctctgagtgagggacaggactgatcttcccctgtgatgctgactccccagaaccacaccttgcccggcacctgccctgtgtgaaaggcaccatgctgggcacacaactgaatctcaacccaacagctcaccctggagtcagcctatctgggtccaaaacctggctggacaactcagtagctaggagagcccaggcatgttacctagcctatctgagcctcactctcttctctgtgaagtggcaatataagagggactacttcccagaagccacatgaagatctcagtgacagtggaaattggcatgtgcaaagtactccctacacgtcaggtgctgctgttattatccatctctaatacatattttccccattttgcaaatgaagaaactgaggttctaagaggtgagagggcccggcctgcacaactaggaaaaaaaagacagaagaaattaccctgcggctctttgggatgtcttcctacagaaatgcatcccctcccctgatgcacctcttcctttcatttatcatttcaacagtccatcatgctgagcctggaggcccaccttggagcccagtgtgggaagaaggggaaatactggggtctggaagccaggtaagacaggggttccaataccagttccccctactacaaactctccaggtccatattacctgggaaagttggtacttttgcccccctgtcttgacagatgataacaactggaggctcagctaatgacttgtgccccagtcccaggtgaggccgaaaaatctgtctccaggcagaacgggagtccgtcatgcaaagcggaaaagaagcagaaaccccaactggaagtatccgaagggagaggattggaacaacacacttctatattacatgatcaagaagtccagaagaattg

SEQ ID NO: 562928 - DNA, 497 bp, Homo sapiens
tcataaggatccttgctcccacttggttgcgtggggagggatgggacggacctttagtaccgattgatttttaaactaccatatttattggatctcagatagccggagatagtgtgcgtgtacttctattttatatacatctgagaaagaaaaaaatgtcgcagtaaactcacatgtcgctttgattagacgactggttcccaagtttagatcattaaacatatgaaaagtccttctacagacagccaggaaatactgtaggtgcataaattcactttgattaaaatcaaacactttaaattgtattcctcttttcatatcatgcattctcattttctcctctaaaatccatcttcttgtgtgtacacatttgtcctaacgcctgctctcaatcactttctagtcatgctgcgaatgcataaatagagagcctattcccattaacatggatacccacaggcagtgagaacccaaggtagttgaattgaaggggcagc

SEQ ID NO: 562929 - DNA, 247 bp, Homo sapiens
ggtgaacatgggatcccccgttgctggttacacacacagcctgatttggcaggctcggggtggaacatgagatgcccccgttgctggttacacacagagcctgatttggtagggtcggggtggagctgggatgcccccgttgctggttacacacacagcctgatttggtagggtcggggtggcgctgggatgcccccgattgctggttacacacacgagccatgatttggtagcggtcgggggtggc

SEQ ID NO: 562930 - DNA, 321 bp, Homo sapiens
ctgcacctacagaccatgctcatcactcacaatgtcctatctaggcccataccctacgaaacggcaggctccgcagatgaggctactgcatcacaacagcctccacaggcacagctccatcgttacaatggcctctatagacccagctactgcctcccagccttctctgcaggtcctgaactttctcaaggcgacctcaccaggcccagctcatgcttctgtgcagcctctccaggcccagctcctgcatggtggcggcccctcgaggcccagcctgtgcctgccgtcagcctctacaggcccaacgtctgcctcacagca

SEQ ID NO: 562931 - DNA, 1618 bp, Homo sapiens
gtgcctagccatcattccattcctcctccttcgcctctcataaaaagaaaatattgtgtacctgcaaacatatgctctgctatcagcattcagacacccaaacaccgaaatcatttagcagctcttactgctgtcagtaagcagatgatggcgtaaggggtttagaatttgatatgtgttttctaaagcatctctcaaaataggcattgtctatttcttgtttgttgcttgtgggaaatttttcgtcaagtgtacctgtacctaacccatgactaaaacttacctagatcttaatttctagatttaaaaagaagaaaaaagggatcaagtaaggaacagcgaagtaaagaatatctaagattaaaagtaggaatagctacaattacctagatttcaatttctgggttatttttagtgtgacaaagtaaagagtgtccaaaattacaaatctgagggataattcaaagatccttttttgttgtcattgttcctgggggaatatgtttcctgggggaaggagcatatctgactggtcccagggaagaaatgaagtagaactggtattgaagagatatctttctatgggaatccagcaaaaatactgggttccaagaacttgcttgcctggggaactcccagattctttaaaaaccttacatgtgaaatagcttaacataaatatataggtttagacatactgattgatgtttcagtgcctatttttatatgcatttatatcgctcaggtcatctattttccacttgttctattaagtcatggttttgcaaatggtcaccatttaaatataaggaagggacctattttgcttctttcatattcttcgacatttcctcaatgaaagaataaggaaagtttaggagtgagttacttagggtgtattctactctgaggatttcagttttactatagctgtatttaatcttatattaattgggcacttatattaatttagtgcctgtataatgttggcactgaaatggttctttagtgtgttgtgagaaaatttcaatgaagtcatttatagaaaactgtttttctcaagggaatttccctttccccttttcagaagtcagaggaaaaactggaattagagtatagagttagagataaagcgaaacgatggcagaatatgctgagacatttgctcaggggttaaaagacagggagtttatagaactcccttttctgcttgtcataaggttatctgttccttcttttggacatctctctagaggtgttcccaagctttgtatcacagattcttttatcgtgggggtcctaaactttaaccatttaaaaataaaaaccaagggttaccaaacaccttaatagagacttctctatgaagttacaagaagtaaacaaccatatggaagaatttgatgtgttctttgaagtcactgcttgtaagagaagacaacgtgtaatttttgagttactgtatgactcacgttggaaatgtttaaagccttctgtaggcatggtgtggtggctcacacctgtaataccagcactttgggaggccgaggcgggaggatcacttgcacttaggagtttgagaccagcctgggcaacataatgagactttgtctctaca

SEQ ID NO: 562932 - DNA, 493 bp, Homo sapiens
atgcttatccctctacgacatctcccctgctgtggtactgcccttgtcttcacagctcctcctccctcctctgcctgggtccgcccctgcaggaggaacttcctccgtgtccgaccgttccgccagctccccctgaccgccctgctgctctgttgctccttctggtgcagttttcctgccatggcctttctcttgggccagcctggggctcctccacctgtgctgtcggcctcactccggctgctcactggagtcctctgggcagccccattgccctcctggcttccgggccccttcttgtcgtgccagcctcttggatcattccttgagtgaccggctgagtgcctgcccatctgctgggggtgctgccgaggtgcatggaggtgtcctgggggcacggagaacaggcctgacgagaggaaggaggaacgtggcgtgccctggcatggaaaggccaggtgctggccagggtgtggcctgagcgtctgtgacg

SEQ ID NO: 562933 - DNA, 157 bp, Homo sapiens
acccgctcatctcatctaaaatcgcaatgcatcatttacaatatcgtaaatacaatacaaagaaagaactctgcatatttatggaaacattgttgatggtacagttctactgaaactcatacacatttcaccatttaatttacatatcgtcttgttg

SEQ ID NO: 562934 - DNA, 163 bp, Homo sapiens
  misc_feature (114)..(114): n is a, c, g, or t
ctactaaaaataaaagtcaggtgtgggggcaccccccttttgtcccaactaaccaggggggttaagccaaaatttctttaaacttgggaggtggagtttgcagcgagccggganatgccactgcactccagcttgggtgatacagcgagactccatctcaaaa

SEQ ID NO: 562935 - DNA, 384 bp, Homo sapiens
tagaggatcccctggccaggctctcgacctgggtcttcatccccctctatgggctggtatcccacgggggggtgattggctgggcacaggcttagcctcatggaacttccaacttgcaagggtttaatctggatccaaacccatataggagtctggatctcagaaacacagtatacggataattgccaggctggccgggggcaggaaacttcagctctacctcctcggtatcttgcagcgtacacacatgatatgggcagggatatgagggtcggctccttcctatcggcaaggtaaagccaccaccattctggttttccctcaggaaggtaagggctatacacgggaggtgtcatgtgggatgggtacccaatagagctctct

SEQ ID NO: 562936 - DNA, 1725 bp, Homo sapiens
  misc_feature (13)..(13): n is a, c, g, or t
ggagaaggggaantggggcgcttgaggggattataatttctttaaaaagaggggaggggagaggccatggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggcggcggtggcccagctgtagccccagtgctgctgacccccatgcaacaacgtatctgcaacctgctgggcgaggcaccatcatcagcctgcccagcaccacagagatccaccctgtggccctcggaccctcggccaccgcagccgcagccacggtcaccctgacacagatccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttactcaccatcaattaccaaggcccttgcatctccccagatcgtttcccaagtttggcgatttgctgtcggtgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacacaaaaaaaacaagaaaaacccgagtttcta

SEQ ID NO: 562937 - DNA, 955 bp, Homo sapiens
  misc_feature (17)..(17): n is a, c, g, or t
  misc_feature (420)..(420): n is a, c, g, or t
agcggcttttttttttncgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaangactgcaatggctgctgctaaggcacctacaaaggcagcacctaagcaaaagattgtgaagcctgtgaaagtttcagctccccgagttggtggaaaacgctaaactggcagattagatttttaattaaggatggcgttattcagaaacacagacgagaagaaaaaacacttgtgtggggcggtggagtctggaaacttaaaaacacattatgggactgggcccaatgtacggccaccgggccacgcgtgtccacagagaaacggggccaagaacaaggggcggaacacacgaaaaaacacagccgcgggggccggagggcctgaccaccccagtgggatcggggccaaggcggcataacacgggtcaggacattatcagcccagcgacgacaacaggaaaccgaagcgacgacaagaaagacgctagcaacccaacaagaaacaatagcgcaaacgaggccgagagagtaatcaataactacatacgaccaagagaaacaacgaacagacacaaagcagagaggaacacgagaca

SEQ ID NO: 562938 - DNA, 700 bp, Homo sapiens
  misc_feature (13)..(13): n is a, c, g, or t
ggagaaggggaantggggcgcttgaggggattataatttctttaaaaagaggggaggggagaggccatggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggcggcggtggcccagctgtagccccagtgctgctgacccccatgcaacaacgtatctgcaacctgctgggcgaggcaccatcatcagcctgcccagcaccacagagatccaccctgtggccctcggaccctcggccaccgcagccgcagccacggtcaccctgacacagagtgagtgacctctcctgcccaggcggcgtgcataagtgggaagggccagcaagctctggggtggcctgggaaggttggctgccaagggtcagaggtcagatgggggtcttggaagaccatgagg

SEQ ID NO: 562939 - DNA, 1202 bp, Homo sapiens
  misc_feature (9)..(9): n is a, c, g, or t
  misc_feature (139)..(139): n is a, c, g, or t
  misc_feature (457)..(457): n is a, c, g, or t
  misc_feature (471)..(471): n is a, c, g, or t
  misc_feature (475)..(475): n is a, c, g, or t
  misc_feature (529)..(529): n is a, c, g, or t
  misc_feature (648)..(648): n is a, c, g, or t
ttaggaacngggaaaaataaaggttggcctttttgtttgtttgtttgtttgtttttttcccccttcaacacaggcctcactctgtagcccagctggagtgcagtggcacaatcacggcttgctgcagcctcaacctccngggctcaagtgatcctcctgactcaggcccctaagtagctgggactacaggcaagcactaccaaacccagctaataggtattttagttgagatggtttcgccatgttgcccaggctggcctcaaactcctgagctcaagcgatccacctgctttagcaccccgaagtgttgggatgagcccctgcaccatgcctggttttgaaagttactatggttatctacattgataacattgagaaaagctgagtaaacactgtactgttactgagatcttttctgtgagtttctgttaggatgcatttcaggatcctacactgnacttggttgtgtcncatntcatccagtctgtgagggtatcttagtctttgtctttcattgtaaagatgggcnttaaatatttaagggtagtcacattaaaagattggcattaggaatgcagttaaattactaagaaagtgatctaagctacataaacaatctggatgtgagagatgggtaataatagggtnacaaaagttttgtggagtaatattgtgttatctttttacaggcacctacaaaggcagcacctaagcaaaagattgtgaagcctgtgaaagtttcagctccccgagttggtggaaaacgctaaactggcagattagatttttaattaaggatggcgttattcagaaacacagacgagaagaaaaaacacttgtgtggggcggtggagtctggaaacttaaaaacacattatgggactgggcccaatgtacggccaccgggccacgcgtgtccacagagaaacggggccaagaacaaggggcggaacacacgaaaaaacacagccgcgggggccggagggcctgaccaccccagtgggatcggggccaaggcggcataacacgggtcaggacattatcagcccagcgacgacaacaggaaaccgaagcgacgacaagaaagacgctagcaacccaacaagaaacaatagcgcaaacgaggccgagagagtaatcaataactacatacgaccaagagaaacaacgaacagacacaaagcagagaggaacacgagaca

SEQ ID NO: 562940 - DNA, 339 bp, Homo sapiens
ttttattttaattaaaaacttaatttttagaccaagtagaatgggaaagggggggctgataaatttaagattcaaaaaagtcccgtcgaaacttaaaggccagattattgctttggggctttttaaagggacaagccatcccgtggttaaaggttttcagggaaatttgaaaaaaagcccagggccctttaaaaacggtttttttttcgagtttttgcctcgggctttgacctggatggcattattattgtttatgggaagtaaaaaaaaaaaaggaaagcccaagcttttcctggaaattaaatttccatttcccttttaaaaaaaaaacaattttcc

SEQ ID NO: 562941 - DNA, 2844 bp, Homo sapiens
ggcacgaggccccacaggacttttcacagggcccggcttgtagtagacagccaggccatatttgttgaaaaaattgatgggaataatactgcccaagtgagacaacgattctggattctgttttcagtgtgggggatctttcatcagtccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttgtaagtgggtcctgtgattggccttggccttagaccggccacgtgcacagctccctctttaataaacgcttaggggttgcactgtttttgagaagaggaatttgttgggctcctgggacccaaactcatactccccctacttgagctgccttgctaagatccagaagattggttagcagggggtcacgtgtgcatgtgatgggacatgtgttgtcatgaccccgggcttgtgacatgacccagccttggtcttggacaactgtaaggaacaacacaacgggctgtcactgggggccgtcacccagcctgggtctctactgagctgcccaaccccaggtgccatcctttcgagtagggtaatgtcactgatgctggcagttgagcaataatatcttcctcctttgggaggtagtgtgactgaggaggaaaccccaccctttttctcctcactgtgcctcagttctcaggggactccaatgactgttgtgttctcccccgaccccaccccaggcacagcgcaggcccttgttaggtagtgtgctgggacgcctccgtaatacatgcagtgtgcagccagtctggctcaggaatgctgtgtatggtggggacggtttggccactctctggttttcaacagcatctctgggcagccctttggtggtttgtccctagagcttttgactcaggtcaagctttggatgctgtaaatttttgagaaagccaactagtgtggaagcttgctgccccactgcagtgggtctgagtgacctgttggctttgtgcggaggcttgcatccagccagttgtatttattctgtgtgtgaacccctcctaggaaggcctccaggaaggctgccctgtggccacacccatcctcctttcctctctgctgactccacatttccaaaattcagtgcaaaaaaagccctgctgagcatcacatgctggactcttcccctgccacaccgctcagtgccttctgttctcttgagactccctctgagtagctgagtgaatccaaagccataattgaccctgaacgtaggaggaggaaaaggcaaagctgacctaagaagtgggaccctggccgggcgaggtggctcaagtctgtaatcccagcgctttgggaggccgaggcgggtggatcacgaggtcaagagatcaagaccatcctggccaacatgatgaaaccccgtctctactaaaaacacaaaaattagctgggcgtggtggcacacgcctgtagtcccagctacccgggaggctgaggcaggagaatcgcttgaacccaggaggcggagattgcagtgagccgagattgcaccgctgcactccagcctggcgacagagcgagactctgtctcaaaaaaaaaacaaagaaaaaaccaaaaaaacaaatgggaccctttggattctatgctcagggaagagcaggcagagccttggagtgctgaaggaggtgctgttccctgttccatctttacactttctcttctgagatgtctgtaaggattttacccagatgccatttgtctgtttcattttcagactcaccatcaattaccaaggcccttgcatctccccagatcgtttcccaagtttggcgatttgctgtcggtgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacacaaaaaaaacaagaaaaacccgagtttcta

SEQ ID NO: 562942 - DNA, 422 bp, Homo sapiens
acagcatttagcagcagcatcacataatcagggtgctggtgataactatgggcataaatcctgaacagacgcttaagaatagtctgagccacagacataaagtcgtcgggaaatgggacaccacctcttagataggaaaaagagtttcatcatcaagctgatctagaacccaagtcatcaaatagtcaatgtattttggtgcagaacatatgattggctttgtaatattagtaccatctgcccagggatattcatatctcggacctgcagacatgactggacagcttgcttcagtgcagaattctgtaaatagtaccatataagcatgttgatctggttaaagaaagtccacagtgttcacagcaatccattcattgagatcctctccctcaggcaacataacagcttgtctcagattccca

SEQ ID NO: 562943 - DNA, 445 bp, Homo sapiens
  misc_feature (326)..(326): n is a, c, g, or t
  misc_feature (397)..(397): n is a, c, g, or t
tgttggttttactcaaggccacactggtagcatggctggtaacatctgtgtgaaggaactggattatttaagtgtgaaattcatcccaaaaatccatcccaaaagacagtcctggccaatccttaatagtcacccacctcaagtcagaatttcatttcctgttggtaaataatgtcatcgcatttaagaacagccttgatgcctaaaggaatgcatttcccattgattatctcctcaacactttcagcaagttccttccagcagcagagaacttcagcaacactgctggcttccttctttcaacttgcataatctgattgctcaangcactgatgaaaaatatgaagaagaagtaagtaggcttcgctcaaaggactattttaaaagtcaacaagantgatcttgggggctattgttcggaattgacatgattttagtgctgcag

SEQ ID NO: 562944 - DNA, 3273 bp, Homo sapiens
  misc_feature (13)..(13): n is a, c, g, or t
ggagaaggggaantggggcgcttgaggggattataatttctttaaaaagaggggaggggagaggccatggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggcggcggtggcccagctgtagccccagtgctgctgacccccatgcaacaacgtatctgcaacctgctgggcgaggcaccatcatcagcctgcccagcaccacagagatccaccctgtggccctcggaccctcggccaccgcagccgcagccacggtcaccctgacacagatccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttgtaagtgggtcctgtgattggccttggccttagaccggccacgtgcacagctccctctttaataaacgcttaggggttgcactgtttttgagaagaggaatttgttgggctcctgggacccaaactcatactccccctacttgagctgccttgctaagatccagaagattggttagcagggggtcacgtgtgcatgtgatgggacatgtgttgtcatgaccccgggcttgtgacatgacccagccttggtcttggacaactgtaaggaacaacacaacgggctgtcactgggggccgtcacccagcctgggtctctactgagctgcccaaccccaggtgccatcctttcgagtagggtaatgtcactgatgctggcagttgagcaataatatcttcctcctttgggaggtagtgtgactgaggaggaaaccccaccctttttctcctcactgtgcctcagttctcaggggactccaatgactgttgtgttctcccccgaccccaccccaggcacagcgcaggcccttgttaggtagtgtgctgggacgcctccgtaatacatgcagtgtgcagccagtctggctcaggaatgctgtgtatggtggggacggtttggccactctctggttttcaacagcatctctgggcagccctttggtggtttgtccctagagcttttgactcaggtcaagctttggatgctgtaaatttttgagaaagccaactagtgtggaagcttgctgccccactgcagtgggtctgagtgacctgttggctttgtgcggaggcttgcatccagccagttgtatttattctgtgtgtgaacccctcctaggaaggcctccaggaaggctgccctgtggccacacccatcctcctttcctctctgctgactccacatttccaaaattcagtgcaaaaaaagccctgctgagcatcacatgctggactcttcccctgccacaccgctcagtgccttctgttctcttgagactccctctgagtagctgagtgaatccaaagccataattgaccctgaacgtaggaggaggaaaaggcaaagctgacctaagaagtgggaccctggccgggcgaggtggctcaagtctgtaatcccagcgctttgggaggccgaggcgggtggatcacgaggtcaagagatcaagaccatcctggccaacatgatgaaaccccgtctctactaaaaacacaaaaattagctgggcgtggtggcacacgcctgtagtcccagctacccgggaggctgaggcaggagaatcgcttgaacccaggaggcggagattgcagtgagccgagattgcaccgctgcactccagcctggcgacagagcgagactctgtctcaaaaaaaaaacaaagaaaaaaccaaaaaaacaaatgggaccctttggattctatgctcagggaagagcaggcagagccttggagtgctgaaggaggtgctgttccctgttccatctttacactttctcttctgagatgtctgtaaggattttacccagatgccatttgtctgtttcattttcagactcaccatcaattaccaaggcccttgcatctccccagatcgtttcccaagtttggcgatttgctgtcggtgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacacaaaaaaaacaagaaaaacccgagtttcta

SEQ ID NO: 562945 - DNA, 2783 bp, Homo sapiens
ccggcaagctggcggaaggggcggcttccgggatgccccgcccctccgcgccccgcttcgccggccacgcccgggcgcacctgaagtccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttgtaagtgggtcctgtgattggccttggccttagaccggccacgtgcacagctccctctttaataaacgcttaggggttgcactgtttttgagaagaggaatttgttgggctcctgggacccaaactcatactccccctacttgagctgccttgctaagatccagaagattggttagcagggggtcacgtgtgcatgtgatgggacatgtgttgtcatgaccccgggcttgtgacatgacccagccttggtcttggacaactgtaaggaacaacacaacgggctgtcactgggggccgtcacccagcctgggtctctactgagctgcccaaccccaggtgccatcctttcgagtagggtaatgtcactgatgctggcagttgagcaataatatcttcctcctttgggaggtagtgtgactgaggaggaaaccccaccctttttctcctcactgtgcctcagttctcaggggactccaatgactgttgtgttctcccccgaccccaccccaggcacagcgcaggcccttgttaggtagtgtgctgggacgcctccgtaatacatgcagtgtgcagccagtctggctcaggaatgctgtgtatggtggggacggtttggccactctctggttttcaacagcatctctgggcagccctttggtggtttgtccctagagcttttgactcaggtcaagctttggatgctgtaaatttttgagaaagccaactagtgtggaagcttgctgccccactgcagtgggtctgagtgacctgttggctttgtgcggaggcttgcatccagccagttgtatttattctgtgtgtgaacccctcctaggaaggcctccaggaaggctgccctgtggccacacccatcctcctttcctctctgctgactccacatttccaaaattcagtgcaaaaaaagccctgctgagcatcacatgctggactcttcccctgccacaccgctcagtgccttctgttctcttgagactccctctgagtagctgagtgaatccaaagccataattgaccctgaacgtaggaggaggaaaaggcaaagctgacctaagaagtgggaccctggccgggcgaggtggctcaagtctgtaatcccagcgctttgggaggccgaggcgggtggatcacgaggtcaagagatcaagaccatcctggccaacatgatgaaaccccgtctctactaaaaacacaaaaattagctgggcgtggtggcacacgcctgtagtcccagctacccgggaggctgaggcaggagaatcgcttgaacccaggaggcggagattgcagtgagccgagattgcaccgctgcactccagcctggcgacagagcgagactctgtctcaaaaaaaaaacaaagaaaaaaccaaaaaaacaaatgggaccctttggattctatgctcagggaagagcaggcagagccttggagtgctgaaggaggtgctgttccctgttccatctttacactttctcttctgagatgtctgtaaggattttacccagatgccatttgtctgtttcattttcagactcaccatcaattaccaaggcccttgcatctccccagatcgtttcccaagtttggcgatttgctgtcggtgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacacaaaaaaaacaagaaaaacccgagtttcta

SEQ ID NO: 562946 - DNA, 541 bp, Homo sapiens
ggcagcttgcttacccgatgtagcacttggcagctctcagaggcagccttggtggtttcactgcttcatagttcagtgcccccagggtgagtgcagcatcagggatggacctgcccacgtgaaaccagagaggctggtctttggcagtggctgtgaattgttgccaccagccgtgtgtagacaaaagtcaagttggagtaagtggggagaggtctgtataatgcaatgcaagtttttatgacttgaattagttaaatctgcagcccaaaatttcatgaaaataaatatttaaaacattttattaaaaattaaattgacaaagtcatattagaaattagtatttcaattttcccaactctaagtatactggaataaattgccttaaagtgaaagagtgagagtgtatttagtaagtcttggttaagcctttttggtttacattcagaaacaagaagagaatgactgatgtaaaatgtcatgacctgcaagttaggtcgtttccaattctgctttcttcaacattgagttgttggccaggtgc

SEQ ID NO: 562947 - DNA, 1680 bp, Homo sapiens
  misc_feature (13)..(13): n is a, c, g, or t
ggagaaggggaantggggcgcttgaggggattataatttctttaaaaagaggggaggggagaggccatggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggcggcggtggcccagctgtagccccagtgctgctgacccccatgcaacaacgtatctgcaacctgctgggcgaggcaccatcatcagcctgcccagcaccacagagatccaccctgtggccctcggaccctcggccaccgcagccgcagccacggtcaccctgacacagatccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttactcaccatcaattaccaaggcccttgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacacaaaaaaaacaagaaaaacccgagtttcta

SEQ ID NO: 562948 - DNA, 270 bp, Homo sapiens
ttctaaagtgtttagatagttattataaaacgctctacatgctgtgtatgactatgagacgaatacaggcaacctgagacaatccatggttaacacaccatacacctttttatctgatctttaccttccagtccttgcatcatacttcagtgtataaatttggtatttggaatggattacgttcctcacccgcccatggtctctgtgcttgcacaaccagccaccagtaggtgtgccttctcctcggtagccagatcattctctggcacg

SEQ ID NO: 562949 - DNA, 330 bp, Homo sapiens
ggataatgatagggatacgatctaccagaatggggatatacacccgtggtctgagatgtaaaccaaagaatatcatgaacagcgttacaggcctcctgaagtatatctctcacatgtcctgttctcatgctgaggagcctgagatccctgtgtggggattagacaggggactgttatgggtgtaggtgaataggcttatttggtctgtccctgtctgaagtgtattgcaggaattaagaaaggaccaagaagaggaagaagaccaaggcccaccatgccccaggtaactgagcaattgtgaacagctacttctgggcacacattatggag

SEQ ID NO: 562950 - DNA, 126 bp, Homo sapiens
gctagtcacctctacaataggctcctctagctctggctctaactctagaacaaaaaccaatgggatattttaaaactaaactccacctactttccctcaacctgggagacccgcccatattcctca

SEQ ID NO: 562951 - DNA, 122 bp, Homo sapiens
tctgcccatcgcgggaaccactggcaggcctctatctcgaaggaggcctcttcccgataggtgccacacagtccggcacaggcgcgtgggcagcgatccaaagccaacccggtgtagaaggg

SEQ ID NO: 562952 - DNA, 1103 bp, Homo sapiens
gctgccgttttgtcgcctctcttgtttgtcgtcgttctttttctctttgctctatgtctctctgtgctctcgcttcgtttgtcttacttccttttgtgtgcgtcgttcgccctctaggacttgtgtgtgctcagtttctgcgcttctctttgtggttgagtgtcaccacagggtcctattggggctcacacccgtgggtttgggtatcggttttggatttcgctccattcgggatctcccttgtctgggtacatctgcgctaccccttttgtgtgtcttgagtggttctcatttcgcacatcatgggttttctctgggctgaaccaccggtaggattcctttgtctgatcggagttaatgtattgcaacaccttgcttgaccacgctattgctcatctggaatggagcccctggaggtctctgcggattcctgatgatgctctgatgggatcggggagttattcgccgtcaagcacacagcgcaacagtcggaatctcatgatgacaaattgctacattggattgccggccctccacttctgtgtgccacctgccctcatctcacattcatctccatgtgcggcgattgcaagatgaatgcttcgtataactcagagagtgatgtgatgaagctatatgtaacgcacgacacttacatctaattgcaagcaatcagattatacattcggtgccaacggggaaaagagcttctaccggattgctccccaaaacctctcattcacacaccccagatgatgaatctacttgtcttgagaatattgctagtacacattaggaagcaagtaggggctggcatctgaagctctgcatttccttcagctgatacaaccttgtgcaggaggccactagcatatttggaatgatgatgatcagagagaagctcctatttctcagggttgagcaaagtggtatatgatcaggcctgagcatgacctcaattatttcaccgtaaccccaggccactatcatatccagaatggtcttcagagttgtctttatatttaatattaagttatactcaactgtttaatttatagtaaagacatgaattaaggcgcgctgtagagtatccctcgagggta

SEQ ID NO: 562953 - DNA, 696 bp, Homo sapiens
gaggggggcagggatggaggggcggcgcggtcgcgcagcggaggcccccgggtgcagaagggcgccgcagaccgcgggggtaaaaaacggcggcgtggggcagaacccacggtaggacgaggaccctaccctcccgcgacgcgaaaacgggggagaagtcgtctcccaggccacaggggaggggtgcctgaaagcgccacaagtggagccccgactaaggtgggtcccaccgcgaagacacacgatctccctctcaaggggggatacgccggccgcactactctctgttgtgggggtcccacaatgccacccacaatgggggtttatccgacctccaattgttgtagatacatagaatacatcccccatgggtggtcagacccgcctatagttaagagagtctgccttcgtgttgttcaacgcgcggttaaggtgtcccaacggtcggtcggcgggctctgaaacccggggaaatacccgcgtcggggtggtttaatggaccctgctcgaaattctcgccccccggcgtcgtagagcgagcctcacacgaggagattataaggcggccattgtgcctcaaggcggcgcgcgtcccgccccgggtaggtgagagacacaacgtcgtgcagcggggcaggggtaagaccggccgcccgcgcgcgcccaggagcacacggggtgtgccacaaagacgga

SEQ ID NO: 562954 - DNA, 404 bp, Homo sapiens
gcgagcccttttctacgtctcatcactggccccagagattgcaactccacgcactattagatatcatctcacaccagttagacgggcaatcatgaaagagtcaggaaacagagcaggtgctggagaggatgtggagaaataggaacacttttacactgtatggtgggactgtaaactagatacaaccattgtggaagtcagtgtggagatacctcaaggatctagaactagaaatagcattatgaaccagacatcgccattactgggtatatacccaaaggaactataaactacatgctgctataaagatacatgcaacacgtatgtacgtagcggaattattcacaaataagcaaagacttggaaccaaaggcaaatgtccaatagagataagacgtagaaag

SEQ ID NO: 562955 - DNA, 771 bp, Homo sapiens
  misc_feature (49)..(49): n is a, c, g, or t
  misc_feature (52)..(52): n is a, c, g, or t
  misc_feature (55)..(55): n is a, c, g, or t
  misc_feature (90)..(91): n is a, c, g, or t
  misc_feature (93)..(93): n is a, c, g, or t
  misc_feature (101)..(101): n is a, c, g, or t
  misc_feature (108)..(109): n is a, c, g, or t
  misc_feature (117)..(117): n is a, c, g, or t
  misc_feature (121)..(121): n is a, c, g, or t
  misc_feature (164)..(164): n is a, c, g, or t
  misc_feature (175)..(175): n is a, c, g, or t
  misc_feature (185)..(186): n is a, c, g, or t
  misc_feature (190)..(190): n is a, c, g, or t
  misc_feature (208)..(208): n is a, c, g, or t
  misc_feature (221)..(221): n is a, c, g, or t
  misc_feature (229)..(229): n is a, c, g, or t
  misc_feature (237)..(237): n is a, c, g, or t
  misc_feature (249)..(249): n is a, c, g, or t
  misc_feature (265)..(265): n is a, c, g, or t
  misc_feature (296)..(296): n is a, c, g, or t
  misc_feature (307)..(308): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (336)..(336): n is a, c, g, or t
  misc_feature (340)..(340): n is a, c, g, or t
  misc_feature (345)..(345): n is a, c, g, or t
  misc_feature (349)..(349): n is a, c, g, or t
  misc_feature (351)..(351): n is a, c, g, or t
  misc_feature (358)..(358): n is a, c, g, or t
  misc_feature (367)..(367): n is a, c, g, or t
  misc_feature (385)..(385): n is a, c, g, or t
  misc_feature (391)..(392): n is a, c, g, or t
  misc_feature (397)..(397): n is a, c, g, or t
  misc_feature (403)..(404): n is a, c, g, or t
  misc_feature (407)..(407): n is a, c, g, or t
  misc_feature (422)..(422): n is a, c, g, or t
  misc_feature (473)..(473): n is a, c, g, or t
  misc_feature (531)..(531): n is a, c, g, or t
  misc_feature (539)..(539): n is a, c, g, or t
  misc_feature (541)..(541): n is a, c, g, or t
  misc_feature (544)..(544): n is a, c, g, or t
  misc_feature (640)..(640): n is a, c, g, or t
  misc_feature (695)..(695): n is a, c, g, or t
  misc_feature (697)..(697): n is a, c, g, or t
  misc_feature (722)..(722): n is a, c, g, or t
tcttattcaataaaaaagtggagatatttttattcccaggtatattgtnacntanagtctttcttctctactgtctgctttattctcttnntnttattttnttatttnnacctcctnggtnctctctgtacattttttctcctctatacaagtctgtaccatgncttctgctgtnatttcttctnntttnctcttcaacaaaatttanactgtgcccgatntccttgtntccctttncttgtaactacnaggccttctgctccgncttctccggctcctttcctccctgccgtggnttctgctgttnncctcctttctttcagancntnttttctntggnctatntttntnggttctngtttttttntcagaatcagaatggctncatttnntgttntccctnnaantttcgtgttttaagnacctgggcttttccttggctttttcccggttatggtgactgctagaaagtncttcatgaagctttctcttcttagacttgtacttctcttcagaatcactgttgttatnttcttaananttntttttctttcttttcttcctttgtatttttttttctttattgttactctcactctcactactgctttctgaagtctcagtagaggaagaggaggangaggaggaagatgaggaagaagaggacttatgttttttgtgtttacttctgctcntntgaaactttttcttttttctatctnttttcttttttttcttctccagtagatctaatttcctgagaagtttctg

SEQ ID NO: 562956 - DNA, 196 bp, Homo sapiens
gctgtaattaatttttgtaaagggctggtcacacgtggatgtggtttatgaatccatttgggatgattttgataaccagatcgccttttcagaaatttagatgtgaaccccaaaagaagcatcctctcaacaaaaattaatagctggttatagtttttttaaacctagaaaaaataaagttgatttttttcagtta

SEQ ID NO: 562957 - DNA, 139 bp, Homo sapiens
ggggaaggggaaggggcccccatacccaaccccccttcccccgggggtgggggttttttttaatacagggggccccccggttttcccccttgaaaagggggcgggggggcccccccattttttttgggttggtcccctt

SEQ ID NO: 562958 - DNA, 118 bp, Homo sapiens
atcagctcggacccttttgggtctcacctggcctgcttgcccctaggccataatttccctcctggattcctacagtccagtgggctgcctgatactccccaggttcagctgccaggtg

SEQ ID NO: 562959 - DNA, 164 bp, Homo sapiens
  misc_feature (131)..(132): n is a, c, g, or t
aagtgcactttgcagacgttcttcacatgctatacatgaggtttggagattaggagcttttacctcgtagcagagcagtattaacacctagttggtcacctggaaaacagagaggctggaccgtggggctnncatgcgtagcggtcacactgatgctggagaga

SEQ ID NO: 562960 - DNA, 1412 bp, Homo sapiens
gcgttcgccgcccgaacacagtgcgtcgcgaaggctagcacccatatgtggaccaatatttagggaaaggcactataactacatgatcaagcgaattgttagtaccatgtgatgaacactgctaaagttactagtactacgtccaacacatgtaacttgtgtccctctgcatctatttatttccggggtcctcgaatggactatcacccatgggaaactacattatagaatctaataggaccgctggacatgggtgaactgggatatgcgggcgtacctatctactggtagtagcctaggtgctgtatgagaattacactgagaaactctggcgtgcaaatgatctcaatcagcactgtgaatagtctcacttttgtagtcatactgtagacgacaccgagaccagatacattatgtggcatgtatccagttggcgtgtatctcagcgctataaattgaaacgtggtaatcaggcaacattgactaaactgtggtagcgaatgcgcacgtgactagcaccatgtgtctttggtgccactcgcttttcgtacggtctccacgtagcgatgctacttgtcagaaactatttcgagcatcgtgggctgttacctcgccaagccacctatggaacgaaaaccccggcataaagcattagacccctttttgggtcctgaattggcactctagtgaggtgctgacaaacattcaaactaaggcattagagtccgcgaagtttcactactagaaaacgctgtgaatattgcacagctcccatgtccaaaacgtcttgggcatttcgcacgtacaacggcggattcactgcagccgaacactaggggacaaccggggaatctcgagacgacttgggcactatttcaccaaaacaacttttgacctgaacagaccaacccggaagggacacatcgtcaattcctatgttaaccccaattctaaccagctgtggtgtcaaggagtcttggacccccactgtagtagacaatgctcactgtgcttccacgcttggccagacggaaaccagggtgtgaagccgcgtcacacccagtgccaaagaattggctcagacccacgcagacaaccgagcaaaggccaagagccgaccatgagcagtggcatacaaaaaaaggccagacactagagcggaaacgacccaggacccaatccaccccggcctcactgcagcgactttctacaacacatgggggtggacattggtcagccgagcccgacatgcgcggcgatagaccagcgctgaagcataacctgaccatagacgaacaaactcgagccatcacgcgtctcactcgaacaccagcaacactcagacacgagccatcacactccctcactcgtcacaaacactataccaatagataaaagtattaaacaccaaa

SEQ ID NO: 562961 - DNA, 171 bp, Homo sapiens
gggcaatcaggagtattctctagtaaccacaacgacattgcgatcaccataccttattattctagcgcttgagactgtcatgtcctaggcacagccctaagcctccttattcgagccgatctgggccagccaggcgaccttctgggtaacgaccacatctacaacgttatc

SEQ ID NO: 562962 - DNA, 128 bp, Homo sapiens
tagctaactcgggaggctaaggcaggaaaattgcttgagcctaggtcaaggctccagtgaactatgcccataccaatgtactatggctggggtgcacagggtccaccctgtctcccccaaataagcta

SEQ ID NO: 562963 - DNA, 238 bp, Homo sapiens
ttttttccccggggggggggccggggccttaaggggccagggggttttttcgcccacccccaagaaattttcccctacccccgggggggaaatatggggggaacctttttttttttttccgggccggggccaacccccccccaaaaacccttttttgggtacccagggaataattgtggtttatcccaaaccggtgggggctttccctttccttttttttatgggttggggcccatta

SEQ ID NO: 562964 - DNA, 86 bp, Homo sapiens
acggccgtgtattactgtgcgacgtcgtatagtgggagctacaaatatgactactggggccagggaaccctggtcaccgtctcctc

SEQ ID NO: 562965 - DNA, 95 bp, Homo sapiens
tggaagaaccagaactcgtggggcactggcgaagatgtgaaggttatattgaaaaattctcagggagaggaggttgctcaaagaagtacagtctt

SEQ ID NO: 562966 - DNA, 860 bp, Homo sapiens
  misc_feature (38)..(38): n is a, c, g, or t
  misc_feature (318)..(318): n is a, c, g, or t
  misc_feature (419)..(419): n is a, c, g, or t
agcggctctttccttgcctaacgcagccatggctcgtnggtcccaacgaagcatctgcaagcgggtggcagctccaaagcatgggatgcgtggataaattgatccggtgtgtttgctcctcgtccatccagccggtcccgcacaagttgagagagtgtctccccctcatcattttcctgaggaacagagttaagtatgccctgacaggagatgaagtaaagaagatttgcatgcggcggtgtcattaaaatcgatggtcaaggatccgaagcgtgatataaccctaccctagctggcattcagtggactgtcatcagncattgactaagacgggagagaatttccgtctgagtctatgacgaccaaggggtcgctttgcgtgtacatcgtattacacctgaggaggccaagtacaagtngtgcgaaagtgagaaagatcttgtgtgggcacaaacaggaatccctcatctggtgactcatggatgcccgtaccatccgatgaccccgatccccgtcagtcaagggtgaactgataccagttcagatgtgatgttagagacgtggcaagattactgatttcatcaagttcgacagtggtaacctgtgtatggtgactggaggtgctaacctaggaagaattggtgtgatcaccaacagagagaggcaccctggatcttagacgtggttcacgtgaaagaatgccaatggcaacagcttggccactcgactttccaacatgtttggtattggcaagggcaacaaaccatgggatttctcttccccgaggaaagggtatccgactcaacattgctgagagagagacaaagactggcggcaaacagagcagtggggtgaaatgg

SEQ ID NO: 562967 - DNA, 779 bp, Homo sapiens
ggaggcctgccacatgaagagcggggtctgcgggctgctgcctgatctcagacacggcaacgccttgtacagcagcaaccgttcgggatgacactgaagtgccattcttggatgcatgatcatgtgcccactggccagaagcacctgtgctggtcccatgccccgagccccgtgccgacccacaacatgcgcccgagcgtacgtgcctgtacacagcctgtgcttgctgtgctgtcctagtgccccacgatattgtccggacaatggacaaggtagttcaggccatcttccgctctggacacgcatatggaggaacccagtggccggactgagcctgcactgcgtgaccagcacacgacgcggaggatgcagcgaatcaggctgctgcagcctgcactggagacgcaattgcggcaacggcacgacatgcgcgatgtaacagcccgacttcgagggtcttcatgccaacagaaacgagggatggccaagacacgccccataggaggacagcgcggtgaacagggcccacgagcaagaggacaggacacgcggcaacccacaggggccaccaacagcaccactagggtcgcgagcacaagataacaaggtaggccccaagcgaaaacccgttggcggccaacaggatcccgacaaaccacgcgagaacgaacaagtgcgaagatcatacaccatagcggcccatagagccgaaaacgacccaaggcggcccaacaggggagaggcccccgagcaacctacagaaaagaaacaccccagga

SEQ ID NO: 562968 - DNA, 815 bp, Homo sapiens
  misc_feature (656)..(656): n is a, c, g, or t
ggcacatgaacatggcggttggtgtagggacggattgctccgagcgtcggtctgcccgaacatgtgagtgccattccttggtggcatttctgccactgaagaccctcaggcctgctgcgatgttggaaagaacagagcatagacataaatctactatgtgttctggtatccatgtctaagcaaaaaattattgcagcatccagttcctctaggtgccatgctagccatgcttgtcaccgcagcatgcaccctatttgagagggtacggccggtgtcaatggagagtctcaagagaccgtaggccttgatgacgttctaaggggaaatatgttggatgacttggcttggtagggccttagggattatgcaggctttgtgtgtcctacagaaactcgttgtcttttgaggtgacaagaagttaatcgaattttcaagatgtgtagctgtgaagtttgtcgctagatctcagtgggattcccagtttataccagtttttgccggggtaaactacaacctaagaaggaatggtgggtgtgtggggtcaacaattggtaacattcgcatgttcttgtctagactttaaccataatgctaagattattccctgatgacttactggtgttgctcgtgcagaccggttccatggtcgtatgctntcaatgcatggtcttctctccattaatttgatccacacattgagtcgtcgaagcatttgcgagcgtctgtggaatctctccagatggggccgaaggcgttgggaatgaaacccactcccggatctgggtgaagggcggttccaaggtatgttagaaagg

SEQ ID NO: 562969 - DNA, 195 bp, Homo sapiens
ccccgcagtaaggagcctgtacacagtcactcgcttcttctggcctattctccatgctcgctcccgggcctgcgtgtccgtgcttgggttccagtctgagtcatagatgacaactctgtttgcccccgtacaggttgacaccgtaagccgcccacccgctgtggccaagaaggacgggtaccgcagctcgacatt

SEQ ID NO: 562970 - DNA, 306 bp, Homo sapiens
acgagactcccgcttcagcctaccacggtgctgggattacaggcgtgcaccaccatgcctggtctaaatataaaaatcatttgtatacagaaaatttgtttccaatgttggttacaaacatgttccgaattcaccatttcatcatttgaaggttgagagaagtaaaggccacctgactcctcactcgactgatccgtgtatcaacactaatataaattatcatctgtcgataagtagtctaactctgccaatactcatcaaacagtttgctggtttaactgtattagaaagattactgtttttcta

SEQ ID NO: 562971 - DNA, 1232 bp, Homo sapiens
ggaccagggcgggacctggggcgggggacgggacttaaataaaggcagacgctgtttttctaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagacagagacaggacgcgcggcgcgcggcgcaggacgaacagcgaggagaggaagtcgcacaggtcaaaacaccgcacggcggcggacgcgggaggcgccgacgcggcagcgagagacaagaacggcgcgcccgtcagctggcgagcagggagggccccgggcgagggggggagaggcggaaacgagccgtggagcgcacgtcagccgagaggggaaagaagacacagggaagggcgggggcggcagaagggcagacggggggagggcaaacaaccggacgcgcgaggaggaggtcgcggggagggtgcgaatgggagacgaggagagaagcaacgggcagagggcagccgcgcagagcgagcggaggacgaaaagacgaagaagaggcggccgcagcggcgggcataaaagacggcgaagggcggggacggcaagagaaagagagcggacaaagcgacggaagcagagaaggaacgacagaaaggcggagaggaggcggccgagaagggcaaggaggcagaggagaatagcaaaacgaacgcaccggcaaggaggcgagcgaaggcaagacagagaacggagacaagagaaacaaaagaacgtgaaagggaagaggaagagaaagagagagaaagagagaaaagaacacaggagaaacgagaggaagagacgaagaaaggacagccggacgggagagaggaagaggcgagggaccaaaggcacaagggaagagcggacaaggagagagaaggcgaggaggcgaggggacagagagtaagggagagggagcaggagagaaaagaggaagacgggaggacgcgagacggagaggaaccgaggcacggagcgaggcagcgaagaggacgggagcggcacgggggggaggaacgaggaaggagagaagggaaccgaaggaggaaggcgcgggcagagacggaggcgggagagagcggacaggagggacaagaaggcggcaagagacgacgaacgcgagagaaaggcaagggaacgagaaaaagcgcggagcagggatgagcgaagaagagcgagggggacgag

SEQ ID NO: 562972 - DNA, 148 bp, Homo sapiens
cgccactctgggcgggggtccgttcgttctcctagtgagatcaaacgcagtcgacgcagataaaactggccgtcgcgctcctcagctagctgagaacgtcccttgacgagaaagcacgacgcacaggtaaattcgccggactgacgag

SEQ ID NO: 562973 - DNA, 267 bp, Homo sapiens
aaaaatgaatcagggtcatgccttaaaaaaaaaacttttgttaaagtattcccctgaaatcccaaatatttgtgggtattataacaatcattggaaagcatggagagctccctttcataatttgagggaaaatttttaacaaatgccaaaaagcttgtttatgggaatgctgtgtttctttttaattatttgtggttccaaacaattattttttgaactcttttaattttggactaaaatctataataaagcttttccccagcttta

SEQ ID NO: 562974 - DNA, 169 bp, Homo sapiens
atgttgacagctgtctcctgcttgtcccctgtcagcatccagatcttgatgcccggtttgtgaagagcttctatagattcagggactccctcctgcagacggtcttcaatgccagtagcaccaagtaatgtaagttagttctccaaactcatggcagattcaagtagta

SEQ ID NO: 562975 - DNA, 201 bp, Homo sapiens
  misc_feature (16)..(16): n is a, c, g, or t
  misc_feature (78)..(78): n is a, c, g, or t
  misc_feature (93)..(93): n is a, c, g, or t
  misc_feature (95)..(95): n is a, c, g, or t
  misc_feature (124)..(124): n is a, c, g, or t
  misc_feature (131)..(131): n is a, c, g, or t
  misc_feature (148)..(148): n is a, c, g, or t
  misc_feature (176)..(177): n is a, c, g, or t
  misc_feature (181)..(182): n is a, c, g, or t
  misc_feature (201)..(201): n is a, c, g, or t
ttttcctcaaatagangtgaaagaagtgaccttttattgacagatgattagcagtaataaggctattgtatgtaacgngcatccccaaaaatncnttcctcactaccattcagtgtcaaaaggnggatttnaaagctgttctctcgtnaagctttcctgagcatgtcttagtaaanncccnnattctctttagcaccctcn

SEQ ID NO: 562976 - DNA, 384 bp, Homo sapiens
tggttatagctcagcattggccttatttgaacgagatttgaacagttggccccctttgattggccgaaactcagtgattggcccaagagtaggttgcagtctgtttacccatccttttaggttatagttccccatgtacagagaaattttaggccaaacttaaaatatgtaaggaggcagctttaggctaaacttgttttaacagcccccaataccccctccctttagtgagcccatttgcccattccaattttaatgacagctccttagaattttttatcaacgaagaccctaacaaagaatggggcattcctccttctcctttttgaggatgccctaccctgtaacaaagtcgtttttaataaatttgcttctttccccata

SEQ ID NO: 562977 - DNA, 838 bp, Homo sapiens
gccctggtcgcacccgtgcaatccagcctcagcaacagaacaagggcctgtttccaaaccaaggaggtaaaaaaggggaaaccatgactccaaaaaaaaaaaaaaaaggtgaaatacgtgtaaattgacaaaacatatgcaatatttctatactaaaaactacaacgttagtgaagaaattaaagaagagcaaaataaatggagaagcacatatcgtcacattcatggattgtaagaatcaatgtaaaaaatgatattaattttccctaaattgatacacagtttaagtgcagttcctatcaaaatccctgcaagatgttttgtagctataaataagattatcccaaaatatatggaaagacaaaagaaccagaataatacataaaataattttgaaaaagaaagataaagtgggagaaatcattctattcaaatttgagactactgactattataatcaagactgtaggatttgatagatgaacagacacagaaaatagaatagaacagagaactcagaaattgcctcacaaatatgccagctgattttcgacaaaggtacaaaaacaattcaaaggaagaaggatcaccctttaatcaccctgtactggcctgactggatatccatagctctgacacccgcccccctgccccctccccgctgccaaatgaacttcagcttaaacttcacacctcattaaaacttaatctcaaatggatgacagacatcaatgtaaaaattaaaaccataaaacttttagaagatattgtaggagaaaattgtgaggtactaggaaaagttgacgagttcttagaaatgaaataaaacccaaaatcc

SEQ ID NO: 562978 - DNA, 829 bp, Homo sapiens
tccggggggcccccccttttttttcccaacaaaaaaaaacccgggtttaaaacctatttttaaaaaataccccgcgcgtggagaggataaaaaatcttgtgcgccccctcctcctcccccccccccccccatcttctttgtgtcctcctctctcgctcgccgggagtatcatctcctctttgtggtggcgcccccctctctgcagaagacgtctagtgagcaggtggggtgtgtcctgcccccgccgtgtgagtcgaaaggagtgataaagcagtcgccggcgcgtgtgagggtgagagtgccgcccgagatggtgtctacacacactcctccagagagttggttctctgaaaaacacactcctctgatcacgccagagagagagagagggcggcgcgcccgctctccaccgcaccctctgatgatgcacgtctgtggtgggtctctctatatacacccacccgagttggtgcgtgtgaaagagagagtgaccagcaatgtgacggggggtgtgcttaataaagatagagagagttaagacgtgaagtgatgtgatgagcgtagacgagtattatctatcccgcgcaagacgagatgaggtgtcatctctctcactatctataagctgcagcgtgaagatagaacccagcattgaaggagagatagtgtcgctaccctgctcagctcaacccgacgatgtgtgttgggagagtgattttattctctctcctagtcaagaaccgaagggagtcgaattatagttttctctctccgaggtaagaaacaatgaggtggtgcaaacgaaaacgaagagagatcattaagagat

SEQ ID NO: 562979 - DNA, 745 bp, Homo sapiens
catgcccagtgccagcagagtctgttgctgcctgggcagatgctggaattgcctgcatggattgtctttcggtggggccgcggcgtcgcggacgcctgtatcacttgagggcatgcgggcttcacggccgtgctaacagtggactcggaggagcccacgcttcaaggcgggtgcctgtggtctgaggatctatggcgcctcttcgtgccagcgctggcacaatatcgccgatagcggacctatctcatccatctggaccgttgcggtggtccttcatctgcgtcaggctccgcgctgagggccgtgcggtgtagtgtgcatctgtcagttgcacgtgagtcacgtcgaaggtgtggcctattaataatctgcctttatctcaatgataggactgacctaagcttccctttgaaatagagcctatgaagacatgctccacgatttcgtcaccaccagaggctaacgatgaattgaagggtggttggagtggccaaccatgataaattatacccagcgcagatggagatacgaacgttgtagtacctctagatgcagactttataaggcaatatcgtttacaaaaagtgatacggcatcaagtatccagacattgcagactttacctcaagaactcttggctgttgacccaaactatcggtttcacagggattgatggatgcggttctctacaagtgtcgcaagtgccatgtgaacataatttcgaagtctagtatctggttcacgt

SEQ ID NO: 562980 - DNA, 94 bp, Homo sapiens
tatttttttaaaaagtatttcccaagaatggaacaaatttacttatccagttaaacctttgaaaaaaaaaacctccttttattgttttttttca

SEQ ID NO: 562981 - DNA, 622 bp, Homo sapiens
  misc_feature (522)..(522): n is a, c, g, or t
gcgatgacagtttccagtaaactccgcggcctgctgatgcagcagctgagaggtaccagccagctgtacttcaacatcagccttcgatctctgagctcctctgcacaagaggcctccaagagagcccccgaggaagtctcagaccacaactatgagtctattcaagtcacaagtgcccagaagcatgttctccacgtgcagctaaaccggccagagaagaggaatgccatgaacagggctttctggagggagttggtggaatgcttccaaaagatatccaaagactcggactgccgggctgttgtagtctccggtgcaggaaagatgttcacttcaggtattgacctcatggacatggcctccgaactcatgcagccctcaggagatgatgcggcccgatagcctggtacctccgtgacctcatcagcaagtaccagaagaccttcactgtcattgagaagtgccccaagccagtgattgctgccattcacggaggctgcattggcggaggtgtggacctcngtttctgcctgtgacattccgctactgcactcaggatgcttttttcccagatcaaggaggtagataatgggcttggctgctgatgtaggaacactgcaga

SEQ ID NO: 562982 - DNA, 376 bp, Homo sapiens
ctcgttggatcataaagtctgaagcccaaataagggtggtctttcatgcctcaggtatgttacctcacttgttatcaaattctagttgaaacatgtaaccattcatattatcggtccagaagacatgatttaccatgatgcgatcagtccgaaagggtggttcaactctctcccatctgtaaactactcttcctgtgagtcccattcacaaaatactttcttcaatatgatcgttataggcatcacaccagtattatgtgttggtgtgaaagtccatgagtttaaaccatttggtcacagcatctttgaggtcacggagaatctgccgattgaatccatccatcctggccttttccatccttcccacgccgtcgtc

SEQ ID NO: 562983 - DNA, 675 bp, Homo sapiens
  misc_feature (326)..(326): n is a, c, g, or t
  misc_feature (482)..(482): n is a, c, g, or t
  misc_feature (489)..(489): n is a, c, g, or t
gctctgcacaggtgtacccatgtagcgggctgcatggttctagaggttgtgggcatgatggacagtctcccactcagtaatgtgctggagttcctacaaggagcctctggcccatggctcccgtctgctgggagagaccctggcagcctcgtccacttacacagggcttgtgaggacgagtggttctgtgaagatgaccgcgatccgcatagaaagggccgattctgtgtacgtgctctgcgtccaccatccttgtgtgccgcgatcatgtactcttgagatgcgaaggctggcaaggcgacaaggtacgatctcgtccaggaggnagaccctcgaagggggggggaccttttttgcggtgagaggaccctggctttgtccagaccagtggattcgacaactgcgatgtattgagagagcggaggacagcggacgcgtgctaaaaaggggtcttgcacaggagacaccacgacccagaattnaaccccngtttcgccacattgtgtgaacccatgagcggtggcattgtggtgatcgggaagagccgtgcaattcgaagggtcatactccattgcaaacgaccgctcttagttgtctgcgtcacgagctcgtcacctctagcagcgaaaactcggtgactacgcaggagcggcgcaggactggtatagcgggtgg

SEQ ID NO: 562984 - DNA, 607 bp, Homo sapiens
agagccgcatgtatatgaggggtacttggtctcacactttatgcctgtgtgacatgggttttcgaggtgaatcttatgtaagtttaagccagtagtggtggcgactgtacatctatcgacatggtgaggtagagcactgtttgggagggaaacgacgttgaactcccatttggtgacagtagtagctgtgaggtgctgccagaagctactgctagcatgaagataggaggagactgtaggaaatacaagataggaacaggtctccactgaaatgttaactctttctctctaaacggccatccaggcctcaatgtctgcagtttctgatctgtgagttatgagcttagtccaaatcttacagtttcttaaagagatagtcatagatgaagggaatcacagtgtgatagattattatggtgagcattaggtggcttgaatgtgctggaatgtactggtaaagctgttataatagggcagaagcgtgtggaggcaaaatataaatgcttgctcaaagtgctgtgtaggctcttatgagggttaatttgattgggacctgtagttaattggcttatggctgctataactaacaaattagcacaaacttggt

SEQ ID NO: 562985 - DNA, 602 bp, Homo sapiens
atagtatgccacaaactggcaattcttcaagtttactaaggaaaaaggccctaatttctgcaaagtcctttgtctttggaagttcattacacctggtacacactgtaaatcagacttgtgtaacaggccttttgacagacaaatcatttgggatttgtaggggccatcttcatgccttaaataggactaagcaacgaatttcccatttggtaactctagatttcttctcctgaaagttcaagctgaagtcaggttttatggacaagtgacacttaggcccagtttgtaaacagatataatttccaggaatcgtgttttttttttttcatagtcaacatttatgcagctagtattattatatttatgcagttatttatgtgattaaatggatgatttagatttcattagaaccgtgtggtgtgcccatgatattggagaataacttcatatatattattcggagagataggttatagatggaaggacataatctatacaacatgactactggcactttaatatctcttggggggaaacttgaggctctctaaggcagcattggtatctggtctttgaatcgtatgaatcttcgagagcatata

SEQ ID NO: 562986 - DNA, 1800 bp, Homo sapiens
  misc_feature (135)..(135): n is a, c, g, or t
  misc_feature (184)..(184): n is a, c, g, or t
  misc_feature (284)..(284): n is a, c, g, or t
  misc_feature (460)..(460): n is a, c, g, or t
  misc_feature (1023)..(1023): n is a, c, g, or t
  misc_feature (1086)..(1086): n is a, c, g, or t
cgtccgacccagaagactactgcagggtcaggggcccacaggtcacgaagtcgagatgggcctggtagagggcatcctactcgcttcgtgcactcacgcagagtagtaactcgagattggaaattagacaagtcncatcatggttgccatgcctcggaccagtgccgttggctgagttgccatngtcgtactagacgtgcatgcggacggcgcggaatgctcggcatgcatgttatgcgctctagcaactgtactggtcggacacgtactgatcaaagcggtcnacggtacggagaaagcacctcggcgtggtgcacacggaagcgtgtggcagtgtccgcaagtggagtaaatcctaatagaagagacgccttttagttagcatcgcgccgtgaacaagatgtcatttaccgtaggacacgcgtagtatggtggcgcacacgggtgtaggttgttccantgaggggccttggctattgcaagtccaacgagtgacgatttttataggatctgtgagtgtgaacggtcgcttgctttcgcgtgaagctaaaaagtccatatgtagatagcctagtattagcgggttgccaccaacgcataactagaagcaagtacaagcaatgttagcatccacgcagctcgatactggacacacaaatagcaagtgagttcagttgggcggaaaacccaggggacacatgttgaggaataagctcagaagcattcttgcgagtgtacgaatattagggccagaggattgctcgtgagagttgtagctaagaccctctgtagccgggagctgatattagaggaccttgcgaattgtgccagaatccgggcaacgagaaggggtgccgcgttttctcttccccccctcggtttgggccgggggcaaaactaatctcctgtacctttgccaatggttatgggtgtcggtcgagggccattaggcctttactttgccaaaggagaatcccatttttcttacctataggcccccatgtttttggccttcgggaggcnccggggtatggcacacaaggtgtgataccgagataacgaaaactttgtagagcgggttgttcncaccagtcccatttgggaccgtaggagggacaaataggacaaaggactttggcggtggggatcttgcgtaggacgaaaggctttagcggagtaggaaatgggaattccccccaggagatcaagagactgttggagagttggaaagtttaccgcaagggaaggggacgccgaatgggcaaccgcaattggtgggggaccaagagacggggttgtaaacggggttaaaatgggtttgaatgtaaactgattgcgggtcgtcaaacgggattgaagacgtgatggggggagacaggaaaatagattgacccaaaagtggtttggggtgttcaatagacaaaaagggggggagggaaaggagggagcccccgagacatgtgatcgtggaccgttgagttaatgaacaaacacgaggcagggatagtatgaaaggtgtggtgaaagaaaaaactccctatagatgggtgagtaagaagaaggtgagcatccaattcatgaacatagaggaggagggggataaacacaggtgagcgatgtgatggcgaccaacagaaggcgagacgactcagaaaagaatcatagtgaagaagatgatggtgggagcaatttagataagggagatgagagaagaaggttggaacgaataacgaagcggcggaggagaacaacttgtgtgttgaacaagagaggtggatgaatgaatgtgaagaagagaca

SEQ ID NO: 562987 - DNA, 424 bp, Homo sapiens
tcggtacgaggtggccctgggggaggccatgacttgaccgccatctgtgatgcctctgagcttgtgccggtctgccagtgtaactgcagccttggatgaggagcttgcagcaaaagcccaacatcaacgcagccacgctagagaaagtcatcgagatcagagtaaacactggagctgtgtgcagaagtcgcgctggctgggcggtccctgcgagaggccaagcaggtgagaccgaggaggccgagactgtgagcgccatggccttgctgtcggtgggggccgagcacatggtctgcggcacgccgggaacacagccccaggccggcagaggagcccatggagcaggagcctgcccatgtgacgccccggcccccatccctcttggcttcaccattgtgattttgtttattttttctattaaaaa

SEQ ID NO: 562988 - DNA, 273 bp, Homo sapiens
  misc_feature (60)..(61): n is a, c, g, or t
atttgggagtttttttgtagataatggggtttcgccatgttgcccaggatggtgaactcnngggtagattgcctgaggtcaggagttttgagaccagcctggccaacatggcaaaaccttgtgtctactaaaaatacaaaaattagccaggcacggctgggcacggtggctcaatcccagcactttgggaggctgagacaggcggatcatgaggtcagaagatggagaccatcctggctcatatggtgaaaccccatctctactagaaaatgt

SEQ ID NO: 562989 - DNA, 405 bp, Homo sapiens
actacctagacctgaatcaacaggaaacactacaaattaccacaccaaagtaacaaaaggaccagcactactccctttgcaaatcccccaccctttacttgtgtggcagatgaaaaattgaaattatgtctgatagctcccttcccacaaccaatcagtaaggctgtggagccaaatcttcatttgcatagaagtataactatgtaacttcactgcagcctctgattggttgcttatccacaatcagatgtctgcatagggtgtagctatagtaacttcagcctctgataggtcccctcctgcaaccaatcagactaataatgagccactacttcatttacacagggcatacaccaagtaaccaatgggaaatctctaaagggtatcaaaaccccagacacttct

SEQ ID NO: 562990 - DNA, 482 bp, Homo sapiens
tccgtttttcttgttactcttggagctgctcttcttggtcctggtggattgtgggcatatgggcaaatacaacgcctttctaagaaaccaaagaaggctcctaaggttgagctcgggaccaagactgttgatacttccatggatgaagggttacagggaactgcttatgctcattcattgtctaacaaatctaagaagaaaaagtagacatctctttctatgatttttccccttttgttttctagttattacgttcctagttagagggaaaattgcaggaaagttcaacctgttgtaactcatactatacgttcatgatgatcaggagagtttagatgctgaggtagtttgtgcaaatttagccatgaaaagggcttgcctggtttttttgtagaatgtaaaagaagattttgagtttctatttaatcttgttatagagctgttagtgctataaattgacaaagagaaaccttttgctaaaa

SEQ ID NO: 562991 - DNA, 366 bp, Homo sapiens
  misc_feature (338)..(338): n is a, c, g, or t
  misc_feature (353)..(353): n is a, c, g, or t
ctcaggtttgaatacagtggcatgatcacggctcacctgcagccttgacctcctggacccaggccatccccctgcctgagcctcctgagtggctgggactacaggcacatgccaccatgcctggctgatttgtaaattttttgtagggatggaattctcactttgttacccaggctggtctcgaactcctgggctcaagtgatcctctcacctcgtgcttctaaagtgctgggattacaggtgtaagctactgcacctggctgatttatttttttaagtataaaatatgtctgatccctgggtgtctccaaatctagtaatttctatacatttaaagncaattttaattttcntggttttttgaaa

SEQ ID NO: 562992 - DNA, 148 bp, Homo sapiens
ggtgggacagctcagtaggatcagatgaaaggaagtttctgaggcagtgggctcgacgccagtagcctcctcgggtacacagggccacacagtgaccaccgcgggaccagtgactggtgagcagcccagtacgcaaagttccagcggc

SEQ ID NO: 562993 - DNA, 262 bp, Homo sapiens
  misc_feature (1)..(1): n is a, c, g, or t
ngactctagtggaccccgctccacccgacggggggggagatgaggcctgccccctaaccccttttttgccaaatgggccattatcgaagaatcagcgaaaaacaatagcctcatcatccccaccatcatagccaccatcaccctccgtaacctctacttctacctacgcctaatctactccacctaatacactactcccatatactaacacgtaaaaataaaatgacagttgacgtgcaaaacccaccccgcgggggagcgg

SEQ ID NO: 562994 - DNA, 444 bp, Homo sapiens
  misc_feature (36)..(36): n is a, c, g, or t
  misc_feature (61)..(61): n is a, c, g, or t
  misc_feature (182)..(182): n is a, c, g, or t
gtcttcctcaaccttgtgtcccttactgaaataaantctggttccttttgccactccatancccaatatggttagctgaacccctgccctcctcacatgcctgttgttacatacccttagcctggtgattaattttccttgttttccccaagtcaataaaaagattgcagacccaggcacgngtgtcacgcctgaaatcccagcactttgggaggccaaggcaggcggatcacttgagctcaggagttcaagtccagcctgggcagcatggtgaaaccgtgtctctacaaaaactacaaaaattagccaggcatggtggcatgtgcctgtaatctcagctacttgagaggctgaggtgggaggatcaattgagcccacgaggttgaggctgtagtgagctgtgatggtaccactgcactccagcctgtgtgacagagcaagatc

SEQ ID NO: 562995 - DNA, 86 bp, Homo sapiens
ttcccgggttcatggtaataaaaaattcaatgtcatccaaaatgtggtttaagatttgcacatctcagttaatggggtccgcacaa

SEQ ID NO: 562996 - DNA, 433 bp, Homo sapiens
caaaaaaaaaaaaaaaaaaaaaaactctcaaacctaactctgaagaaacaacctcagtagtaacttgcaagtacctttaaagcttgcaatcataaaataaggctctaaagactagtttcaaatttccaaaagtggccgggcacagtggctcatgcctgtaatcccagtactttgggaggccaaggtggaaagatcacttgaggtcaggagttcgagatcagcctggccaacatgttgaaaccctgtctctactaaaaaaaaaaaaaaaaaaaaaaaaaaaattggccaggcatggtggcgtgcacctgtggtcccaactacttggtggactgaggtggaaaaatcacctgaacccagggaggttgaggctgcagtgagctgtgatcatgccactgcaatgtagccttgatgacagagtgaaccctatctcagg

SEQ ID NO: 562997 - DNA, 323 bp, Homo sapiens
accacaagtgtctgagctgccctcggatttcaggagcgcgagcctgcacatggagaagcacggctgcagcctgcatccccgctctgcacccggcctacgccgacagcgtccccacctgcgtcattgccaaggtgctggagaagccagaccccgccagcctgtcctcccgcctgccgtaggtctggctgcactgcagcagctgggccgctagattgcagtccttcctatagagctcgttgtcctctgacagcttgtcgatggtcaccttggcttctagcagatggctgttgagggcaacaatctcgtccccacagagagagcgt

SEQ ID NO: 562998 - DNA, 89 bp, Homo sapiens
aaaaaaaaatttttttttttaaaaaaaccttttgttacaaaaggagggcttttttttcccaagggaaaaattatggcctttttttttga

SEQ ID NO: 562999 - DNA, 640 bp, Homo sapiens
gagagtgaggactatacaatttctgcacaacctactcaggcgctgtagacactaaagcagactacagacacttgaactataacatatctaacatgcactaaacctggttcgtagttacagctaaatttgcacataaggattatgttagccaaccatatgagttgacctacgttagacccaggtacttctgaagcgtgtaactagtgaaagagtacctcatattcagacaagatattaagtcatgtatcatccatgaagtattggtaacctcgtacaacatgtgagattagtgtcgcatagtgaaaagactctcaaaccctgatttcagtccataagcaatacactgaataccgaaaggtcataaaatgacaagtattgggtcatgggacgaaggtcacgattcagctcacattccactggccaagcaaatcccctgactaaggtggaagtctgtggggccaggaagaattcttctcttataggaaggcactgcaactcacatgacagtaagtgcagccatataatcttcttacaggtaagaataattacaggtagtgaataattaggaaaattactataatatacagttcagtccatctgactctaaatttcttgcctaaatgctaaggagatttgttgg

SEQ ID NO: 563000 - DNA, 580 bp, Homo sapiens
tgatgttggagtgggccctggtgggaggtgttcgggtcgtgggagcagatccctcatgaatggcttgggccatcctcttggtgatgagggaacactcactctgagtgttcacaagatctggtggtttaaacgtgtgtggcacctctccccacccccactctttcttgttcctgcttttgccatgggactcgcatgatccctttgccttctgccaggactaaaagctccctggagcctcctcagaagctgagcgatgttggcgccatgcttctggtacagcctgcagaaccatgagccaattcaacctcctttctttataaattacccagcctcaggtatttctttatggcaatacaagaacagcctaatacaccaggggtttgcaggtaacccgggcccctgtccttgaggacacagcagcaagccattggtaaagcaaaactgtccataaggaaggctgctcccatgcagtgttcatttgggcagcccagaaattgagaaatcctcggtccatttcaagtttgggggaaaacttatttttatcatatttgagatgaataataaaagcaaatccagaaaa

SEQ ID NO: 563001 - DNA, 179 bp, Homo sapiens
gagatggagtcttgctctgttacccaggctgcactgcagtgagctgggatcgcgccattgcactccagcctggctgacagagcgagactgtctctaaaaaaaaagactcaagtggaccctacaatgaagcctacacatcccaataggagccccttctgtcgtcttctaacagccgtata

SEQ ID NO: 563002 - DNA, 149 bp, Homo sapiens
acacgcaatctactctatattttgtgttgtttttcagacataatctcactcttttggcccaagctgaggtgggaggatatgctttgagccccagggagtttgaggctgcagtgagacattctactccactactactcccacctggggga

SEQ ID NO: 563003 - DNA, 143 bp, Homo sapiens
ggcgggagaacgataatgcaaagtgctatgttcttgggtgttcacaaggcttcagacccatgggcaaggggcccaggcagttgccacaaggggccagggggaagggagaaaagattaaacgggcccctttttaaagattggga

SEQ ID NO: 563004 - DNA, 133 bp, Homo sapiens
  misc_feature (7)..(7): n is a, c, g, or t
  misc_feature (66)..(66): n is a, c, g, or t
cactatnctactactactcgaatgaagggtgtgtagtctgacatcactatctatgcataaactggncaggatctagggacttgaaaatccatcttaccttgtagctctgggtaagatgacctgagtcccttat

SEQ ID NO: 563005 - DNA, 243 bp, Homo sapiens
cagagttgtgtaacaatcaccacaatcaatttagaacagttcatcaccctcaaaagaaatcacgtacccattaacaataattccccatgtgtcccacatacctagtatctcccccagccccagccctggacaacctctaacctttctgtctctatagatttgcctattctagagatttcatataaatggagtcatattaggttaatgcaaaagtaatcgcgggtttgtgccagatgacggttt

SEQ ID NO: 563006 - DNA, 181 bp, Homo sapiens
  misc_feature (40)..(40): n is a, c, g, or t
ggcgccttgaggactccgacagcacagaggaggcgatggngaaggcctcggcggataacggggatgaggtccaacaggtagtcgggagggatggcggcagcttgtgtgcgagaagtcacagagcacctaggcaaagagagtctcaggggctgtcctcctctgtgctgtccagtgctgtcca

SEQ ID NO: 563007 - DNA, 106 bp, Homo sapiens
attaatcgcatgaaattcaaaaacacacattcttctctaatacccacactagagatcactgaattgggttgaagcaacagaacatggaattctatgggtggggttg

SEQ ID NO: 563008 - DNA, 144 bp, Homo sapiens
atccgtacactgcctcctggctgtataaacaagtcatacatttgaaaagaaaaaaaaatgttgtttacaaaatgttttctcctgctgcagtaaatatttttgcatgatgaaattccaggtcacacttttccaagtgtataatgt

SEQ ID NO: 563009 - DNA, 323 bp, Homo sapiens
acttcatggacaaacaatagcttcttaccatcaaaaatgcaagacttattacacagagtcaaggtaaattttacaaaatctggcattcaatcacaagttgccacaaatgcaggaaaaaaaaaaaacaggaaaagacccatagtgaaaataggattaaaccagaaactgactcagatgataggagacgggacattagaacagtggtaatatctgtagtccatatattttaaaaggtagctagcagacaggacattagaccaatggtcatatctgtagtccatatatttcaaaatgtagctagagcaaagacgggccttattttt

SEQ ID NO: 563010 - DNA, 499 bp, Homo sapiens
aaacaccggaatcttaggaaccaagtcacaactgaagcgacgacaaaatgtcttactggaaaagagggaaattatgtgaaattctgcgtcaggataccgtagactatctcccaggagaaaatggaggtgacacgattacttaatgggtgccaccatattaagaactggtcaggatatggtagattattggtaatgtaattaataggcaggaaaaaaattttaaactgggataattatcggaaaaacaaaatattattaggggaattttggggactccagttggtgaaaaatatttggcataggtcttaataaaccactaaactaaccccaaaatctgatacctataaagatgagaaaaagggaagtatgtataaaagcctgtgggcagtagagagattaagataactaatcttcatccttcttagatggaagtcagtagctactatctaaaatgaaaacccaacaaaaagcagaataactgacttagaaaaatgaagac

SEQ ID NO: 563011 - DNA, 128 bp, Homo sapiens
atggagagaggaggaggtaacagcgtgagtgctagctcaagaggtcagcaaagttgtgcaggcgagccttaacatgtcattggtgcagacccaagcatcgttgatgttctttaataggaacatctggt

SEQ ID NO: 563012 - DNA, 1284 bp, Homo sapiens
  misc_feature (422)..(422): n is a, c, g, or t
cgcgctgagaaagctggaggtggaagccaacaatgcctttgagcagatatcgatgacctgtatgaggacacgtggcgtctcatctgtctacctctgggatctggatcatgaggctttcgctggagtgatcctcataaacgaaggctgcgagagtcgagcagtcaaacgagacgatcacaccggctgctcgcggagttccactccacgtcgggtagaacgtgcaggagaaatccgtcgactcgcaccgaccattacaagttgacctccacggtgatcgctgtgcgctgcgagaccaacagaaatctggctctgggcaccatgaacctcgggaggcgaagccttatccatgagcagatcgcgtaggaatggtattgaaactgtgagttgactgcttcggcccaaactatatgaccagactattnctgggcggcctggtaggacggacattgggcaaacaggaatactcacgaagtacgcctgagagcggagaatcttactttggagagcagaacagaatgcgcatatcgctcgagatggggtcctggaggtggtctcgtacgagcacttttatgtcagattcacaattccatgacacgagaggatacgctctgaaagagatgcacctgggtgcgaagggcttcggagagcagaagagctaggccagattgcgtagaaaccctttcatggtattcaatgcatataccgaggacaagcgcgcggtggcatctgtcggtatagcactgtccttttacttgagaaataagcttccgtggataccctgacttcgccctttcacgacttccgttcccgattgcgccgatccccctgagaaggtggtcaatcgatacacaggcttgccagtccattttgagcccggttaccaggtggctcacatggcgtgcttccccctttgcagcagagtcacagaggcacctgaacttaggcccgaggcgcgttcacttcccagggagctccccggacggcccttgggctatcatttggccccacgagggccttccgagctgctatcataggtaccaatctttcctcaggcaaatttgttcccaacttaaggaatagaaccccgttggttggcgcgttacaaggatcagcccgcacgggggagacgccccccagagagtactcattacagtccagcgtaggtgtcccgcccccatattatgttatataagggggacatatagacaatcacaagatatggaccttggcagaaggccgagctatcaattctccaattccctagacccttaataagggggagaa

SEQ ID NO: 563013 - DNA, 449 bp, Homo sapiens
gggtaatactcaaactaaatgtttgtccccccaccccctaaagtcatatgttgaaattagaaaccgcagggtgcaatgactcacgcccgtaatcccagcagtttgggaggctgaggcaggtggatcacttgaggccaggattcgagaccagcatggccaacatggtgaaacctcatctctactaaaaatatacaaatcagccgggcgtagccgtgggcgcctgtagtcctagctactcaggaggctgaggcaggagaatcgcttgaatctcagaggcggaggttgcagtgagctgagattgcaccactgcactccagcctgagcaacagagcaagcatctatctcacaaaaagagagaaggggagaaagaaaggagaaagaaagaaagagaagaaagaaaaggaaggaaggaaggaaggaagaaagacagagagaaagaaagaaaagaa

SEQ ID NO: 563014 - DNA, 369 bp, Homo sapiens
cacaccctggctactattctttcttccttctaaagatgagctagcaaaactttttataggttgtcccctcttcatgcagctttttagaataaacatttattacattatttcttcaccagaattatatttttggaagtctgcaggaaaaatccgcttgcctaagtgaatttggcacacaaagagtaacaacaaatcaaactttaagctagccaaccaacacacaaaataagcatgcaaagaatagcacatcaagtcttatatggatacaggtattttagcccactccacttataaggtattacaaaatctctatatagtattgaagctatatgttgcagtttaaagttacttttaacaataatacgtata

SEQ ID NO: 563015 - DNA, 225 bp, Homo sapiens
ggcgcaggtgctatgatgcagttaattataaattaggtatagtaagagattaaaacaaaaacaaataatagaatataacaatgtactgtaataaaagttatgcaaatgtgatctctgtactcacctatattggacggtagttgaccacaggtaactgaaaccgcagaaaacaaagccacagataagggggcactactgtattgggctaacttgaggatgaacatg

SEQ ID NO: 563016 - DNA, 1211 bp, Homo sapiens
gtctcctcgaggatcgaggtggactctgaccacagcctgtggctgggaacgggagacagagtgcggctgtgctggctcagtgggaaactgaggctgcacgtggtggtagtcagtgaagatgtcgtggcgaggacgagcaacagtgagcaaactaatctgctcgagtgacctggtctgtgaccaagtatacagcatgtgcgtgggctgaccatctgccaaccagggatacttctggtccttggtggaatgcatctagctcagagtgtgtctggtactgagccttgtgtgacgaaaggtgatgccatgattatggaagaaacatgggaaaatctacaagacaagacaccgcgacatgacgcacaggtctcgcattacacccaaacagcataacggatacacctacacctgtgtatgctcaccttctacccctttgacagagcgaccaggattatatacatcaaggaacggtgacctatgcgaaacaacattgacccttggacgctccaatgagagactggcatccaatcggctaactgtaagctcacactatctgagcgttgactgtaactcagggagaacccaagtaaccaagggacggcaaaggaagcaacgtaacagaccggcagaaccaaccgtaagaagcagcacgctggcccctaacagcactggacaaacccatgcaaacaccacaacaacacaaccatggacacgaacagcctgacaaccacacagcacgacccacgcacaatacaaacatgcacacccgaactagacacggcataggaggacaacacccagcggccacccagacaaggccaacgcccggggagacccaaccacagacatacaagaatacccccagaagccaggacgaacgaatgacccaccgaacgacacagacaaaagaaagaccaatccacccacggacgagacagaccaccgcacacaagaagacggacagcacaagaagacaaacggaaacaagaataacaaacgcccccaacacgacagtgaggcaaccgaaaaaaaagagaaccaaagaacggcaccaaaacggccgaaccgaaaacacggataccacccaaacggaccagcaagcacgcaaaaacaagaaaaggagacgagcgcgaccaagcgcgccagcggaaggaacgacagacgaggcgcaaagaacaaacaaaaaacacgaaaaacaagaaaagaacaaaaga

SEQ ID NO: 563017 - DNA, 732 bp, Homo sapiens
tttagctggactcgccacaaaattcacggggagccaattatgtaaattatcttgctgccaatcctttgagcccttagggattcatctttctgtttccaccgttagggtggcctgactggccattgttattagcccaacatcatccacttaggcctctgttactacaacggacaacggtacataacgttgtagactcactttccacctaatgtcctatccaataggaggctgtaatttgccactcaataggagggcttcaattcaagctgagtgttcccctaattttcacggcgtacacccctatgagcccaacctacgcccaaaatccactttcactagtcaatagttcaatcggcgttaattctaaccttttttcccacaacactttttcggcctatccgggatgccccgacgttatctcggagctaccccgagtgcataccagccacactggaacatcctagtcaatctgtagggtcaattcaatttctctaaacagcagtaataattaataattttcatgaatttgagaagccttcgcttcgaagcggaaaggtcctaatagtagaagaaccctccattaacctggagtgactatatggatgcccgccaccctaccacacattcgaagaacccgtatacatataaatttagacaaaaaaggaagggatcgaacccccccaagctggtttcaagccaaccccatggcctccatgactttttccaaaacca

SEQ ID NO: 563018 - DNA, 396 bp, Homo sapiens
tgtctcccaaaggtcagtctaaggcggcagcacctatatagacatgacgtcaggggattaggaaggatccacagtcaccttccctaaggcttactgacttgtactataaggtatataatttaggtatacgcaccctaagtaacatctgattgaaggcgtgaacttgcttgagatccactctcagacacaggtttagaggggaaacgcaaaagaatactgggagcttcaaggaggacgaacagggtcacaggacaaggggaagctgggcctatagcagtccagcatggttaggggccaacagttggcttctcaaaaggtaatgggttaacacagtcgtcctaattacacctcctgagatgccgaatgtcctctcagctaagtacacatttctattgt

SEQ ID NO: 563019 - DNA, 924 bp, Homo sapiens
tcctttggtttttggaagtgtgggggttgggtttggtttttggagtcttttttttaaagtgaaatttatggaggaaaaatatgtgaaggaccttcactctaagaatgtatatttttcttaaaaagtaactcctagtaggggtaccactgaatctgtacagagccgtaaaaacgtgaagtttcgtgcctcctgattgttatttgggtgagtttggttcccttgtgaattttctcattcttatacagttacttttcccttgcattacaaacaagcattataaaagggcaaccaaacgtgcacatttgatttcacaaattattaacaacagctccttttaacaaacgttttggccaaccattaatgtggtcgatctcattagctctatttatccggggaagtgtatagtattggaaaccagaatttgggtaccttgcacacatcatcttgtaagctggttgggttttcaaaaatactggtgagataattacccagggtacgaatggaccttgtaatggtaactggctctggggcaatattctctggtacatattaagcgacaccagatggatccccatggtcggacctcggtcgggtacataagggcaacatattttggtatgcaaggcagtttccaactcaaaagtcggatctgacctctgtaaaatgtgactgtcgatgcaaacccttacaaactgacgtgggttttcacaacactttcacagctaggcacaggaacctacttgaaagctgttcctgtcacaaactggtctggttccccgtggccactttccccgtcacaggaagttacctatttaccaattccacgacttgttcacaaggaaaaactcacgcagggtccacacacgtccctacataggctcaattctctacacagggtttcaaagggcaatgcacaggaatact

SEQ ID NO: 563020 - DNA, 111 bp, Homo sapiens
ggctatcacattatctataaacctaaaaactccaggacagaagaaaaggatgatatggggaaatttgcccataaatgccggttctggttcttagtttagcccatttcccat

SEQ ID NO: 563021 - DNA, 662 bp, Homo sapiens
  misc_feature (60)..(60): n is a, c, g, or t
  misc_feature (108)..(108): n is a, c, g, or t
  misc_feature (190)..(190): n is a, c, g, or t
  misc_feature (199)..(199): n is a, c, g, or t
  misc_feature (214)..(214): n is a, c, g, or t
  misc_feature (216)..(216): n is a, c, g, or t
  misc_feature (232)..(233): n is a, c, g, or t
  misc_feature (240)..(241): n is a, c, g, or t
  misc_feature (243)..(244): n is a, c, g, or t
  misc_feature (249)..(249): n is a, c, g, or t
  misc_feature (258)..(258): n is a, c, g, or t
  misc_feature (264)..(264): n is a, c, g, or t
  misc_feature (268)..(268): n is a, c, g, or t
  misc_feature (272)..(273): n is a, c, g, or t
  misc_feature (280)..(280): n is a, c, g, or t
  misc_feature (283)..(283): n is a, c, g, or t
  misc_feature (290)..(290): n is a, c, g, or t
  misc_feature (293)..(293): n is a, c, g, or t
  misc_feature (302)..(302): n is a, c, g, or t
  misc_feature (309)..(310): n is a, c, g, or t
  misc_feature (314)..(314): n is a, c, g, or t
  misc_feature (323)..(323): n is a, c, g, or t
  misc_feature (328)..(329): n is a, c, g, or t
  misc_feature (339)..(339): n is a, c, g, or t
  misc_feature (344)..(344): n is a, c, g, or t
  misc_feature (350)..(350): n is a, c, g, or t
  misc_feature (353)..(353): n is a, c, g, or t
  misc_feature (355)..(355): n is a, c, g, or t
  misc_feature (372)..(372): n is a, c, g, or t
  misc_feature (378)..(378): n is a, c, g, or t
  misc_feature (387)..(387): n is a, c, g, or t
  misc_feature (389)..(389): n is a, c, g, or t
  misc_feature (391)..(391): n is a, c, g, or t
  misc_feature (395)..(395): n is a, c, g, or t
  misc_feature (402)..(402): n is a, c, g, or t
  misc_feature (460)..(460): n is a, c, g, or t
  misc_feature (488)..(488): n is a, c, g, or t
  misc_feature (508)..(508): n is a, c, g, or t
  misc_feature (520)..(524): n is a, c, g, or t
  misc_feature (585)..(585): n is a, c, g, or t
  misc_feature (626)..(626): n is a, c, g, or t
cagaggacccacctgggccaaggactccaaagccgcggggacaccgggaagtgcagcggnccaggcaggctgggtgggagggaggagggccgagacaggagcagcccncccagcagaaatacaatccgagctacaaagcatgggaaaaagagactcttttaggatcagatctgtgagcacgttggcgagnaaaaacaantcaaacaaaaaaaananccttgtgtctctctgnncaaaaanncnnacccnaaccggaanacagcnccancacnnccccaanaanacaaaancanaccaaacanccccccnncatncattgtggncgganntggatatatnctgtncaggancancncatatggaagtggactnaacccnatgtagaancncncacncactgancattgttattcattttgtaaaatactagtctttattttcattttttgtaaaatttaancatcgtatgcgcataaagaaaaaggaancaagaattaggggaaaatancattttccaaannnnncccccaaattgtcctgtgtctatgtatctatatctgttttgtatttttttctggttccaanccagatttcctgtgattctatactaataatttttgatatanccctttgctttttataatgagtgcgatatatgttgt

SEQ ID NO: 563022 - DNA, 421 bp, Homo sapiens
  misc_feature (82)..(82): n is a, c, g, or t
  misc_feature (87)..(88): n is a, c, g, or t
  misc_feature (98)..(98): n is a, c, g, or t
  misc_feature (103)..(103): n is a, c, g, or t
  misc_feature (109)..(109): n is a, c, g, or t
  misc_feature (112)..(112): n is a, c, g, or t
  misc_feature (114)..(114): n is a, c, g, or t
  misc_feature (131)..(131): n is a, c, g, or t
  misc_feature (137)..(137): n is a, c, g, or t
  misc_feature (146)..(146): n is a, c, g, or t
  misc_feature (148)..(148): n is a, c, g, or t
  misc_feature (150)..(150): n is a, c, g, or t
  misc_feature (154)..(154): n is a, c, g, or t
  misc_feature (161)..(161): n is a, c, g, or t
  misc_feature (219)..(219): n is a, c, g, or t
  misc_feature (247)..(247): n is a, c, g, or t
  misc_feature (267)..(267): n is a, c, g, or t
  misc_feature (279)..(283): n is a, c, g, or t
  misc_feature (344)..(344): n is a, c, g, or t
  misc_feature (385)..(385): n is a, c, g, or t
ccccgggctgcaggaattcggcacgaggagaattttaataaaccagaaggaaactaatgccccttccaggatttattgtggncgganntggatatatnctgtncaggancancncatatggaagtggactnaacccnatgtagaancncncacncactgancattgttattcattttgtaaaatactagtctttattttcattttttgtaaaatttaancatcgtatgcgcataaagaaaaaggaancaagaattaggggaaaatancattttccaaannnnncccccaaattgtcctgtgtctatgtatctatatctgttttgtatttttttctggttccaanccagatttcctgtgattctatactaataatttttgatatanccctttgctttttataatgagtgcgatatatgttgt

SEQ ID NO: 563023 - DNA, 306 bp, Homo sapiens
cgccgagcgagctggaagaccctcgcagtgagcaggccggtgcctgtcaccagcgaatggctagattgtcaccaccgcacctggctttcctactggctgtacagcctcacaccacaactctctctcttcttcacctgcactctctgcttctaaaagaccattggtacacacactactcagaagacatgcatatggggaatcaacccgatgcttcagagacctacttacatcttcatgggatagataaaacaaacacagcttaaactgctggcatccagtgactttaagtagaaggatccaacacta

SEQ ID NO: 563024 - DNA, 196 bp, Homo sapiens
gcagttgttctattggatatatatctaaaggatataactaatatgagtatgttgaagagatatctgtactactatgttcattgcagcattattcacaatagctaagatatgaaatcaacctaagtgttttcattcattgatggatgaatggtgaaagaaaatgtggcatacatacacaatagaacaactacaaccg

SEQ ID NO: 563025 - DNA, 1001 bp, Homo sapiens
  misc_feature (371)..(371): n is a, c, g, or t
  misc_feature (500)..(500): n is a, c, g, or t
  misc_feature (587)..(587): n is a, c, g, or t
  misc_feature (619)..(619): n is a, c, g, or t
  misc_feature (812)..(812): n is a, c, g, or t
  misc_feature (973)..(973): n is a, c, g, or t
tggaattccaatggttttttttttttttttccaattccaaaaaattaaaacccatccccaacccccgggtaaaggggttggccctgcccaatgggggggatactttcgggacctgattacacttttctaaatcttaaaatacgaattttttcttttcacaaaccggtaggaagtcaaatttctcaaaatggttaagtgtaactacgcatctttttttgttgttcagagaacaggatgttctctgtccaatggccacttttccccattttaattataaccctaagcgatctcctctttattataaacacatgcttcttatttttttttccacactataaaatgtgtgctctctttgtgtgtgagacagagantctctcatttctctgataatttcttcgcctctttgagtcagacaccacaccccccactctttgttctttcattctgtcacccacacacactttctctgtgtctccttcgactcttttgacacactccantctctgtctctgtgtcgatgagagagaagacttttgtttttctcacacaccagagtgtgtgtggcttctctttcacacccagacacncaaaaatttaaagcttttcttccgcagtgtgntttccacaccgtgtcttctcgcgtgttttaatgagtgggcgtatacaccgcgggtacaaacaacagagttgccgcttttcatccatttctctaatatatatatacgcgcgggagacacccctcgtcggttcctcaaataacttcttctcttttacgtatttttccctccacagcaatctttgcgtcctatctnggctgtttcttgcgcaccactgtgtctttcttctctctcccgagcaacacctgttgttctttcttcttctccggggacaacactcttctcctcccgcacagggacagagtcttcctcggcaacatctttctcgctcaattatggaagaaccggcctttttntcgggtggctaccccaatcttcgtcgcg

SEQ ID NO: 563026 - DNA, 359 bp, Homo sapiens
  misc_feature (116)..(116): n is a, c, g, or t
  misc_feature (120)..(120): n is a, c, g, or t
  misc_feature (140)..(140): n is a, c, g, or t
  misc_feature (142)..(142): n is a, c, g, or t
  misc_feature (146)..(146): n is a, c, g, or t
  misc_feature (152)..(152): n is a, c, g, or t
  misc_feature (168)..(168): n is a, c, g, or t
  misc_feature (177)..(177): n is a, c, g, or t
  misc_feature (236)..(236): n is a, c, g, or t
  misc_feature (238)..(238): n is a, c, g, or t
  misc_feature (240)..(241): n is a, c, g, or t
  misc_feature (243)..(243): n is a, c, g, or t
  misc_feature (247)..(248): n is a, c, g, or t
  misc_feature (256)..(256): n is a, c, g, or t
  misc_feature (263)..(263): n is a, c, g, or t
  misc_feature (269)..(269): n is a, c, g, or t
  misc_feature (284)..(284): n is a, c, g, or t
  misc_feature (301)..(301): n is a, c, g, or t
  misc_feature (307)..(307): n is a, c, g, or t
  misc_feature (311)..(311): n is a, c, g, or t
  misc_feature (326)..(326): n is a, c, g, or t
  misc_feature (329)..(329): n is a, c, g, or t
  misc_feature (335)..(335): n is a, c, g, or t
  misc_feature (353)..(354): n is a, c, g, or t
cgctcgctcgctcgctcgctcgccctcagcgcatgggccccgcgccgggccccggggcctcgggccgccgggacgccggggtcccataggccggggcgtgggcggggcggccagcntgangaagctctgcaccccctacnancacnagggcnggcggcggcggctgcnccgagggangcggccctaggcggtggcgatggggaccgcaaggatagcacccggcctggcgctcctgntntnntntctnntttttttnttttttnttttangcgctggtggtatgnagattacgttattattnaatatnatanatatttttttttttnacntttctnatgcccatttctaaaaanngttca

SEQ ID NO: 563027 - DNA, 252 bp, Homo sapiens
tatctctagatcgacaggctccatctaaacgatatttggagggtcagcactggagctcacgtgtcgacggaacttgtacagtggaggcatgcacctgcagtggtgaatacacgtctgacctggatccatgcatacatgattgggtcatgatcacggatctcatatattcaaggagcatgcatagaaaggtatgcatggccgtggtgaatacacgtcgagatggaggcatgcatgcatgctcgggtcctggac

SEQ ID NO: 563028 - DNA, 591 bp, Homo sapiens
gacggctaggtaggaggcgggggttaatcggccgagggggaacccaggaatattacagctagccagcgatctcagtcagagagaaagtggttggagggtggtcaagatggctgataagcagttcagcccactgcttccacgttagtagaaccagagacagcagtaacaggaacagagtcacagcgtcaagagtacattatccaagagagaatgctggaactcaacagaggcaaggtgatccaggggaacaccaaaagtggggaaggaggaggagaggcagcctcgtctggctgggttcggctgggcatcaggaggtgacaatatcaccaaatattaagggaagaggtgagtaggtgtaggggccagaccctacgagggatctgttgaggttattatcgtacacacgcaaattgatggtgggaagacatgggagattgtacgcaataagagacacaagtacaaaagagattaaagagacaagacatgggggcaccagggagggaggaacaaaccgtagccaagccagagaacgatagacgaccagatagcatccctgaatgccagactggtgctgtatatatacttgggaca

SEQ ID NO: 563029 - DNA, 509 bp, Homo sapiens
  misc_feature (2)..(3): n is a, c, g, or t
  misc_feature (9)..(9): n is a, c, g, or t
  misc_feature (11)..(11): n is a, c, g, or t
  misc_feature (16)..(16): n is a, c, g, or t
  misc_feature (267)..(267): n is a, c, g, or t
  misc_feature (402)..(402): n is a, c, g, or t
  misc_feature (435)..(435): n is a, c, g, or t
  misc_feature (456)..(456): n is a, c, g, or t
  misc_feature (461)..(461): n is a, c, g, or t
  misc_feature (498)..(498): n is a, c, g, or t
tnncaccancncaccnccaccaggactgtgaccttgctgtagaggtgttgtgatcatttggagtaaacaagtcactctggccttttgagttgttaggggtttttcattcctttctcatcttcatgagtttgtctcattttgatctttgaggctgctgacctttagatgaggttttcgtggggactttttggttgatgttgttgttgctttctgtttttctttcgacagtcaggtacctcttctgtagggctgctgtggtttgctggngattcacttcaagccctatttatctgggtccctcccacacctgaagatgtcaccagagggtgctggagaacagcaaagatgggaccccactccttcctctgggatctctgtccttgaggggcacccacctgatgncagtagaaatgctcctgtattagggtgtctggncgacccactggggtggttcanccagntggaggggcacaggatccaggacttggtttaatgaanactttggattg

SEQ ID NO: 563030 - DNA, 333 bp, Homo sapiens
  misc_feature (306)..(307): n is a, c, g, or t
gctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcnntaaaaatgagatctgaaacccaaaaa

SEQ ID NO: 563031 - DNA, 1342 bp, Homo sapiens
ggttcgcattcggctgccgagtcgcggtcgtatcctgtgcggcttaatgtggctgattcttcgcccgaggtatgcgggggtcacgtgtcgtgccgtctgctcctcagctcgccgctgatagccgagttacgtgagctagtcgatagggggctggtagtgccttcattgctatggtgggtacggtgggtcggatgggtagagcgagagcattggtcggagcgggtaggaggaggggggacggagtgacagccaagtgccgttgagggggaggagtgtgggcgagcactgttttgagatggccctgaacgcagagaatacccgcgagttagcccgggagcgcgtggacgcgtccgtgtgacgaaacaggggagcgggcagtcccagtgggctggcgccagagcactgcggattggtgccactatgtgaccgtacggtgcaacctggggcggcgtggggtagcatccaaggagattgttgccgcaaggctttcactggtcgatgcgaaggtcgaagttggcctgtttttcttcaaaggtttacacgcggggggttacttctgggaggcgtgaagagtttgggcttgggtggaaagatagttgaagcctgggtagtcgtataagccgaaatcggactgcctcctcagcgagtgactcgtccggtggatataagcacttcctctctggcggctccgttcacaatattttgccatagggcaagacctgtacggcagctaggccgtcccacggcgaacgtgcgctaggtctgcgtgccttccaagggggccggggggacaagggtcggtgcgggatccttggggaccagtctacaccggcttgggggaagcgttggcaccggaagataaccttgacatgacccggagcatgcttgtggcacacttgggtagccaggacacagcaaacaggccagagtgcatgagcgcaaggggccaagcaaacccgaacatccactctgaaaccgcggccactcgggccgcgcgcccttggcacagaccacccccgcccacacttgggcacgcaccatcgagcactgaaaaccattctacccccacaacccgtcatacgacagcaaaacaataagcgatcagaccaacaagcaacgagagacaacgaggagggaaaaaagtagaaggaacgggttaagtaaaagagaggagacgctcgggaacaggaggcagagggggaagaaggtgtaagggaaggaacgcaggagagaatataggaaaggtaggtgagcggagacagaagagagaaggggagagcgatagagaaaagaaaataacaaatagaagaagataggggacgagaggaatctcgggaaggaa

SEQ ID NO: 563032 - DNA, 136 bp, Homo sapiens
ctgttgaccgcgctgtggctgcgcctgttcgaccaggaggccacagcctgccgccgggcggcggcgcgctggggcagttggccagcatcgacccgcgcggcctcgatccgcggctggcgaagacgcgcatcgtcat

SEQ ID NO: 563033 - DNA, 392 bp, Homo sapiens
  misc_feature (84)..(84): n is a, c, g, or t
  misc_feature (139)..(139): n is a, c, g, or t
  misc_feature (169)..(169): n is a, c, g, or t
cttagaggatcttaccgcgtacagtgcgcggaggggatattgggtgcgtcaagattcaacttcacccgtaacccaccgccatgnccgaggaaggcatgctgctggaggtgtaatgacgttaatactgcttacaagaggnctgaagactgcctcatccacgatggcctanacgtggaattcgcgaagctgcaaagccttagacaagcgccaagcccatcttggtgtgcttgcttccaaactgtgatgagcctatgtatgtcaagtgggtggaggccctttgtgctgaacaccaaatcaacctaattaaggttgatgacaacaagaaactaggagaatgggtaggccttggtaaaattgacagagaggggaaaccccgtaaagtggttggttgc

SEQ ID NO: 563034 - DNA, 153 bp, Homo sapiens
ccatgatgaggctgcatctccccccagaaccaaacatattccatgcatgcctcctcagactctagaatcccccaaccattccctttgcagcttccatggggcccagcaactgtccatcctacctccttgcagccatatggaggcaatatggga

SEQ ID NO: 563035 - DNA, 457 bp, Homo sapiens
gcatctcccatgaggagctgctctcctgaccacgggcaatatgttgaatctttccggccgctcgtcaaccattccaggcaacaccagtgcacgcaggactccatgcaccagaagctgccaggcataataggcagatacccgcattgctgcttaacaaaccaaataccggccagatgccttcgctcacgcctgtactcctagcacttcgggcggccgaggcgggagcattacttgccgcctcggacctcagacccagcctgggcaacatagcaacatcccctctctcccaaaaactcacaaagttagctgaacaaggcggcatgcacatgctactccacaccgctgaagtgggaacatcccctaagtccgagagcccgcggcttcagtcgacatacggctgagacactgctctcagcctggatgacagagcgagaccctgtctcaaacaacagaaaac

SEQ ID NO: 563036 - DNA, 171 bp, Homo sapiens
tcttgatgtcctgtgtcggcaggtaggtcagcacccgctcgttcttcttgccgcccaggatgaagcggttgacgtagaccggctcggacagcttgttgatcgggctgcgatcgtagtcgctgctcagctcccagctgccacggcggccgccggcgcgggtactggctgaag

SEQ ID NO: 563037 - DNA, 329 bp, Homo sapiens
  misc_feature (116)..(116): n is a, c, g, or t
  misc_feature (268)..(268): n is a, c, g, or t
ggccgccattttgatggcaggaagagtccggttctgggacagctggagacagtggtggtgactgaaataactttaccaaaggaaagctattttgcgaactaccttctccagcgganatggccaatgtgagtaaattatctcttaagaatcagcatagtaaactcgtttgggaatgttaggaatgaaagaacgggtttaattatgatggcattgggtggtatagtgttagatataatgtatcaaaaatgtcaagggaagcaagtggtgngaaattaatgtaatggctttgaagatggtagcattctttggcactgcaaattacacttatt

SEQ ID NO: 563038 - DNA, 405 bp, Homo sapiens
ctccctgtgattgagaataaagtgtgcaatcgctatgagtttctgaatggaagagtccaatccaccgaactctgtgctgggcatttggccggaggcactgacagttgccagggtgacagtggagggcctctggtttgcttcgagaaggacaaatacattttacaaggagtcacttcttggggtcttggctgtgcacgccccaataagcctggtgtctatgttcgtgtttcaaggtttgtttacttggattgatggagtgatgaaaaatgattaatttgtgcgggagacatattgacgcactgacttctcttgatgctaggccgctgggtagggatttatactgcttggaaatacctggcatttatttaatactactgacactgtacatcgcttcccagttacgcc

SEQ ID NO: 563039 - DNA, 814 bp, Homo sapiens
agcgggggttggggtcacatggcggcgactgcggcaaagcgagagcctcggagacgccgctgccgccagcacatccgccatatcggagccgacactgggggcagtcctggagaccccgaactctctcgatgagtcggagaagtcccgttgtatcagagtaagatggacggtagcttatgattgtgattgtggtgagctggagccaactgatcactaagcaaaagacatcttctgttaaccaacagccgccagggcttcctgttgaccatcccatatatagcaacaaaaggaaaacaacgcagcagaaccggaaatagtgcttaccagcaccttagcatgatgcttgctcaaggaacagatccaaccacgtgcatgtaatcatgcacctgatgacggagaactgttcaatagaaagcctgtcgatgtgacactatatatacaacataacggttaacatgtccaactcgttaagccacaggatacactctggagtggacaagagatgatcacttctccagtatccagataatgacggtttcatagattaacccgatacaacatgtcatggcaggacgttaggctggcacccagttagacttggacactactgacagtacctggccaaacgccttattacaaaacgtccgtcccactgacttgcacattacgacagcgttagaccgaaggccttttacaacatcctcaacagggggcacacgttccgaaccagggcaccggttaagggacaattaacgacaccatgacaccaatccacggacaccaccaatctcgcccaggatggcaacgcactaaa

SEQ ID NO: 563040 - DNA, 155 bp, Homo sapiens
caacacaaaaacaattaattaccaggcatggctgatggcatgagcctatccagctacttgagaggctggggtgggaggattgattagagccaggaggcaaggctgcagatgagccatgattgtgctactgcactccagcctgacttacaagagtg

SEQ ID NO: 563041 - DNA, 515 bp, Homo sapiens
tttagtccgtggagctgatgtgagagcgagtagtccaggcaattcaaaagcccagcccgggagtctgtccaccatggcaacgcgccagcgtctccatgtgtcgttgggctttccaaagtctgcggctgactggcctggggctgggccgggctcgggggccacaggcagtgtgcgacgaggccgcatctctgcttcatcacatgggcaggtgggctggaggcctagatgcggctggacgaggtgctgcccgagctgatggggagcctggcactgtctgagttgctcttcagaggggaggggccaccccgggcctgcagccgcatggaccagtaccagatgaagatgaggaagccttggaaggaggtgatgatgctgaaaaggtagaggacgacaagctggaaggtgccagaagcaaaggagaagaagatcaaggcccagggcagggccaggacccaggctgaggcccagcagtgtcagcacatgtgaccccttttgggtgtgggggcgcacccggg

SEQ ID NO: 563042 - DNA, 1336 bp, Homo sapiens
cagcctctggggcgcataccaacctatccagcctagcgacctagcggcagaaaaaaaataactatatatttctatgccccatacatacctatgaggcgagcaaaaaaattaaatatttaaccatagagggaaatacgtagcacataccaggctaggtacagtgtaggcaaccagatacggtagccaagtaactagggagtgtagatacacgtagatagaacataggcatactgaccccaccggcacctaaccacggtggcacatgctgacctagcagctaggacctgcatactactagtagtaactaacaatagaacgccaccaggtaggcaacataatagtaacctacgtagcacatacctaggtaggatactaagcaacctagggcacccataggcactactagtatactgctacacggtacctatatacaggacccacgatactatacaagacaccacgcaacaacgctatatggtaatacatagggtaccaggtactagggcgcgcgacgcgtcaaacccaacctagaggcccacaaagggacccaccctaaccacccacgcacgcgtgccacgcctgaaagccctagcgctacagcactacacctaggtacactagtggcactagctagcgctaaccgcggcacacgggcaagtgccacgcaagccacgccgtaggtagcaacttaggctcttaagcccaaacggacgccttataccaccagaggttcttaagacaccacccccaacattaccacacctaagacggtcgccccagcagcagagcagagctaatccactgcgaggcctcaccctttaggccgcacaactaggccggcggcccaaacattaccataaccccttatacaaataaaccaaccgaccaacaaaccgaacgtaccccaccggcaagcacaaacaaacgggaaacattctaaaccccgccccttttaaggaaattaaacgtggcgccaaatcttaccccaacatttggtgaaacactttaacgccccgtattacccaaggctacgcgtatggcgctagcccccttattacgcaccccaccacaaaaacgggtagctacctaaggagaccaaccccggaacaggggccaccagcaggccccccccaaaaacgaatacttagccccccaaaccccccataacaccaaccccggaatatcacccaatcacccaaggagataaacgagcagtatacaagcccaacagccacacaaattaaaccgacctacggccaacgtaaggcaagacaacagcacccaaccacacctcacagcgccccagctcatacgagaacaccccgcataacagcaa

SEQ ID NO: 563043 - DNA, 544 bp, Homo sapiens
cacgattgcacgtcctgtgtgcgatactccctgcttcctctcagccccacctgagagcgggacccttagctagccatgctctgacagtctcagttgcacacacgagccagcagaggggttttgtgccacttctggatgctagggttagattgggagatacagcagtgaagctgaaatgaaaaatgtgttgctgtagttcgttattagaccccctctttccattggtttaattaggaatgggggaccccgaggctcacttgttcaggctcccttctggcctagaagttaggaagtccagagctctacagtttgaaaaccggtttttttatgaaccaagtagaacaagatatttgaaatcgaaactatttcaaaaattgagaatttctgaccactttaaaaaaccacagaaaattcacccgagtgcactgagcacgccagaaatcagggtggctccaagagctggtcccaccttaaggagacgcgctgctgatgctgtcgtactgcctagcgccttggtctacaggggacgcgccaacgtgggctt

SEQ ID NO: 563044 - DNA, 131 bp, Homo sapiens
aggcaggtgatagtagttgttcacagctgtacagctcaacgttgtgttgatccagaaatttttgttcagcatatctgcatactgattaattgctcgcaggaagactttattttgcaccatgttcatgatca

SEQ ID NO: 563045 - DNA, 1693 bp, Homo sapiens
tggggacttcttgtgcccctttattacctgacccattatttgaaagggataaacgcggaaggagtgtgggtgtggccccaattgccgggccggccatgtgctttaggggctttgtaagggtaagtgagaaaatctcgcccaggataggtggccgatctcatctcttcgggctttgatctctctccaccctgtgggtgagaagggctcttgtgcgcgcggtgtgtataaacccccacacacacatgtgggtgaccacacacacatctctctgcgggagaagagaagtagatctacatgtgtctcccgcacagacggtgtgcgtatctttcacccacatatttctcgcgagcttctctctcccagttgtgtggcgtggcgcgccctctctcttctctgtgtgcgcctgtgtgcgcacagtgcgccgccgcttctcaacgcagagagagagagagtgcgagcgctatcttctcgcgcgcagacaagtgtcgcccccggagtgtgtttcatcgcgcgctgctctgcgcccgacggttgttgggcagcgcgcaccctgctgttgtgatacacacagcgctgtggaccatatcccacgcgctgatgtgccctgccgcaatcaggagacacaccaatgatgtgctccaccacaacaccacgccgctgttgcgcctctccaccacgatatcctacacgacgagctccgccgccgcgatgatctaacgacgtgtttgtaccaccctgctgcttgcggcgaacaaaaacaacgtcggtctctcacgcaggcgcctctcatcctcattcttctatgctacttgctagtagtagcctgctccactaataacactacttcatccttgctgggccgacaatacatcatatagcgacgccccccacaaataattgttggcccacaaataaatcaatacaaatccattatcattagcacgttactacacataacatgcctccccatataaaaatctcccccccatatgattcaaccaaccaccccctccataatcaacaccacagaggtagggagagcgaaccccccctcctctatctaacaaacggcgcgccctctcacttccccttaattatcaatgtttagaaaacaccccaccttcagccggcaggcccacccacctaataatgcaccccccaaatggatgtctgctgctacaaacacttctagacctcacgactacttaccacaccacccaacaactcctcccacaccaatatatatactaccggccgcccattccttcctccatccttatccatactactacactcaatcacacggacgccccccccccattaaccttaacttaactacatccaccaacacaacacataacccgactatttcatacaaccgcccgaaccaattatctatatatttccgctcactcacccaccgtcagactaacgcatgcgcggccccaccacacacactgcttggtcataccacctccatcccgattgattagtactaacacagctccggcacataacatatatcttcacacgccacacagtaggctgcgctcccccccaccccctacactaacataacatcaacccctccctactcccactgttgtgtctgtctcccacacaacaactatacgatgcccggccacccatcctacctgacgtaaaatataactacccggcggacgaatacaac

SEQ ID NO: 563046 - DNA, 162 bp, Homo sapiens
agtgcagtggggaaacagagatgagaggatagtacactgcagtcgtgcgaacatccgtaatctcaagtgatctcctgtctcaggcgcccaagtagtgattaggagcatgcgctgacgatgcccagaatccagaactttgtctatcactctccccaaccacag

SEQ ID NO: 563047 - DNA, 551 bp, Homo sapiens
aggtatggttggctcaggcccagctctgcaccttgattgtggaagctgagcataaaccaactttaaaaaatcagttgtttgtgcttggtttttaaatggggacaggatcggtatagtggctgacgcctgtaatcccaacactttgggaagtcaaaatgggtggatcacttgagcccaggagtttgagaccagcctgggcaacacggtgaaaccgcatctctacaaaaagtacaaaacagccaggcaaggtggcgcacacctgtagccccagttactcaagggtcttgaggtggaagatccctcaagcccaagaggtcaaggctgcagtgagtcatgatcacgccatgccatggcactccagcctgggcgacagagctagagtttgtctcaaaaaaaaaaaaaacaaaacaaaacacaaaaaacgtgttccataaaccctcttttaatatctagaactgctggggaaagtgaaaactcctggaggctaactttatttcctctaggggtttatattttatagcagtaagtagtatatattaattcacatttct

SEQ ID NO: 563048 - DNA, 199 bp, Homo sapiens
ttatcaaaaataatagttttaactggcttctagtcttctgttgcattactaatattctctcgagttgtattacagaaagtggagtattgaaatatcctagctatattgtatggctctcttagtagttcattcagtccggttagcatttgcttcatatagctgaaaccccaatatgagacgcacacacataatttatttg

SEQ ID NO: 563049 - DNA, 211 bp, Homo sapiens
gtatccgtatgcttgcaaagtctgacactcctggccacactattgtcctggggaccaggcatccctggattactgactccttgctaatactgggtctgagccctctggaacctttgggaccagtgaatcccagtctcaataatacctaatgagttcatgagccacattcttcttagaagtcagctctgtcttcccagaatttttatcttca

SEQ ID NO: 563050 - DNA, 181 bp, Homo sapiens
gaccatttcctttctgggagtcatgcggttttataaggctggttaatgtaaagccaagaagattaaaggaattgtccttttgacaacaaaattaaggtttcccggaataccttcaggaaaaatcggttcttcgaagaatcctaataggacaattgtgagagaaacaaatcccaattattgt

SEQ ID NO: 563051 - DNA, 186 bp, Homo sapiens
tgcttagaatttggggggaaatttagaaatattattggccggattattgggaatttgttataatgaatgaaaccttttgtcctattagattcatattttctttttatacctttgataaagtaaggcatggttgtggtttatttggtttatttttgttcccccagttaaataaatcataaaacttta

SEQ ID NO: 563052 - DNA, 1192 bp, Homo sapiens
ttgtctgtttcgttcttctgcgcggtcattgttgttcttgttcctctcacacgggtggtgtgtgtctctcctcctcttgtggatgttgattcgcggtcttgtacacctctgctgttctgtggttcttgttcgtctacttacttctttaccgatgatgtgttcccctttgttttgctttcgcctgtggcgtgtcctgtctttctccagggtggttttcacccattgtgggttcgtctggctcgctggtttcggtgtgtccccacgggtggatctctgggtggtgctctatctccgtgttattggggttatcctgtgttcccggtccagtgtatctcggtttgttatactctcgtgtcgatatgtctccctctatggctttcgatctaagtctcttttctcgggggacctattgtgcggtctttcatatgctcctatgaattgttgtctgttcaagggatgtttcgttcgtggctacgtttgctggtgactagcatattttgtacctcatcctattggaagcagctggcctcactggctcaggtgattatcctgaaccatccaggccttataagcgctcggctatgcccctgtattggattgccacacggctcacattgcatgcaagtttgctgtagctgtaaggttaaagattgatcgccgttctggtataatagctggtaagtatggccctataattcttgaagtctggtgatgctgccattgttgatatggttcctggcaagccctatgtgtgttgtagagctttctcagtactatccacctttgggtcgctttgctgttcgtgatatgtagacagacagttgcggtgggtgtctatcttatagcatgtggacaagaaggctgctggtagctggctaaggtcaccaagtctgcccagataagctcagaaggctaaatgatatattatccctaatacctgccaccccactcttaaatcagtggtggaatgaacggtatgcagaactgtttgttatcaaattaggaccatttaagtttagtagtaaagactggttaatgataacaatgcatcgtaaaccttcagaatggaaaggagaatgtttttgatggtatctctatttatggatatattatattatgcgagtggacaagtatattaaagatgaggtcgcaaattatattgcagcaaattattacagatgcaaatgtgaca

SEQ ID NO: 563053 - DNA, 413 bp, Homo sapiens
cagctctgattgtaggtcaccccttttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaaaa

SEQ ID NO: 563054 - DNA, 395 bp, Homo sapiens
gtactataagaggaaagacggagaaatcattctcgggacatagccagtctcaacactataaggcccaggattgcaactatcctttatacacaacactcgcctattatgcaaaagaacaccaaaaacttacagtaaatgatgaagacagtttatacttgccaatatatcaccctcacggctggcagaggtagcactagcttagtacacaatataaactggcactaaaaaaaaaacctggttcattattattttacgtctacgataactgtcaaataaagcgccaatttgcaacctaccaagcaacaaagtagactccaaaattccccttctgtcactctggcagaattcagcacagtgtcactttactaccttttcacttttcttattatattttt

SEQ ID NO: 563055 - DNA, 418 bp, Homo sapiens
  misc_feature (3)..(3): n is a, c, g, or t
  misc_feature (83)..(84): n is a, c, g, or t
  misc_feature (99)..(100): n is a, c, g, or t
  misc_feature (105)..(105): n is a, c, g, or t
  misc_feature (147)..(147): n is a, c, g, or t
  misc_feature (154)..(154): n is a, c, g, or t
  misc_feature (157)..(157): n is a, c, g, or t
  misc_feature (186)..(186): n is a, c, g, or t
  misc_feature (188)..(188): n is a, c, g, or t
  misc_feature (190)..(191): n is a, c, g, or t
  misc_feature (212)..(212): n is a, c, g, or t
  misc_feature (223)..(223): n is a, c, g, or t
  misc_feature (250)..(250): n is a, c, g, or t
  misc_feature (279)..(279): n is a, c, g, or t
  misc_feature (293)..(293): n is a, c, g, or t
  misc_feature (299)..(299): n is a, c, g, or t
  misc_feature (306)..(306): n is a, c, g, or t
  misc_feature (313)..(313): n is a, c, g, or t
  misc_feature (395)..(395): n is a, c, g, or t
aanaattataccacaaaacatgatattggatttatacactggatcccaggaatgtgactcactgggaaaaaatgttcgactanncatcttcactcaacnngccangaagttatataacacacggtaaacatccacctggctcaaggngcaaatncantacgtacagcattggcagtagtgcgtcanangnngcagaactatttcacactaancagttgaagantacacaagattaataccatccagcatnaggatatagctgtggattttacaaaccantcttatttctaacntcaggngttggtnttttttnctgtccatcttaaaatattactgctttaatcacagatcagataaaaaggacaacatgcacaacctgccacgctagaatcctnttgtaggcgctaaacagtgaaat

SEQ ID NO: 563056 - DNA, 232 bp, Homo sapiens
  misc_feature (91)..(91): n is a, c, g, or t
  misc_feature (97)..(97): n is a, c, g, or t
  misc_feature (104)..(104): n is a, c, g, or t
  misc_feature (108)..(108): n is a, c, g, or t
  misc_feature (131)..(131): n is a, c, g, or t
  misc_feature (173)..(173): n is a, c, g, or t
ccagtgtggggcatcactgtgaagaggcacgggaaaaatatggcaaagacttcaaggacatacggcaagattttcttcctgggaaatcatngactancatcatngaanattattacatgtggaaaactacngacagatatgtgcaacagaaacgtctaaaagcagcagaagcngagagtaaactgaaacaagtatatatcccaacctacagcaaaccaaatcccaaccaaat

SEQ ID NO: 563057 - DNA, 121 bp, Homo sapiens
cgggtctgaagctggcgggtcagcttctgcgtctctgctggtgtctctccttctctgaccgcggctgagccctgattcgccttcctcactgctgggcagcttcccaccacctggagcagcc

SEQ ID NO: 563058 - DNA, 898 bp, Homo sapiens
  misc_feature (161)..(161): n is a, c, g, or t
  misc_feature (181)..(181): n is a, c, g, or t
gagagaagcggaggccctgctcaaaacagcgtctcttattctgagccaaagtgttcattctcaatgcaatggtagtcatcaaataccatcaagtcaaatatcacaatcctctcttttgtagcttagtctaatacagggattcccatttgagggggcttatnaggatactcaggctttttangaagacatacctacttcttcgtattctgaaatgcagtgtggattccagagtttctacataggagaggctttgaaaatgtaatctggttgtatggcagggcaaagggagatgttttaaaggtacatttatatagcaagtgcaccctttttttaaaaaaaacctagattcctttttgtttgtttattgggggagtaaatggagattagtttagtactccaaccaccgcctgtatgcaccccaccgcatgacatgcgccccctggtggagagttactacctctacaagtggaacaccctgtaaagtgaaaccctggaaaagtttcaatgcctgcattctaggcatagattccgccacagaattaacataacctccctgagtctcagtgtcttcatccgcgagatgggaataaggaaatctgctggacctgcttactttactgggctgctgtatggaagaacacaatgagaatgaaaggcgtatatcaaatatccgctggaagtagttagttttacaattcaaatgaaatgaacatgaaactatcccttctcaaggacagttctatctttttcctttactggagtttatatttctcatttttataacactttttttgtactatggtgtaatgctgggagaccattcctgtgagaccagaggagttaaacagaacctggagaaagagatcataacaatagctaacatttattgagtatccga

SEQ ID NO: 563059 - DNA, 1061 bp, Homo sapiens
gcgctgggctgctggggggcgcgggcgaggactcggtcggcggacggcaagcgatggccgtgccgagggagatcgccctgggcgcttactcgccattggactacatgagctagtcaccgagcttcccgcggctgccctgatggacgaagccggcgcctcgaggcccctgttgagggggctgcaagggaacgaagacgccattcttgggagacccacgacatgcgaccgctggtactctctttaccatgaaagtctgtcgagcgggcgtgcacgtcgggcatgccctatcaggacagtcaggtctgcgagattgggcaagtccaacgacgcgtggtccgctcagctatggacgaagaaggctacagagaggaccgcggttgcttcgcgccacgcaaagcgtggggactgatgcttgctaccctagccggccaagtggcaattgtgggcttcacaggggttcatcggtacaagcgggcctgtcgtcacgcttcgttaacgcgtgtgttccccggtggcgcctgcggtcgatgccagattctaacttttcgggggagatccccctacaagaagtcattcacaattccaggcggattgaccacggtgggttgaaccccggagttgcgtagcaactcgggcatggaagcaataccgagcatagagagccatccggaaggagttggcctcaaggtacaaaccaagtggtaattcgtacttggaggggacagcaacgcctgcggtgtgcaggcaagggcctaagatgagtacaaggcggagataatacgctgaaggaccttctccaaccaaagagaattttccttggggagtcctgtcgtagcgcagaatgaagtggggggcccttgtgaactggccatggagctaagacattttgaaagaaatcctcggaacataaatattggaagatggcaacagccgttacatgttaggaagtattacacgggaggaagcatccccgaacaatgcgagggcgggttccccatctagacgagtataagaaagaaacccgttcacgaaactagaataccttggagagaaggaaccca

SEQ ID NO: 563060 - DNA, 415 bp, Homo sapiens
acacacgtgagctactataactccaccatcttcttgccccatagaatactgataattacttatcactcttccatcgtgataccctcttcaccagttaatggcatacgtgtatatcaatggaggactgtttaaatcaacagtgatgtcaacatgtatatgcaatattaaactgcccagcagcacaaataaaatagcctgactgtactcttaatagaagtggtgtagaattggattaatcatgaacactgatacatataacattctcatcattggtccatgcatgttctgcaatatattaatatgtagagctatttatttcttttaaataatacagtcaacatccatgagcaaatcatccaaaccaagaacaaggaccctgcctgtcctgtcatcagacaatgtttgcaggatcctc

SEQ ID NO: 563061 - DNA, 578 bp, Homo sapiens
ttagattttaactaaatggagcagctccttataatacaaattgtatagtaaggatacaacactaattaatatgttttcagtttaatttgttatgtattttttaattatcaagaaaaagaaacagttttgtacatttgaggatttttttttcaacagctttcatctgtattgtcttaacgtggaactttaacacaccagaaacgaaagttgttaaaagcagccttctagcacaaacacttttttaagtaaataatggtagcctaaaacttaatatttttataaaatattgtaatattgttttatgaattattaaaataaaattctttgttgaatgcatctatgtattcttttctgttgctctttgtatttcattaactttgtaaattttgacatattctgaatttattcttccattaggggaaaaatgttcagttagaacatccttggaaatccttaacagagttaaaatcgtctcttcttacatttagaatactgttgaatttatttcacatgactaatttcttgtgtctagtaaatgatatgttctaaaattgtatcagcaaatacagttactgtat

SEQ ID NO: 563062 - DNA, 177 bp, Homo sapiens
agagggctgtcagatgcatgagtataccattgaaggccatgatgtcccacacaatgatacggctaaccacaactgtccctggggccacaggggcccaggaactgttgtcagggcctgcgtcgctgatgatgaggctgaggcctgagtgggccggaagcaacttcccctgggggcggg

SEQ ID NO: 563063 - DNA, 352 bp, Homo sapiens
catctttgaagagcctgaggaccccagtaacctgctcattcttctacgtgaaatcatactacctacctgtgtcctgactgtgatgttcatgccacagctggccgctacattgctcacccttggactaccttaacagtacaatggtctagggacctagaacataggaggcatgacccatatgagacctaccaggtccatgactacctatcggagcaagctctgttccctgtacgagaacgactgcatatttcgacaagtttgaatgtgcctggaacgggagcgacagcgtcatcatgaccgtggtggcctaaaacaaacttcttcctgcatgtcccgcttggggtaccgagct

SEQ ID NO: 563064 - DNA, 148 bp, Homo sapiens
tactgcagctgaaacggtaagaatcgctgtgacggtggtacctgtctactgagtagcctcctcagattcattgaactaggtctgtcccaatgtatgggatggcggatagtacgtttgtacttactgtggcacctccttaatataaacg

SEQ ID NO: 563065 - DNA, 122 bp, Homo sapiens
ggatccttcaggagcgagactgggggagctgttcatagaccacctggatcctatatgcctgagaattgggcagtgtggtcctcagacgaaactctggtgctattactgtagcgaagggaaaa

SEQ ID NO: 563066 - DNA, 1893 bp, Homo sapiens
  misc_feature (248)..(248): n is a, c, g, or t
  misc_feature (957)..(957): n is a, c, g, or t
  misc_feature (1297)..(1297): n is a, c, g, or t
  misc_feature (1552)..(1552): n is a, c, g, or t
atcaaccgactgcgttgtcgcgccagataagtgtaagacatagaccgtacttgtctctggggcgggacgataagacaagcaagcacacagtcgatgttggagagagtatagctgctggcggacagacacgagagtctctcgcgcgcggagttgcgacccaggaggcagatgcaccatcgtcggtcgctaggtctagtgtggtgatccccgcgtggggattgcgtcgacgcaaggagtagtcgtcgcgnagtgactacgccggaaacacgtggggacagaatagttcgcggggcacaccacgtgggtgccggagtttctttgagacaccggcccttgggagagagtgatctctccactttgtgtcggagtgggaagttcgcatccctcggtgcgctagctgcggcagggggatagtattattcagggggagccctgttgattaatcacagggggggggatattacaatagtggtgtctctctgccgtccatgacagcagggggggcaagctatacatttcccatagtatcatggaacgcccgtggtggcgggtggtcgcttataatcatgatattgtccgggcgggggtgcgtgtttccgtgaaattatgtcggtgcgctccgcaacgtgggggcgcgcaaatgttacgcgttagcctgctccgatgatcgtctcccgcatgtaggtgagacatccactctggcgcctaccgacgttgtcggctttggtgggttgtgatgtgtcataggggagcttgatgtgtatactgggctcggtccaacgtgagtgccgcccggtgggatctctcggctgtcctcgcttgttgttggctacgttgcatcatatttgggggctcgtgtgtctgtctttaggcgcccctgctatgtttgtggtagcaactacggccgtgtgatgtgatggtcttgtgtgagcggcggggccggtacaagatgtgagngtctgtagctgggtctaagcgtctgtctctcgcgcggggggtgtaccactacattatgtaggtagagcccggtggagctgacacactgcaagagtggcttcaaactacatccgcggggcccaacgcgtcgtgccggtgaacagtagttttttgtcggagggcgtactagagaatactagtcgtctccacgagaagataattgttaggaggggggggggagcgcacataagaggacccctggttttcttctattcacaacgaggcgagtggtgcgtctatgggggtgtcgcctacaatgcgggttgtcatcttctcgtcgcggcgggggcgtcacatcggngggggagacgcgcacactctctcgtagccctggtggttctctcgctgatgcggataacgagaggcctctcacatagaaaagggattgatttctctataaagagggactcgcgcgcgcactccctcgtgcgcaccacacactcacacacacacacacacacgcacacgcgggggaacaccacaagagagagatcccacgcgtgaagagatttctctccacatccgctcgggcgagaccactgcagaaccttctttngaagagaaattctccacgcttggtcgtttgttctcccacagcccggcatttcctcggcctcgtaagatgtgcccgcgggaatggtcttctagaaaagggggcgcatatgcagatgccgacaccaatcggcaacccgcgtctgccggtgttttgatacacacggggtggagaagggaacgcctaggcagtacccttgacgtggggcccacaggcgtgaaaacactcccagtacctgagacctagagtccaaatgcttgtatggaaccatactttgtgttttaacgtaattattttaaaccaaaccccccccgttttcccaaattgtaaaaagaaaaaaaaaa

SEQ ID NO: 563067 - DNA, 116 bp, Homo sapiens
cacacgtaaggggtagggggtagactaggacaagaacaccctgagaaagtatttgtacagcacaagctttatgaggaataggagaacacagggtaccgatgctcaaacttcgtaat

SEQ ID NO: 563068 - DNA, 186 bp, Homo sapiens
agagttccagaccagcctgggcaacatagagagaagccccatctcttaaagaaaattaaggaaaaaatgatcaatgacaggatatgtggattttttccttaattttctttaagagacagggtttcaccacgttggccaggctggtctcaaactcttgacctcaagccatctgtccacctcagcctc

SEQ ID NO: 563069 - DNA, 227 bp, Homo sapiens
  misc_feature (14)..(14): n is a, c, g, or t
  misc_feature (16)..(16): n is a, c, g, or t
  misc_feature (19)..(19): n is a, c, g, or t
  misc_feature (36)..(36): n is a, c, g, or t
  misc_feature (40)..(41): n is a, c, g, or t
  misc_feature (67)..(67): n is a, c, g, or t
  misc_feature (79)..(79): n is a, c, g, or t
  misc_feature (87)..(87): n is a, c, g, or t
  misc_feature (95)..(95): n is a, c, g, or t
  misc_feature (105)..(106): n is a, c, g, or t
  misc_feature (108)..(108): n is a, c, g, or t
  misc_feature (114)..(114): n is a, c, g, or t
  misc_feature (116)..(116): n is a, c, g, or t
  misc_feature (120)..(120): n is a, c, g, or t
  misc_feature (143)..(143): n is a, c, g, or t
  misc_feature (154)..(154): n is a, c, g, or t
  misc_feature (193)..(193): n is a, c, g, or t
  misc_feature (205)..(205): n is a, c, g, or t
  misc_feature (225)..(225): n is a, c, g, or t
gcagccaggtctgncngcncagatggcaaccactgnagcnngcgtcggctgtgggctctgctgtgcnggcacacatgtnggtcacgncattactnggggcttcanncngaggangnaatnctgagcctccgaggcctgacatnacttaccaggngcctcagggaacccagccagcacagcagcagcagccttncctctatgagancaaacagtttctggagtgtncc

SEQ ID NO: 563070 - DNA, 264 bp, Homo sapiens
ctctgcttcagcctcccgagtaactgggaccacaggcaagcgccaccacgcccagctaggtttgtatttttagtagagacaggatttcaccacgttgcccaggctggtcacgagctcctgacctcaagtgatccgcctgcctcaacttcccaaagttctaggactacaggtgtgaaccaccacgccagttcagggagtaatttatttagcacctactatgtgccaagcactgttattggaactttatgacatatgacattcatg

SEQ ID NO: 563071 - DNA, 977 bp, Homo sapiens
  misc_feature (1)..(1): n is a, c, g, or t
  misc_feature (148)..(148): n is a, c, g, or t
  misc_feature (260)..(260): n is a, c, g, or t
  misc_feature (271)..(271): n is a, c, g, or t
  misc_feature (282)..(282): n is a, c, g, or t
  misc_feature (284)..(284): n is a, c, g, or t
  misc_feature (295)..(295): n is a, c, g, or t
  misc_feature (317)..(317): n is a, c, g, or t
  misc_feature (343)..(343): n is a, c, g, or t
  misc_feature (362)..(362): n is a, c, g, or t
  misc_feature (366)..(366): n is a, c, g, or t
  misc_feature (372)..(372): n is a, c, g, or t
  misc_feature (403)..(403): n is a, c, g, or t
  misc_feature (405)..(405): n is a, c, g, or t
  misc_feature (425)..(425): n is a, c, g, or t
  misc_feature (656)..(656): n is a, c, g, or t
  misc_feature (661)..(661): n is a, c, g, or t
  misc_feature (664)..(664): n is a, c, g, or t
  misc_feature (674)..(675): n is a, c, g, or t
  misc_feature (696)..(696): n is a, c, g, or t
  misc_feature (698)..(698): n is a, c, g, or t
  misc_feature (704)..(704): n is a, c, g, or t
  misc_feature (706)..(706): n is a, c, g, or t
  misc_feature (710)..(710): n is a, c, g, or t
  misc_feature (713)..(714): n is a, c, g, or t
  misc_feature (750)..(750): n is a, c, g, or t
  misc_feature (755)..(755): n is a, c, g, or t
  misc_feature (840)..(840): n is a, c, g, or t
  misc_feature (961)..(961): n is a, c, g, or t
naattcccgggatggacagcacagctgacagccgtgctcagacagcttctggatcctaagctcatctccacagaggagaacacgcaggcagcagaaaccaaggggcccctcccaaccccttcctgcacacagacgcaacacctggaanggctcctgctcacaacatcacatttaaacttctggaacccgcccaccactgccgaaatcacgattgaagcccaaccacccaaaatttctgaagggaaggatgttcttctacntgtccacaaantgccccaaaancntcctggctacntctggtacaaaagggaaaaaanggacctcaaccaaaacaaaaaaacgnaaaaaattaaaggtaaaanaaanaaatangggcctgcatacagtggaagagaaacaaaanantccaacgcatccctgctganccaaaaagtcacccggaaggatgcaggaacctacaccttacacatcaaaaagcaaggtgaaaaaacaaaaaaaaaaattcgacatttcaccttcaccttaaacttggagactcccaagccctacatctccagcagcaacttaaaccccagggaggccatggaggctgtgcgcttaatctgtgatcctgagactctggacgcaagctacctatggtggatgaatggtcagantttcnttntttttttttnnttgcagctgtccaaaaccaanangacccncnaacnaannggtgtcacaaagtatattgcaggaccctatgaatgngaaanacggaacccagtgagtgccagtcgcagtgacccagtcaccctgaatctcctcccgaagctgcccatcccctacatcaccatcaanaacttaaaccccagggagaataaggatgtcttagccttcacctgtgaacctaagagtgagaactacacctacatttggtggctaaacggtcagagcctccccgtcagtcccgggggtaaancgacccattgaaaaca

SEQ ID NO: 563072 - DNA, 1190 bp, Homo sapiens
  misc_feature (955)..(955): n is a, c, g, or t
  misc_feature (1044)..(1044): n is a, c, g, or t
  misc_feature (1075)..(1075): n is a, c, g, or t
  misc_feature (1077)..(1077): n is a, c, g, or t
  misc_feature (1080)..(1081): n is a, c, g, or t
  misc_feature (1084)..(1084): n is a, c, g, or t
  misc_feature (1114)..(1115): n is a, c, g, or t
cgtgtctgtaagcgcgtgatggttgctgatgtcttctgtgtaccacttttaactgtggttcatgagctcagtcagtgttggcgtgataatgtggctaatcccttgtggcgcgtacgtgtgtgtgagcctgtgccagtgtatgtggcgatattcctgcttatggcctggtttgagattgcgcctcatgtgttagggcaccagctctcgtgagatgtgcgtgtaatttatggtatatctcatgtccccaggggtggtcgggtttcgggcatgctctattgaggtatttgcatcgactgggtgtccttgttgggggtgaaaattttcgtctttgtgtcggattgtggatggattcgtgttgcgcgtgcaatccctggtgtgagtcccgcgaattgctgccagtggcccgcatgggtatctgcgcatatcttacataggcagggttcgttgttcaagcaaaggagtatgggtgcggcgggtttgatgatccatcttgggtgcgaaggagaggctcatgctcatgttgtttccatgtatatagaatgagttggcgcaggccgtatgtgtcgttcaagagttgggtacgtaagccgattggtccagaagaattcagtggaatggcagtcttcggggcgatggacattgacacgagaagggagagtgaaggtgggagttatgagagctgctgtgtgtattgcaagcctggtggtccatctgattgatccggataatgaagtggatgactcgtgtttgtcggtaatagagtataaggccaactgtcaaagatccagtgtagaacctatgctgccctctgcttcacacctctgcttggagaggatcaagtgcatgcctgtcagttttagaagcaagtaatatcatcctcgtggtcaagagcagtgtccgtggtgtgcagattcctctccaattgctgcgtggtcgtggcccgacctctcacggnatgacagccttcgtcacccagcctgtgagggtcctgactggagcaccttctaaatctaagattctgctgaggagcccccgttggtcccnctgggcatgctgtgctcggacggaaagcggngnctnntgngtccttgtgtccctgcctgctgaagaatgnngctgcgtctgagggcaagacgctgtctgctgccttcagtacagatgctgattaaagatgatagcgatacagaatt

SEQ ID NO: 563073 - DNA, 423 bp, Homo sapiens
tgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagcaaaaa

SEQ ID NO: 563074 - DNA, 354 bp, Homo sapiens
  misc_feature (349)..(349): n is a, c, g, or t
cacgtgttgcactctctacgaaaaatacaaaaattagatggatgtggtggcgcatgctgtagtcccagctactcgggaggctgaggcgggagagtcacttgaacccaggaggcggaggttgcagtgagctgagatggcaccactgcactccagcctgggcgagagagtgagactctgtctcaaaaaaaaaaaaaagaaaagaaaaaaaaaaaaaggggactatactagtgttccgaaaagtgtattttcggtcccatacggaatccagggtttcttcccctaggtgattaaaatacaagaaaaacgttaaaggaggggcaacagggggttcccggagctcgaaattcgntaatc

SEQ ID NO: 563075 - DNA, 465 bp, Homo sapiens
gggacttaaaacatgaagaaaaatgaattgggagaaattcaactgagcaaaatgtatttttctttcttattaatgttgttttacttacacaaaaccacagagaagtagctagaatgagagtcttttaataaaagtatgagatgatccgggaattatgagggaattgaaatcttaaaaaaaaattaaattacttgtatttaaaaaggatgggaagcctgtatcaatgcagcatttcccagctgtgttccttgaaatgttagtttgtttagatatgttcctagaggactcatggggaaacagtaagtttcagaaaatgcttgaaatgtagtccacatttaggggctcctaggacttattaacatttttgggtctctgagaagtcttaaagaacctgttttggctggtcgcagtggctcacacctataatcctataatccaagcactttgggaaatactaggttaatc

SEQ ID NO: 563076 - DNA, 118 bp, Homo sapiens
cactggcgcaggcggtgcctctaatactggtgactgctaaggtgatgttttcggtaacaggcggggctaagattgccgagttccttttacttttctttaacctttccttatgagcatg

SEQ ID NO: 563077 - DNA, 243 bp, Homo sapiens
gcccccaaaacccccccttttgaggaggagccccccccccccccacgagaaaaatattttttttgtggggggggggggccccccccccctccctttttattttaccccccccccgggggggggggcccccccaaacccccccccggtttttttttttttttaggggccccccgggggggggttttttttttttttttttttttttttttttttttttaaaaaggcccccccccttttttttta

SEQ ID NO: 563078 - DNA, 365 bp, Homo sapiens
aggtcgatctagaggtccccggtgggagacgggggtctcactggtgagcaagacggtctccatctcctggacctcgtgatccacccacttcggcctcccaaagggcggggattacaggcatgagccaccactcccggcctcataaatatttaaagagtagaaggtgatggcttagaaagtatgtcagataaactccagctggggtttggtgccagtaaaatgatgtagtaatgatttcccttcttggggggggggggtggaagaggataattctagtccatagaggggccaggtataaatcagggcaggcaatattatgtgatgataacaaatagccccaaattttagtggcttagtacagcaaa

SEQ ID NO: 563079 - DNA, 429 bp, Homo sapiens
cttagccgtcaggtagaacgcttactcacctgacaccgacttcttagagaagcgagtcttttttgaatggaggagcgatggtaaccacactagggggcgcccatgatcggctcccagtgcacccccttaagggtaagcaggccgcatatctagagtctgatagtctgtgtgtacataaggtctagaagtctgtggaaacgccctgaaacttgtagtattatcttcactaccctcttatgttaaggtctacataataggatttctacaccaatgcgtttaattctctacgatctcttcgtattaaaattctcttctggaataagctgtggcaatcttcttaccacctggttgacatcaacctctctacaatgacacaacttctgaccttttataaactagctacttccgtgaaaaaacacaacacaaaac

SEQ ID NO: 563080 - DNA, 392 bp, Homo sapiens
  misc_feature (5)..(5): n is a, c, g, or t
  misc_feature (13)..(13): n is a, c, g, or t
  misc_feature (180)..(180): n is a, c, g, or t
  misc_feature (350)..(350): n is a, c, g, or t
  misc_feature (358)..(358): n is a, c, g, or t
acaanccttaatncccttatggatcacatgcctcaggtttttgttgtttcagttttccttgaaaaatctgtgcttggtgcctttcccattttgcccaggagttaaaaatagatactattggcccaggcgcagtgactcgtacctataatcccagcactttgagagtctgaagtgggtggntcatttgaggtcaggagtttgagaccagcctggccaacatggtaaaaccccatctctactaaaaataaaaaaattagcgtggtggtacatgcctgtaatcccagctaatggggaggctgaggcaggagaatcacttgaacccaggaggcagaggttgcagtgaaccgagntcacgccnccacactccagcctgggcaatggagtgagacttc

SEQ ID NO: 563081 - DNA, 367 bp, Homo sapiens
cccccaattgggttttttcccccccctgggggccaggtttgtcctccaaagccaaggggttcccccaatccctccctttttttcccaaatttaactttttgggctttccccccccccttcccaggggttaaaatttcaggggctacccccgggccctttgcggctgatttgggggttttgtttaaaaaaaaaaccgggggggggggattttttggaaaactgggggtggggggaaaggggggatgccccagttttggggttttgggtcccgttccggggggttatggggtttttccccccccccccccccttttttttttttttttaaaaaaagccaaaatgggaataaaccccaggggcccgggga

SEQ ID NO: 563082 - DNA, 104 bp, Homo sapiens
ttactgagtctctgtgtagtgcggctggtctcttgagaagctctgcttggccttgttctcctcctcagccagcctctcaaacatattggcatagagcttcttct

SEQ ID NO: 563083 - DNA, 311 bp, Homo sapiens
  misc_feature (271)..(271): n is a, c, g, or t
  misc_feature (281)..(281): n is a, c, g, or t
agagtataaaaacactgaaaaaattaaaatctgctattaatagactatcccaaaataaccactgttaatgtttttaaaaatattttatttgaaattcttccatgtttatatattgtatatattcatagttgagattatacttgtatacaggtctaaatcatgctttaaaactttataaactttaagcattttatgagtcattaacaattcttttaagcaacttttttttttttttttgaaatgcagtttcgctcttgttgctcaggctggngtgcaatggngccgagattgcgccactgcagtccgcagtc

SEQ ID NO: 563084 - DNA, 329 bp, Homo sapiens
atgtaaatactctcatgacaatgaagaacatcaaaataggaggtgaggaaagtgcaacatgacaagagtatctaatcagcctacaagaggagtcaagatcctctacctcggctgtgctggaaagtgtgactacacacctcacggcccagctacgcatatcctacaaagcaggcagaacacctagttatgcaaagagcatcactcacagaccactgcagaccacctgggaggtgtggagcttctatctagtagacaagcctgccaaggaaactacacaggcccagagacaaggagaaacctagaaaacaaggtagaaagtcttggaaaag

SEQ ID NO: 563085 - DNA, 171 bp, Homo sapiens
tttttttgccccccccccccggttgggccgggccgcttcccccccccggggggggaaaaagcctttttggggccccttaaaaaaagccccatttccaagggggaggggggttttttcccgggcccaatttttccgggggggggggttccctaaaagttttttttcccctga

SEQ ID NO: 563086 - DNA, 117 bp, Homo sapiens
gcgcctctttatgtgtcgccctggtctttcctaatgatattcctgagagcttctctgggtcactcttgtcatagagtttcaatacgtaaagccacacggtcctggtatgccctctaa

SEQ ID NO: 563087 - DNA, 358 bp, Homo sapiens
  misc_feature (35)..(35): n is a, c, g, or t
  misc_feature (62)..(62): n is a, c, g, or t
  misc_feature (241)..(241): n is a, c, g, or t
  misc_feature (243)..(244): n is a, c, g, or t
gaatgaataaaagttaatttattctatatcctcangaaggcagaagggaagatttcagtgtncatgacacaaatgataaatgtttgagatgatagatatgctcattaccctgagttgatcattacatattgtatacacatatcaaaatatcactgtcccataaatatgtacgattattatatgtcaactaagaataataggggaaagaagtaatggaaccgtatactcgcagttgtcaacnannaaagtaaataaatctgccaaggagtacacttggcctgtgtggaggaaattattaacattttctgaaggacatcaaatgatattagaataaatgtcggaaacaaggaaatgttac

SEQ ID NO: 563088 - DNA, 774 bp, Homo sapiens
gcggagttgtaacgctccatctgactgagtagagcgaccggacgatcatggcgcccggagtggcccgcgggccgtcgccgtactggaggttgcgcctcgagtggcgccgcgctggtcctgctgctcatcccggtggtccgccgcgcacgtagcctcccggatctcgtcttgttctctagtaacagaaagaaaatctgtgaagcagtgcctgacagaaccgtctcctgtctttggttgcaatactaacaaggcttgtctggactacccagttacaatgcgtcttgccaccggacttccctttgtaaatttgagctctgcacgctggggagttggtagggtgaactttgaggcgctgatcatcaccatgtcgcgtagctcgggggaaccctcctcctgggcattgccatctgctgctgctgctgctcgcaggaggaagaggagccggaagcctggacaatggagatgaggagaaggccatgcgtgagcgggaggagaggcggatactggcagagagggaaccgcgacgtacgtccagagcatgacgctcgacgtaccactgctgaccatgccgaacagtcgtgtactgcgcctgttccagaaataggacccgtatgctatcatgcgaagcagggtaatggggctccaacaaattcagttgcgatgagccttcctgatgaggtgcacactgtggaagaccagagccagacagggaacaccaagttgggcatttgcggcttctggactcggccaatgaacctagcacctaccacgacg

SEQ ID NO: 563089 - DNA, 373 bp, Homo sapiens
  misc_feature (321)..(321): n is a, c, g, or t
ggaatgaataaggttaatttattctatattctcaagaaggcagaagggaagatttcagtgttcatgacacaaatgataaatgtttgagatgatagatatgctcattaccctgatttgatcattacatattgtatacacatatcaaaatatcactgtcccataaatatgtacgattattatatgtcaactaagaataataggggaaagaagtaatggaaccgtatactcgcagttgtcaacaaaaaaagtaaataaatctgccaaggagtacacttggcctgtgtggaggaaattattaacattttctggaagggacatcanatggatcattaggaataaaatgtccgggaacaagaaatggttaccatttaaa

SEQ ID NO: 563090 - DNA, 113 bp, Homo sapiens
tgtgaccagttgcgacagacagcgccaagaacctcatcatcttcctgggcgatgggatgggggtgtctacggtgacagctgccaggatcctaaaagggcagaagaaggacaaa

SEQ ID NO: 563091 - DNA, 141 bp, Homo sapiens
tacgtaggtattagcgggttaaggatgagctactgtagagcaagtacatggcacaacagtgcttatgatgccctggatgaagttaagagggcaccgagtcagacaaaatactattgacgcctggtggtggatatgcgatga

SEQ ID NO: 563092 - DNA, 368 bp, Homo sapiens
  misc_feature (148)..(148): n is a, c, g, or t
tgtgtggtgatctagaggatccgaggtatgtgtgtagaagagcttcgaacgtgctcactctgcagtttgcctggagactgctgtgtagtatgtctgctgtctccatgaatcgggtcacatctcacgggtggctccaagctgtcttttngcgagacatgtcctgcttcaatttcatatttgtggctaaggcttcctggatgactcctgatgagagtgatgacacctgcttcccttccaggttttgttcaacttccccaatagactgcaacaggctctccaggctttcctggacactctgagattgggcaattgctttctgcagcagagaagatcgctcagccaggctataggagaggctttggaagtgg

SEQ ID NO: 563093 - DNA, 215 bp, Homo sapiens
actaccggccccagttcacagctcccactctagttcaaataaagtatcttataactaagaatacctatagaatgaagcagatatagaatctgcttctattatcggccaagggccgttgggaggtggggagaaatggggagatgttagtcacagggcacaaacttgtagttataggatgaatgtgttttgggggtctaatgtactgttgtaactgg

SEQ ID NO: 563094 - DNA, 840 bp, Homo sapiens
ttccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttatggctattgtagatcttcctgggagaaatgtctatgcagacttttgccaattttttaatttgtccatttaaaaatcagggttttttttgttgttgagttgtaggagttcttttggtattccttatactagtcccttatcagatatatgcttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgtattacataaggtctttgagccattaagatctttgacttaactttgtatatgatgtaaagtcactgtcaaacatcattctttgcattgtggtgtccaggtatcccagcattattgttgaaatgctacacttctttatattccttgatctctaacaagagttgggcctttgtactacatgcctgaaatgtgtccgggtactgaggcgggggcttgggaagaaaacctggggcccctggaaaaaaaccggttggaaatacctaaaacccggaggggtccagactgcaaccgggccaggg

SEQ ID NO: 563095 - DNA, 1301 bp, Homo sapiens
gggggggccaagggcacaggttacagggggattcttgctgccgatctaatatttatttaagcatagacagacttataattaatatacgttagttagtgacatagaaacagtcaactcggaaattaacgtcataagcacttgttctcatattatcaagtcatttcatttctacatgcctccacatcagcccatgtcaatattccagcatggatacccccgaaccaccatcccacccatgatttgttccacacactgatgatctcccatagccatgctaggagacaaggcagggcagggacagacacactatggaaaggccagaagatgaggagctgatcatggacacaaatgagggcaccctagagaggctagcacacagggtgtatcgcactgggaccaccaggacttctccattgagccacatgggatcctgggctgctatgatgtagggcagagtgggcggaggtgtcataactgagtgccatgcaagatcttgcagacggcacatggacggagtggtcgtcgaaggtatccatcctgagtagcggacgggcagacaccggccccactctactatctagagagacggacacaacactgacgagacgtgacctccaaagaaagaagttaccagagcacacctattcacccagagacacggcgtgacgggggttgacactcgcgcaacagggcatcatgaacattgcaggccagacgggacaacccagaggattgttgatcaagaccctgggacagagggaacacacaggacaggcacacgggaggacagaggatacaccctgaacaaatgatgcaagcaatcatgggaacatgcatatccagacacaccccaaaccccacacacagctcaagcgcagtcagagccacgagaacacagcaacaccacagacgaaaatcagaacatcaaggacacacagaccacaacagtacacgagcgagtcgaacaagccacaactcacacaaccacaaacatgacaagcgacaacgaacacaagtcaacaaactggaatcacaggacgggaaaagcaaccgaaaatatacaacgagaacaaggaagaccaaagacgaggacccaagaacaactcgctaacgctagaaaacaaaaagagaacggaagagacaacacaggaaagaaaaaagaaaacaacacagaagcagcataaacaagacaaaacaagagaccaagaagcgaccaaaacgaagagacaatacaagagaagagagagaccacaacggaaaccacacacaggcgatgcaacgagacgtagcaagaacacaaa

SEQ ID NO: 563096 - DNA, 229 bp, Homo sapiens
  misc_feature (24)..(24): n is a, c, g, or t
gctgtctcaaaaacctaagagtanaacagcacaggccagaatctggccatagtttgctcacccctctatttcttttttttccccagaaacccttgtgctgagacccctcttttaattagacaaatcttcaaggagttgctatgtagtacagagtaagggggagataggagttaaaagatcttctctagcttttaattaaggtgaggcactaaacctgttttacgccagt

SEQ ID NO: 563097 - DNA, 790 bp, Homo sapiens
  misc_feature (203)..(203): n is a, c, g, or t
gagcagcggggctgccacagctcctcaccccctgaaaatgttcagctgctccaagtttgtctccacatccctccttggtcaagagcacctcacagctgctgagccgtgcgctatctagcagtggtgctgaaacgaccggagatactgacagatgagagcctcagcagcttggcagtctcatgtccccttacctcacttgtctntagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgggtctggttggccccgtgtgttccttttcctatacccccccaggcagcctggggaacgtggttggctcagggtttgacaaaaaaaagacaaataaattctgtttatttagcctgggggaacaattgaggccaattgggaacttgttcgcccgcttggggccagtttactctagacttggggaagttaagaatgccgccaccaataaagcctaattggccattccccttatggtgggggtattacaattaatggcccggggttaaaaggaagggattggccctgcgttactttg

SEQ ID NO: 563098 - DNA, 273 bp, Homo sapiens
tgcgggtctcttctgacggggagagctatgctgggcatctacatccccacccgggccggtgctgggtcatgcaggatcccagcatgaaccttcaggggctggctgtgggcaagggactctcctcctatgagcagaatgacaactcccgggtctacttggcctactaccatggccttctggggaacaggcttgggtcttctctccagacccacggcggctctcaaaacaagtgtaacttctatgacaacaaagaccgggaatgcgtgaccaatc

SEQ ID NO: 563099 - DNA, 865 bp, Homo sapiens
  misc_feature (278)..(278): n is a, c, g, or t
cattcgtgtggctcgcggtctcatttggtaagtgagcatgttccttgctgttgtcttatgagatcctgatcatgactagtgcttggattttcgacctacataatcacacatccgctctggggagaagacgccgaatcgttctgtgactaatccgagcatggtagttctgcgaggtcgatgtaggtggcatctcatcgagcaatgcgagtccagattgggaagtctgatatcagatttgacgccctgatattggtgccccttataccctcacttgtctntagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgggtctggttggccccgtgtgttccttttcctatacccccccaggcagcctggggaacgtggttggctcagggtttgacaaaaaaaagacaaataaattctgtttatttagcctgggggaacaattgaggccaattgggaacttgttcgcccgcttggggccagtttactctagacttggggaagttaagaatgccgccaccaataaagcctaattggccattccccttatggtgggggtattacaattaatggcccggggttaaaaggaagggattggccctgcgttactttg

SEQ ID NO: 563100 - DNA, 115 bp, Homo sapiens
ttctagaggatcctaggtggtgtgggtagggacgtagcaatgttgtacttacaggacagaattcactccaaatttacgagtgtggttcgggatgtagaagctgaaactatgtaca

SEQ ID NO: 563101 - DNA, 979 bp, Homo sapiens
cagtcttgatccggactggaaccatggagggtgtagaaggagatgaagaaggaggttccattgttgtgccagaaatccttaagaaaacgcgacggaatgcgcagagctggaataatcaatgcgcccatgacaacaggatagattggcccagcagagagtgctgtcgcaaagggcagggccgcgacacgtcttactctatgacataagcacgccacgggcactatgcacagaggacactatagggccgagtgtacacgacacctggcaattcgaatggggaggatggtaagaaaagtctggctaacttctatgtacctgcagataacaataatggttagtgagtcactcaggtaaatcagtcgtgctatcaattggagtgagcaacaaatggttcggtgaaggtgtgagccagtttacattacgtcgttacgacaaaatattcaaagttggaatctgttgtgaaggtcaacaaaggcttcgattaacatgcattgatggataggtagagccaatatattgcgattgggggtacccagaatcttgaagtgctagaaatggtatttgatctaatatgcgtggtaatagagcgaaaatgaataaagaagcgaatgcttttgacagataacggctttgatttgatcgatctcttgagtaaatcactgcatcatctgccatggaggatttgattcctgagcatctatactgtggacaaagccttcaagaaggcaaataattgctgttggcctccaaatggtctcctccagagggtgatggagaactaatccaccatttggtcacgggggaactcatggacaggagaccaatcaagtaattaagaagataggtctcagatattttacgagtacaaaggacgttaatggaaaaacaaaaaatattggctacagaatataaaatgtaggacagaaaaaaagatgaaaaatgatcaaaaggatcataagtattaaaaataacaaaaaaa

SEQ ID NO: 563102 - DNA, 495 bp, Homo sapiens
gcggggataaaagaatccttcaccgtaatgttgggttccccggtcctctataaatttgagagcccccagtatggtgtaaatcttgccgatcatcccgatgcacccctgtcccaggtgtagggagcgccccctctccttagattatttgtcgatattggagcaatggtgggtttaccccctctggatgggaagggccctgccttttttctcaattttcttcccggtttcctaaaggaccgggcaaagggttctgcccctttgttcagggcccggggttatgaagtggctcctccttggtcccctcggaaacctgtgtgaggggccctctcccccccttatggttgggtccccggaaccccctttttgtttttggtttttctcttggcccaaccatgggcgtgggggatggtggggtttcccctttttgtttgttttttgtttgattttaaacaaaaaaaaaataaaaggggggaaaagccccttttttttttttta

SEQ ID NO: 563103 - DNA, 151 bp, Homo sapiens
  misc_feature (8)..(8): n is a, c, g, or t
  misc_feature (23)..(23): n is a, c, g, or t
  misc_feature (38)..(38): n is a, c, g, or t
  misc_feature (146)..(146): n is a, c, g, or t
gatcttgncccaaagaggtcctntgtgtgggtgccatnaggatcccgggctgagccagagaggctgggcctgaccacagtgccccctctctcaaaggtgccatggttcattcccctctaagggcacgagaacttggcctgaccatnccttt

SEQ ID NO: 563104 - DNA, 744 bp, Homo sapiens
tgggtttggtaaactcgaggggattattatttcttaatgggagaaagaaaaaacagcattgggggacaaagtcatacaggggggagtgtctcgagggagagagaggtgactccaactccaagagaggagtgcggacacacgtggacacacgtgggagaaacacaccgcagagcagagggtgatcactctctctctgagaggaagagacaacctcagagagagcagactccgcagagtggggcgcgcacacgatgagggagagacgacgagtggcgaggacgacgacgtctcccggagtagggggaagaacggtagcggcgccaccacgaaggggggcgacagaccaagtcggaccacagagggaaggacgccctctaattgcatggaccacacaaccaaaaagaagggagcaaaggtggtcggtcgggcgcccccaacctaaatgcttgcctacccgacgacaggccgggaggtggatagagattcaatcagcaaccgcataggccggccaccccgcccaggatgagaagaaagcgacagaacaaagcaaagcattagccgaggagcagcccacgccgcgccgaacctttgccctggaaatggaaaggataaggggaggagacgaaaacggaacgaaaaaagcggccaccgaacaatggcgagagaccaagaaaaggagagagcacgaccaccaccagacaaggcacacaacagcacactactttggccgataccatagacttg

SEQ ID NO: 563105 - DNA, 946 bp, Homo sapiens
aacaggcatccaggccaggcacatctctgctcacccgtgatgggctcaaggcgtggagggcatttcccagcggcgctgctgcccctgtggctgaccatgattcttttcctgggcccactgatgcagctctctatggatgcccttgtgacctggcagatgggcatgaaggtagtcctggccccccgctcctgggcccgatgcctacacagatcatgcgtatggctgcggaaccaagtgatcgccccgctgacatgagtgagctggtgtaacgggccctgtatgcatgcacaatgttagccaccggtgcatgggactgggccctgctggtgtaccaccgtgcaccgcgtacaatttacaggacgattgcccaattatagcaccactaattatttgacgacaggcatgcgatgtccgccaggagacaagcgatggggaaagaatctacctatgtctgctgcagtaccaggttagtcgctacaacaagcatgtcgattcgagtgcgctacaacttgcttatcctcttcatccgcacaggacacactgattggggacgggtaactctgccattcacgttctgcaatacatgggtttcccaactgtgttgtgctggcttggagcacccaagaggctggaccctgtaggacagggctatgcacctggagtgtggagaaatctgacactgcatactgtccagcacctcagggaaccacaaagctacaacggcagacatacccatctagtcgtgtctcggagcggcgccggggactcagaaggctacacctgaggtccaggacctatgtacacgcatacgcaagacctctaccggaccacggactcacccaacaggggattgaagacaagtgatggagacaagcaaaaacggagaacaggagggacaagccaaaaaaagagacaagacagaaaaagaaaacaaggcaacatcaag

SEQ ID NO: 563106 - DNA, 436 bp, Homo sapiens
gtcacccaggctggagtgcagtggcgcaggctcggctcactgcacctccgcctcccaggatcaagcgattctcctgcctcagcctcctgagtagctgggattacaggcatgctccaccatgcccggctaatttttgtatttttagtagagacagggtttcaccgtgttggccaggctggtctcgaactcctgaccttgtgatccacccgccttggcctcccagagtgctgtgattacagctgtgagcctccgtgcccaggccagtgttctctcttaaatgtgtttcaatatggtggacatttattgagcacttgtgttgggcgtttcaacaggaggcactggtacgaaaagtagcttgttctagttcatatatcatttgcactttgcttaacttgtataagtactttttactgtttaataaatattttattagaaa

SEQ ID NO: 563107 - DNA, 195 bp, Homo sapiens
actcgctattcgtcggcacctcgctattcatcggcacctcgctattgatcggcacctcgctattcatcggcacctcgctattcatgggcacccgtggctattcatcggcaccggtattcggcgagtgctgctgccgggggggctgtaacactcggaggggggcgccgatgaatagcgaagtgccgatgaatagcg

SEQ ID NO: 563108 - DNA, 383 bp, Homo sapiens
atccagatttcataatctgccattcatcgccacctagtttgatccactcactttcacacattgtttggtacaatcatctactaagtaggctttctctttatcctgtacttacttagacctctgttttatgcccacgtatccaaacttaatttttagccttggcctcccagagtgctgtgattacagctgtgagcctccgtgcccaggccagtgttctctcttaaatgtgtttcaatatggtggacatttattgagcacttgtgttgggcgtttcaacaggaggcactggtacgaaaagtagcttgttctagttcatatatcatttgcactttgcttaacttgtataagtactttttactgtttaataaatattttattagaaa

SEQ ID NO: 563109 - DNA, 791 bp, Homo sapiens
agaaaaaaattcatgaaatcaaaaagtagactatttcaccctatggcagctaagtggtcctggggcatggagtcttcaacctctctatgaatggcacaccttagtcacttatgttactttggtgtccccaccagtggtggggggatttggtaatcctagatctatgagtttgaacaaagtgaataatcaaaaggaaaataattcctgtgtggttcataaattaagcatcactaaagtctctgtgaaaggcatttctgtatggggcaagatttaaaatactaaagccttaggtcctattcatatttaaagtagcatgtttgtaaccgtgttactatttggagagagaagcagtgtgcctgcaaattggaagactaacctttcaaatagcaaaagagagagagaaggctgatattcggctttaaaataaagatggtgtggtcgtgtttaagtgtaactgtcactttcccagtgaaaatgatttcatatacatggagggtctctacaggtatgggtcaacgtctatacaatgtgcaacaaaaatgataccccaactttcattttatcctttggtatgtgtgaacactggaaactttatgactattgtacattatcaggggtttctggatataaagggtgacaacccagaaacgtatttggacctatggaaattcgggggtctcgaagaatatgggctgtcttggaataggcggcgaacggatacatggcccttacgaaataagaccgaatacagcaataacccgagtcgtggtagacaagctgcatcgggaaaa

SEQ ID NO: 563110 - DNA, 508 bp, Homo sapiens
catgccgcagacatgaaataaaagctttgcaaaggcaaaaaaaaaaaaaaaaaaaaaaaaaaaacaacttgttgcgggcggctcccggcccccgcgaaaagctcttctcaaacaaccacattgctgttggggagcgcgcggccccagagaaggtgtaacaagtaggacactggatgcaaacagctgtggtgcgcctaaggagagacccggcggccatgagaccaacgggcggggattccccccaccatataaaaacagccccggggggaacaccgagacgggtttcgagagaacaaaactctccagagaggggagctgcctgggaggagccacatacgcgggggagcctcctaactaaacccggggggagtcccaaaaggcagagccctccggaaattttcaaaatttatacgccccccgaaccacggaggaggccctcctaccccacaccctgccatacgaccacgcactacgtcgctctcatgagatcacacgtgcacgtgcgagt

SEQ ID NO: 563111 - DNA, 654 bp, Homo sapiens
acgaggagagttagagagagagagagagagttgagagagagagagagagagtagagagagagagagagtgagtgagagagagagagttttgtgacttcttcccgtttccctactcgtctttattctttgcgcgtccttttctctctcatttcctcttcttctgtttgcttttttcttcctttctatttttcttacttctctctcttttctccattcctgttttcttctcttctttgttcgctcttccttttctgttattgttctcccctgtaccctctctcttctgtgttccctccggttccttttttcttttttttccctttgtgtcctttaccactttccttgctttgatttcctcttcctcttcgtgtttctttcttttttctccctctgaccttcttattcccttcttcttttttctgccctctctccctcttttcttttttcttttctttcttttttgctcctccttttttccttttcccttcccgcttttctcttcttctctttcttctttttctctttttttcctcctctcccttttttctccccttcctctttttcttttgccctttctctctttttctctctctccctttctccctctttttcttctctctctctcttcttttttccttttttcctttcctctct

SEQ ID NO: 563112 - DNA, 310 bp, Homo sapiens
  misc_feature (238)..(238): n is a, c, g, or t
  misc_feature (273)..(273): n is a, c, g, or t
gttttgatacatatataatgatcagatcagaacaattagcatatccatcacattgaacatttatcatttatttgtgttgagccatgattgtgccacttcaccctgggcaacagagaaagaccctgtctcaataaaaaagaagagaaaaactggagtgagaactctcctcctcttcataatcatagtatccacgttagggaaaatgcttctgaggagtaactttaaagtactgtgtgtngcatcttcccttccaaaaccttggctttttttctnccttttttgttagggtgagggaaggggggaaaaccct

SEQ ID NO: 563113 - DNA, 152 bp, Homo sapiens
tatctacgctgtaaccctcattcccaattgcctactagaaaattatattataaataactgcggggcacctcaaatacacatatattgtggcgaccaaagccattatcctttttccttaacaccgccagagtaatgccatcctaaacttccca

SEQ ID NO: 563114 - DNA, 965 bp, Homo sapiens
ccttgcctcagattcagcatagcggagcggatccgatcggatcgtgagcggaatcggagcacaaccggatgctaggctcatgctgagaaggcggtctgcgtagaccactggagaactggatacactcatatggacacgattagtaacgaatcactggccgaagtggctctcatgtctcacagctaaggcaccgatcctgcaaaagattgcgagatagatcgtagtgtggtgtcatgggagttcagccgaggtcgtgacttgactagaatcaacgtcatggacccaggaactcgtttggactatcgagctgaagatcactccacacatttgcctcactgatagtacgagtgcacaggttcaatagctggcacgatcatggaatgtgagcggtctccttgaattgcgcagggcactcgtgtgactgatgccagggcacggtgtccaccatggtatgaacgggatagcctactcgtggaaggtgacattcgccagtgagggtgtaccacattctgggtgtggacatccctggtagtcagcaatgcagcaggagggctgaactcgcatgttttgacggtggggggatatcatgctgatcggggaccatatcaactacctgcgttgagcggtcgaaacctctcagagagtgcccatgatgcaaggttcggagatcgttccctgacagaggtctgggtgcctaagcacggcatatgcaggcaaggggcccctaagtgctgggaaacgccacggggcaaccagtgtacctgacggcaggcccatgctaaagcgtgcgaaccactataaaggtgacaagtccaacagtgcaactgacgccactgtgtacaaggcacagaatcctacccatccactacagacgactaccacagcaagataatggacacagaacacaccaacaagaaacgactgagacgcgcgactttaccctgtccgtcacacgcgcacaaact

SEQ ID NO: 563115 - DNA, 294 bp, Homo sapiens
caacaggagtatgacaatttttcaacttgagtgcacacactgtcgccggaatcccgcgttacagtgaggaagcgcattcgacagcgcgcgccggatcgtgggggccgacggcgtgactctgtggttgcggacctggcggagatgcgcattggtttcgattgtagaccattccttttaggagttgagaaaggatcaatttatacagcattctcgacctatggtttgtggtgggggaaactagatatgtggataaaaatacagttggcaaaataaaaatgccaattttacatttga

SEQ ID NO: 563116 - DNA, 1938 bp, Homo sapiens
ggtcctcggagcaagcggaacaggacacaggtcttccccaccataggaattgactttaaaattaggaccatagagctcgatggcaacgcagacattaacactgcacgcactatgggcacacagcccgcgtcacggacacggcttctcgcgacgcactcaccaacgcgccctacctacagcggcgcctgccacaccgcggccactcactgcctgcgctcctaccgcaccactccaccccaaccgcagcaaagctccctctcgcacgacaccactcccgcgaaccctgggcactctcgccacaccactctgaccgcgacgccaccggccccctccctgcccaccacaccgcttccccacaccccgcaactccactaccctctgcgcgcaacccaccacgctgcctgcaccgcctgcacactgccacccaacgcacgcacaccacgctccccccccaccgcgcaaacccgcgcgcccaccgcaaacccacgccctgcgcccccccctccgccaccctaactcggcgaccacttccacccgcctccccacctgccccacgcaaccccacgcgcgcccgccacacgcgcccccacaaccacttcaaactcgccttgcggcacacacaactcgccaccttctctccccccaaccctccctcccgccccccaacgccaccccactcacctcccacaccaccgccccccccaccaccacctgcgcgcaccaccacaccaccaccacctccccgcgcacccgcgggcccaaaccccacggcacccccccccccaacgcgggccgcgaaacgcccaaaaccccccacagcgcgccgacgcccttccccgcatcaccacctcccgagccgcaccccccggcggcaacccccaaacccccccaacgccaaacacccaacccgggcacgccccgacaggcccctatgtgcttttctctcccccagcgcaacgctggcctcggtcatctcccgtttcttccgcttggccttggaccacggcctggcgcaccaaccccaaccgcccagggtcccccctttttcaccccttcccctctgccaagcccccccccttcccggcccccttcccaccgcgccccctccccaagcggcctattggcaaccccccttggcccggcgcccccccgttgccctctctccccttttgggacagccgctctcgcgacacgcccccccccccaccgcctttccctcaacaccctttccacacgggccccccccgccgcggctgcggctccccccccgtcattacgcccccccgaaccgccgccccttctcccctcatatgcgccccgtggccccgcccccctcccggcgtgtcgcgccctccctacaacccgccggtcaccccgcggtcgcccgtgctgcgaccgtccccgcaatccacgcccggccgaagcggcacctccccccccagaaccgcggcgtgcgcccccctaacaaccccccgcccaaccgaccgacacacacccttgcggccccccacacacgcctctcgcggccgcgcccacaaacaagcccttgccgccccctccccgccaacttctcctcccgctcacacgcccctacaaccccgctgggcgcccctccccctcgggccaaccctccccgcctcctacccctcactcctccaacacaccccccctccccccctcgcgccccacgccacaccttcgcgcgccccccctctcccaccccccccctcccccaccccccccacccgcctccccggcgcccccctccccctcccccccccttcccccccctcgcccccccacccccccccctccccctgcgcccccctgcccacacccccccggcgctgcccccccgcccccccccccgcccccccgcccccgccccctctcgcgcccacctcctcccctctccccccacccgccactcccaccgcc

SEQ ID NO: 563117 - DNA, 308 bp, Homo sapiens
gaaaatgaattggcaacatttacctttttaaagtttttgacttttgctcacgcctgtagtcccagcactttgggaggccaaggtgggtagatcatttcagctcaggaattcgagaccagcctgggcagcatggcgaaaccccatctctgcgaaaaatacaaaaattaggtaggcatggtgatgcatgtctgtagtcccagccactcaggaggctgaagtgggaggattgcttgggcctaggcggttgaagcagcactgagccacgatcacaccattgcactccagcctggtgacagaaccagtcttta

SEQ ID NO: 563118 - DNA, 944 bp, Homo sapiens
catgtgtgcacggttattcgccacagttcttaatccaagtgctgcatcttacaacacggggtgggggaattcagagcttaatatcaccgtaggtgcactagcttctggtgaatggatagtaagatgccctgcagcactatcaggtgagcttttctggaatcttgttctcagtgcgcttagcgatcgctcttacctgtgacttggctagttgtgtgatcagcggaggaggtgaggatcaatggttcaccacacgctcttctccgtcccatgtactgacccagtgccttaccgatgttcctggtggagctgggtgtttctctcgctcacccatgtcccactaacacgtgccgaaaaatctgtgtatgtgccaattgggtgaggtcagccccaagcctcctaggggagtcagggcaatacacacggtgccctcatcgtggtctagatgccatgtcccgtctctatgagtagacttgaggagaaaggcggggaagcttcctcagccttgcagactatgctgtgcgcattctacctagccagagctcgtgaaaggcagtgctcgtctgtgttcttgtacctgggaccaaagtaaaaatccaagcacattccccttgcagttaggggaggccctaatgccttctctaagtcagagaggcagcgttatcaaactcagcgccgatactttgtttacatgggatggggaagatgggagccagggtagtacagagtgggatggtcaggacctgggtccattgcaaacaaaatggggactctcattgggtagggaggtcactccctcgtactcactgagtctaggagtagggtagggttattgccccaaccattgcgatgggaggtggagggacaggctcagcctcctgcagtgtctaaatgaaggcctaaatgtgtgaagtgcgatttctgataaatgtgtacgtcaccacccg

SEQ ID NO: 563119 - DNA, 158 bp, Homo sapiens
gagcttgggaactgcggcacaaggtatatggggatgggaaggggaggagtggggagcagaggtggtgtgaagaaaccaagaggagaaaatgaaagcggtgcctaggcaagttgaggtggtcagtaagatagagacaggtaatccactatgcacgaaag

SEQ ID NO: 563120 - DNA, 421 bp, Homo sapiens
atgagtcttttatattggaaatactgtgaatggaaaattgccaaatcccttcttagtatattttaagcaccctacaacactttacctccctgcctttagtggtatttaaacatatggccaagttagtatttgggtttgattcctttggtgaagattaaggcatcaaaacatttcttgaaatgttcgagtacaaggctaaggcacacgtcaactttcaaaggtcatgacccattcggtttgcatatgttcaagtgagccattaggatttgcccaagtgcaataccacaaatcgagaatgtatatttcacattttgggcttgaacacattcatgcatatattttgggaaacctcatagggatttagaaagaatcatgaccggaatcaaaattcttccaataaaatttctatttaaaaatctct

SEQ ID NO: 563121 - DNA, 467 bp, Homo sapiens
ctgcaaactactctctgcctctctcataaggatcaaagcaagacccctggattataagaagccagccaaagtgcatctgcattcatggatacatatatcagtttcttcagaaaaattctctctctgccaataatacatcagatcatgtgatatctgcccatgtaacaattatggaaacaaggccaggcgtcttggctcacacctataatcccagtactttgggaggccgaggcaggcggatcacttgaggtcaagtgtttgagaccagcctagccaacatgatgaaaccccatctctactaaaaatacaaaaattagccaggcttggtggtacacacctgtaatcccagctactcaggaggctgaagtaggagaattgcttgaacccaggagatggagtttgcagtgagccaagatcacaccaccgcactccagcctgggtagcaggacgagactctgtcttaaaaa

SEQ ID NO: 563122 - DNA, 195 bp, Homo sapiens
aaattttgtgccctttgaactccatggcatattcatcctctaacagcgacataaaggaccacgaggcgcgagtgcggttccaacctgagcctctctgtgggctatttcccctgtgaggacaccccctgtgaggacacaaccctcctgagaagatgcaccttccaagggttcttccatccactttctgcctcccgt

SEQ ID NO: 563123 - DNA, 188 bp, Homo sapiens
  misc_feature (91)..(91): n is a, c, g, or t
  misc_feature (134)..(134): n is a, c, g, or t
  misc_feature (178)..(178): n is a, c, g, or t
gtcaagtctaccatcattctagaaggaaaaggcatggtgggaattcagcacctgaacttgtatttacaccagcctcggcatctggcaaggnaatagcgattgttcatagtgatgcagagagagaacaggaggangaagaacaaatacacacaaacaactgatctagggagactccaangatccaacag

SEQ ID NO: 563124 - DNA, 132 bp, Homo sapiens
ggtagaccgggcttgtgggttgacgatggctgtgggttgaccgtggactaatgggttgaccgtggcatgttagggttagaccgtggatagatctttctaaggatatccttagaaagattaagccacggtcaa

SEQ ID NO: 563125 - DNA, 834 bp, Homo sapiens
agcggggttgttgcggaaccaggaggtgaagcgatgcgctgtgcccgcgtggatctttaaggtctctcggctgctgggtggcattccacaacccaaaagcaggtgaccagaggttcttactgagtggtgattcaagacgagtaagctttacattccacggtacgatggtactgggcccagcaactttccagctgtcatgttaggtgaacgattttcgatgctgccaatagcacctattcagtgggaggagcggaacgtcattgccattcaaggacctggaggatacatgtgtgagtgcatcccttcagaggctaaagagtccatgtgataacgaacatagattggcgcttgacaaggccctttgaagaccccaatagcagccggtcacccatctatgacatttactggctgcgcataacatttgagctttacgcgaatgtccgacgcattgtgtctctatcgacacggcctataatagagcccttacagcgatgtaaatagtggtgacgcgattcgaggagatagcacagaaaggacgaatacatgtgtgcaattgaggcctgtgatagtcgatggagatcgtgcagagtatcaagctcatcaccgagggggcgagctagcgcattgctgactttgcctttgaggtattgcccggaactaaccaccggagcaacgtacacggcggtgcgacaaagcctgacatgatgctggatgtccgatggggctgaggctacaactgtgcagggcaagttgctgaaagcttgtaggcattttcacattcaatggaggggtgttcctttgatacgtatgttgaatatgggtacagaatcttcc

SEQ ID NO: 563126 - DNA, 323 bp, Homo sapiens
tactgtgctttgggacggcggcatagtatgtaaaatatggaacttatgaagttaacaccagaaaaggtacagaactggaacagtgaaattcttgctatgcaaaaacctcttattgccaaacctatactgcaaaattactctttgtcaacagactgaacgggaaaaaatactaaacgaattcctccactaaagttctcctacatgccagttcattctattgaccaccgaatatcaaacactcagaggaaaatcacagacgatactattggagatgcaaggggctatgaagttattaagccgatattaagaggaataggatggat

SEQ ID NO: 563127 - DNA, 97 bp, Homo sapiens
cccctggggggcccttaacttggggattttttttcttaaaaatgtggaataaagcctttttttaaatttttaataaagtgttgaggttgctttccca

SEQ ID NO: 563128 - DNA, 1058 bp, Homo sapiens
  misc_feature (369)..(369): n is a, c, g, or t
  misc_feature (825)..(825): n is a, c, g, or t
gggctggtacggccgggagttaggatgcaggtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgctggctgcaccggagtctgcagctgtctgctggtcatgcgcagcgcccgggagctctacctctcggccaaggtggaggccctcgagcccgaggtgtcgttgccggccgccctcccctctgaccctcgcctgcaccctgncccgagaagccgagtccacggcctgagacagcagaccccctgactggtgagcaccctgtttccggagccaatggacacgcaggaggcgcctgacagccgaggagacctccgcctgctgtgaccccgcgccccgccaaagtcagccgcaaacgacgcagcagcagcctgagcgacggcggggacgctggactggtcccgagcaagaaagcccgtctggaagaacaaggaagaagaggagggagcgtcatccgaagtcgccgatcgcctgcaggcccctccggcgcaagcggagggcgcctatcccaactggcccgagtactgcagaggcgcttctccgggctcctgaactgcagccccggggcccctccgacggcgccgcccgcgtgcgaggcaaagcccgcttgccgcccggcggacagcatgctcaacgtgctcgtgcgggccgtggtgtcttcntgatgaccccgatcggcgctgccggagctcagagcgcgcgtcgaaccttcgcccgagggagcatacttgaggcgaggcaccccttcatcttgggggaacgccgcgaaaacgagaaaaagcacagcggctctaaaccagaaagcctgaccagggacacacaaaggacgaacacacaataaccaggagagccaccaaacagcacgttacaagccacaacaacacaccaaaaaagc

SEQ ID NO: 563129 - DNA, 349 bp, Homo sapiens
acttactatacacagatgtactgctttgacacatcgcacactctcgtttccttgcccatagttcctcgaccgatactggctcattttcctttcttcagtcacattccggggcgtgatcacttacagtaaaagcagcgtttagaactccagctcctcttaacccacttgaaatatttggattcacggtcctgttgtgtttgtttcccaagctagaacattttctcctaagatacgcctgagattccttcctcagggcatagttaatacatctaggacccagagttttgcaactcggggcagctgtttttcccagtggccggcaccttgagccccataccttattcattct

SEQ ID NO: 563130 - DNA, 150 bp, Homo sapiens
  misc_feature (138)..(138): n is a, c, g, or t
ctctattcacttttaatgagaaaatggttatgtcctgggcggagacaccatcatctcttagctgaaaaattcaatcattgtccctgcttgtgccctctttcagtccatattcaacataaccactctgccctgtcacanatagtcagttat

SEQ ID NO: 563131 - DNA, 304 bp, Homo sapiens
atcccttacaccccacgatcactctggaggtcagtaggggaaggagtggggtgatgtgagtgtcatagaggtacagtaggggaaggagtggggtgatgtgaacacttatggaggttcagaacgggaatgagtgaactgatgcgaaagtaatgccggtgcagatagagggaaggagtggggctgatgtgatcactatggaggtacagcaagggaaggagtggggtgatgtgtcgtgtcatggaggtacagaaagggaaggaagtggggtgatgtgtaatggaggtacagtacggaacggagtaag

SEQ ID NO: 563132 - DNA, 293 bp, Homo sapiens
gaacgtcttaggttatcaataagctcctagttcagacggcatgggtcaattcacaaaggaggacaaagctactatcacaagcctcttgggcaaggtgaatgttgaagatgcttgaggagaaaccctcgcaaggctcctcgttgtctacccatcgacccagacgttctttgacaacttttgcaacctgtcctctgcctctccatcatggcaacccaaagtcaaggcacattgcaagaaggtgctgacttccttggagattccataaagcacctagatgatctcaagggcacctt

SEQ ID NO: 563133 - DNA, 703 bp, Homo sapiens
  misc_feature (59)..(59): n is a, c, g, or t
aacgcgtattaatggtcttttttataaaggggtattaataatttttctgttgcctagtncggggcgtaatttgtatgtcgaaagatctttgaatttgagaaaaagagcgtgtcctgcaaggaaatattgcgtacattctgcataggagaagagtactttttatgaaaagcagagggtatcgtggcataaatgtatgggtgtaagaaggtagtataaaagaagagtgtttacagagcatggtatcagttgtgttaaagcgcagttcagttatagtaaacatatgttgtcacagaaagggttagagctgagttggcatataggtgtgcaagaaaccttctggatggcagctcatgaacatagaacgttcagctttcagatgtagtagtgctatgagcagttactgctacatctcgtaatagtaaatgtagagatgtgttgtaaataagcatcgggtacgtgtcagaggagcatgactttgccaattctgacgggtcaacagttgataggcaatgctttgcagatgggatggtggctagataccgagtgaatgtgatgaactccacgcctttatagtataggtcggtcgtaaagtaatgctgatatatgagcaggtttaagcgtggaagttgaaagaaaatctctctgtctctctctgtctctctctctctctctctgtctctatagctctctctctctgtctctg

SEQ ID NO: 563134 - DNA, 147 bp, Homo sapiens
tgaagagaccgtgttgcaatgtgtgtttaaggcacagccagaagatccgtgtccacccatgtgccaaataagacaagtgggcaaaggttaaccaaactggcaagaggaaaaatggggactatttaatggcgttgtggaaaagggcct

SEQ ID NO: 563135 - DNA, 385 bp, Homo sapiens
gggggattttcccccgggggggttttttggaatccgtttttggggacaaaaaaaaggcctttttttaaaaaaacccccttttggggggggtttttttaacccttttaaagggccaccccttcccaagttttaaaaaatgggggatatccttttggggggtatcggaaaaatttttgttttttttcccccgggggcccgggggggccaattttggggaccccttttttttttcttttttaaaaaaaaccaaaattttttccctttaagattttttaaattccaccttttcccccttttctttttttttcaaaaaattttttttttcaaaaaattttttttttttttggggggccccggaaccctttttaaaaccccccgggcccca

SEQ ID NO: 563136 - DNA, 1088 bp, Homo sapiens
gctgcgccccaggtgagcggcagagggggcggggtgaggggctgagccggaggcggctcaccatggcgggacaggtgcctggtctgctacaaaccagtgcaatgagccatgccccgagtcctgagactatccctcgccctagctagtctgggcctccatgcttgggaccgtgggagcgggccaacagatgctagtgtctggagacatatgataaatgcatgctcagtaccgcgcgaccaagaccgccgcaccccgttagatccagaccccaaggtacccttgggcaccatgggccagagagcattaccttcatctctggctctgctgagccggcccttgagtgccccacctgctgcctgctctggcgagcctgggtgtgggagtggtgccgggctgccttctgcttccggcgttgccgggattgcctccagtcgctgttggagcctgtgtgcggggatgcagccctgtcctgtctactgaggactccaatgaggggactgctgaagccaactgggccaaggagcacaatggagtgcgcgcccagcgccatgatcgtgcagcctgccagatcggggggatgcgcatgcggctcaagtcaatcattgggcaacgaggttacagttaccaccgatagttcaggctctaaatggcaatccctgtgtatccccttacccgagaggccaagaatttcccttcaaggcacctggaaatggcggacttccatgcttgaaaagggacgccacctgtctcggataccacctatgcccagtagacaacacattgtcgtgcccgagcgcactcgatattgagccaggatagacatcgtatggccacacagaaggagggagcaaaaccacgcttctggccatggcaaggctgcgagcgtatgtacacagtgaccggaggactgggccagaggcatccacatggtgaaggcgctacaaatggagtagcggaccgactcaaagaaatatggacgaaactgcatgccgagccacgaaaatcgaccttcgccgtggcaggcgaagtcatacacacagtcgtgctacaggacgacaggcgagagtcgtgcaacgttcagcagagaa

SEQ ID NO: 563137 - DNA, 865 bp, Homo sapiens
gacctgcgctttcccattgtgctagctgaaagttaatgtgtctagcgggccaaatcagggacatgccggcattagcgggatgagtgggtgtcccgggagggatgtggtcattgacggccagtgaagggcgagagtaccacaggaccgacttgcttccttgtgagctggagatgagcgggctgggtacccgtggaataggccatgcaggccacgaaagagagtgacagcgagctcctcgaggatgaggaggatgaagtgcctcctgaacctcagatcattgttggcatctgtgccatgagcaagaaatccaagtccaatgccaagtgacgtcaacatcctagagcgactcgtgcagatttgactacctgactgtcgtcattcgtgggagaacgatgtaatccttaatgaaccgtgtggaacaagctggacagtcctgccactgcctcatctctttccagtccaaaggctttcctctggacaaagctgttgcttactccaagcttcgaaacccctttcttatcaatgatctggccatgcagtattacatccaagataggagcggaggtgtaccggatcctgcaggaagagggtatcgatctgcctcgatatgctgtgctcaaacgttgatcctgcccgagctgaggaatgcaacctgatagacaggtgaagaccaagtagaaggtcaatggagctgtctttccaagcctttgtggagacaccagtgagtgcagaagacacaaagtttacatctaataacccagttcagctggacggaggaagccagcgtctctatcgcaagattggcagcgaaacagatgtaactccttctgaaaaccagtcggaacacaggggtctcgtcctctag

SEQ ID NO: 563138 - DNA, 253 bp, Homo sapiens
ttgtggttgtagctctggagtcagactaactggatctaacccatcttgacagctgtgtacctgggctcagcaggaatttaaactcccagtatcctggcggggctcggtggccacacctgcaatcccagcactttgagaggccgaggcgatcccagcactttgagaggccgaggcgggtggatcacttgaggtcaggagttcatgaccagcctgcccaacatggcgaaaccccatctccactaaaaatacaaaa

SEQ ID NO: 563139 - DNA, 391 bp, Homo sapiens
tcagtgtcaggcagccacagtggcatcaaagccaccttctcggctttgatgttttccaccttctctgaggaagataattatgagtctgttcatgaaagcttttggtagcagcagaaacggcaatgtcagggcctaggcggaaggttcccaagtctgctgagccctgtgcatctgggcttgcgacaatacctacacacctccgacctgggcacccagctggaagggccacctgatcggcgcagaaaggccactgggcggaatcctggcacaggctgcagatgctgctcctggggcttagcactgagcagtttccacaggggcccctggtttaaagccagcagcaggacgaaggttctcgtcttactcagtccacagctggccacatcttcat

SEQ ID NO: 563140 - DNA, 250 bp, Homo sapiens
atgaagatcagaatccacgctagttttgcacatgcagtatcttgtcctgaagagtccttgtatactctgactgcttggatgtcatcctaggcaaagcaagatagatagctatcagcaaaccggaaggaagtgcttaagaaaacgataccagccaaagcctaaacaagaactgttcacaccgacatttgattatttgcatttctagagtgtctaaagtacttttggattaattctctctttcagacactta

SEQ ID NO: 563141 - DNA, 157 bp, Homo sapiens
agagcctgatcttgtcgtgctggcgtttttaacgtgttgtgtccgttgatctggggctactgtacaagtgtggtagattcttcctgaaggccagcgcttgtagagctggcaggggtcagtgttgtgtgtagcgagccagtgctgctgtgcgtgtgtg

SEQ ID NO: 563142 - DNA, 938 bp, Homo sapiens
  misc_feature (141)..(141): n is a, c, g, or t
atacctaatgcttaccggaacgaaaaattctatgctatatacaactacgtcataatggccccgaacgtatgtaggccccgtacggtgcgtactacacacccttcggcatgacaggcctagtagaatactcgttcaccaaangagcccctaaaacccgtcacatctacccatcacaccctctactatccaccagccctcggaccatatgagcctctctaccaataccgctcgttcgtaactcatgaaccccgcacatcccgcgatgaccctagacaccactgcgttggaagatgcaagagccttgaaggactgcgctcatagaattctgagcgctactctctacgtcttatgcccgtgtacctccatgacctctgtatcatgccgtgaagccatggatagcccgtgtttacctctcctcgaatacggggcaggcgacatgctgcacgcctaggataaggcacctacacaacacaatcttcctactaatcgaaaagctgcgacacgctgaagcgcggataccagtatgcgttagctcatgcatacctagtctccgcgtcacaatcaccccgtaggaccttccctcttgatacccattctcaccacacgctttcagtcaagcaaacaagcggaggaagcatcgcgtactcgaatttagcatacgcgtaggccatttcagtgagcaccatgtgtgaccatacctcctggactttatcgtccaagacccgatacgagagattcaaccgaatcactctggcgacttctgcctaatggaggagtatcgaaactcgttctgatggcctgactgaatctaggtgtgccgaacggccacattcgtgctaattactagatacgacgagcgtacctgatcgctggtcatcataaggcggcttcaccgaatattgtggggctagagatgggaattgtgaacgtggtcttcc

SEQ ID NO: 563143 - DNA, 492 bp, Homo sapiens
gacttggaaccaacccaaatgcccatcaatgatagactggataaagaaaatgtggcacatacacaccatggaatactatgcagccataaaaaatgagttcatgtcctttgcagggacatggatagagctggaaaccatcatcctcagcaaactaacacaggaacagaaaaccaaacactgcatgttctcactcataagtgggagttgagcaatgaggacacatggacacagggaggggaacatcacacaccggggcctgttggggggtgaggggccaggggagggacagcattaggacaaatacctaatgcatgcggggcttaaaacctagatgatgggttgataggtgcagcaaaccaccatgacacatgtatacctatgtaacaaacctgcatgttctgcacatgtatcccagagtgtaaagtaaaataaaaaataaaaattaaacacaaataacatttctaataaaacacagctcttatctgttctaac

SEQ ID NO: 563144 - DNA, 1137 bp, Homo sapiens
tattctctagaaagcagcaaagacagtggaacactatacctataatgcggcgcatgagctggagtcctagggcacagctctaagcctccttattcgagccgagctgggccagccaggcaaccttctagggtaacgaccacgatctacaacgttatcgtcacagcccatgcactttgtaatagatctgtcttcatagtaatacccatcataatcggagggcttgggcaactgacgtagttcccctagataatcggtgtcgccccgatatggcgttataccgccgtcataaacaacataagcttctgactcttacctccctctctcctactcctgctcgcatctgctatagtggaggccggagcaggaacaggttgaacagtctaccctcccttaggcagggagactaactacccagcgctggagcctccgtagacctaaccatcttctccttacacctagcaggtgtctcctcgtatctataggggccatcaatttcatcacaacaattatcaagtgataaaaccctctgccagaacccaataccagaacgcgcgctcttcgtctgatccggtcctaatcacagcaggtcctaattactcctatctcatcccagtcctagctgctggcatcactatagctactaacagacgcaagctcaagaacacttcttcgacccgcggaggaggagaccgtattgctaatacaacaccaatgctgattattccggacacctgaacgttcatatccttatcctaccgggtcgggaataatctcccattgtgacttactaaccggaaaaaagaaccatgggaatcaagggatggctgcgggatgatacaactggtcacaggggtaaccgggtgaacaccaaaatttaacgagcagaaaaacagaacaacagcaaatatacacccggcgcccaaaaacaggcgaccacccggggcgacaacagcagaagcgcacacccagaacaaaagaagaagacggacgagaacaaaaaacagacgagagacaaagagaggaaaaacacagaacgaaagaacaagagaagacgacaagaacgaagaagaaacagcacaaagaacacagaagacccacaaccctatatacgacagaggaaggaccaccaaacaacac

SEQ ID NO: 563145 - DNA, 911 bp, Homo sapiens
actaccaaatacaaccctgtgggggccagtgagctgcgtgacctgtatttgaaaactgacaactatactagggaggagagtacttatagctacggatggtcaaggaggtacgcccgggagctaggaggagagcacgtaccagtactcagagccacggctactccatctacggccgcagtacctgaggagtggcccaaactggcctactggttcataccagcacacaaggtctacttctctccaaacatagcagctgtgcatacaatacccagcgtgacccccggatatatatagacacatatacttcaagtgtcacaaagcaaagctaagtagcccacaaactatattggcgaagcttgcttcgcgagaaacattcttacactaggcctccacactattcgccatagagtggccaactgcataccacaccgccacaaatggattcaatacgcaggcagcgttcaatccttccttactctaaaaagataatcgctagaacgcgcggatatatcgagaagagcagtagggccatgaatggccgcttcacctagcccgacgaatgcagagcgctatcactgatttgtttcccgcataccacgtcagttcccgacagaacacacgagaaacgtttatggtacactaagatgatcaagcaggataagccataatccccgtaacaaggtcacacgttaccgtggataccttcacagttgttaaagctcagcccatacgaagggctggctcctacacaagccatacgcgcattatgaacgcgcctgtatatcgagtaccggctgcccctgctaccgaggacaacaagactaacccaaagacaggatcccaacacaaacccaacctagcgaaatctggcccaaccatcaactgctaacaaccaatatacccaaagggct

SEQ ID NO: 563146 - DNA, 349 bp, Homo sapiens
tcgtctagaggatcccgtaggtggttgtgggtagggaaacagagtgggtataaagagtcaaagggccaggtgcagtggctcacacctgtaatcccagctactcaggaggctgaggcagaaggactgtttcaagccaggagtcagagaccagccttggcaacatagcaagacccatcgctgcctccgttaactatagtcatgcatcgcttaacaatgggaatatgttctgaaaaacatgtcattaggtaatttcattgttgtgcaaacaccatacagtgtacttagaaaaaccttgatgatatatcctactacacaactaggctatgtggtatggcctatcactgctagg

SEQ ID NO: 563147 - DNA, 206 bp, Homo sapiens
ggccttctcaaagctgtccttgtctgtcactgagtacacgatgacatatgcatctcccatggccatgcagtggccaggtagccagtggcccccatcctagcaaatacagacacacacaaatatacccaatagtcctcatgccccagctacaaggctgtcactccctgtagcccctaccccaaccctgccctggccctcagcctgcg

SEQ ID NO: 563148 - DNA, 423 bp, Homo sapiens
aacctcgatatcatttgcaacactatatatacgttaggtgtgatgaaagaaagctcagttgcaggaaatgaggaagtcaaggatcagagaggagagacagcaaattcaactacctttcacagaagtgaggtggtgaaggaaagcagagcaatcccaagtgatagcttaaggatcaaagctggtttagaacaaaaaagatacttggtagctaaatttttcctctaggttcaggcacaggcttgaagcacacttgtagctcagagcaggagagttgcccagaaggacctgaagagtgcaaagaatggagattatttccggtccccataaaagtccagagtgtatgtgggatctacagcacagctagaacggtttgacccaacagggagtatagacatttctttctctgtgacagaagggtcagga

SEQ ID NO: 563149 - DNA, 445 bp, Homo sapiens
  misc_feature (1)..(1): n is a, c, g, or t
  misc_feature (130)..(130): n is a, c, g, or t
  misc_feature (204)..(204): n is a, c, g, or t
ntggttccaaggatctggcccaacccccagccttaggtggatgccagatggatctggagggaaaaaccactgcccaggggacttttaactttctctcccaaagaaaaggaggaaaaaattcctttaactnccaaccctggtaccccaacaccatgaatgttaccaatagataggaaaggagtggtgggtcttctcttcttattnttccaacacagggtttctcagccttgccattattggcattttggacagggtaagtctttattacgggagggctgtcgtgtgtacccctattctcttcccactagatacaagtagccccttccctctaaggtcataacaatcaaaaatgtctctgcatagagccatatgtcttgattaaggactactgctctaagtagttgcatggtatgtggatcaggggaggtaaacctgtcatggtatc

SEQ ID NO: 563150 - DNA, 1333 bp, Homo sapiens
cctgcgtttcgctggccggtctcgtctgctcgctgtgctggtgttgcctccgtgctccccacgattggtggtctcgtctcctcttgcgtgttgtccctccgttgtgccctcggtactgcctgctgttcctgtgggatgccttcacggctttgtcgcgcgtgtgcgccatggatatcatttgcctgcctcgtggttgtctttccaactacgccctgctctctctgagtcccgcttccctcgtccaagggtgcgttctttcgtggcaagggctcttgtgcccagcatattctcacattcgtgtactctctttacgggatgctcttgacgtacgcaccattcctttggctttctgattggtaagacccccaggtcctgtgtggaacattgtcctactgaacgatctatacggaaatgccaagtcaaaagggggcttgccatctaaattgaaggccttgcccttgaagtgtaagactctctttgctttgcccgcagtcattgagcacatccgaggatgtacacagagcctacttacgcaggaattccataagaccctggaagagccattctgaagcgacacatcagggcaacttccagcggctcctcatctctctctctgcagggaaaccgtgatgaaacgcacaaacgtgcacatgtcactcgcccatgagagatgcccaggagcctgtattgcggccggtgagaaccgcctgggaatcagacgtagtccaagttcaatgcggttctgtgctcccggatccgggcccacctggtagcagttttcaatgagtaccagagaatgacaggccgggacaattgagaagagcatctgccgggagatgtccggggacctggacgagggcatgctcgagcctgtggtgataatgtctcaagaataccccagctttctttgcggagaggctcaacaagcccatgagggggccaggaacaaaggaccggaccctgattcgcatcatggtgtctcgcagcgagaccgacctcctggacatcagatcagagtataagcggatgtacggcaagtcgctgtaccacgacatgctcgggagatacttacaggggatataccgcgaagattctgcgtgaagatcagctggtggtcatatgactcgaactagtgaactggtggctcacattctgcacgcaccgttgcacggcaacatccagtgccaggaaataaggccataaagaatgtctgtttctaacaaatccacaaatagccctcgagattcaccgtcctagagcttaggcctgtcttccacccctcctgaccagtatagtgtgccacaagggacctgggtcggtctagaattacccc

SEQ ID NO: 563151 - DNA, 110 bp, Homo sapiens
ctcggtcactctaaggatcctcatgtcatcagtggaagcgaaaggcagtctctgtgcgaaatcacagtggaagagaaggcagtctctgtgtcaaatcaccagtggaagag

SEQ ID NO: 563152 - DNA, 522 bp, Homo sapiens
  misc_feature (118)..(118): n is a, c, g, or t
  misc_feature (313)..(313): n is a, c, g, or t
  misc_feature (462)..(462): n is a, c, g, or t
gaatgggtctgccgcgagtgcgagcaggttgagatggggcgtgagcaccagcacgatgggcggcatagaggcttctccacagttcttatggttgtggagtcaaaatgtactggtggtnaatttggtcaatggatggctgcggatctgttcggtgatcgaacgtttaatcaatgcaattgctggatcaccggctgacgtgcattcggttgaagtattgcgcgaggttgctgaacgaggaggactttcgagcattggccgggtcgttccagtcgttggcatcactggttacaacccggcattcgccgggtttttngtggttactaatctgtgaaacagcttcgggaataggagccggttgtcgggtggcagagggaaattgttacctgacggaaaataacctaacggatgggttacgatgagagtaggtgcttacaaaggctatgtcatttcggtgtttatcanggatgagcattgcccgccccatgtgcatgtcaggcagggacccactcgggggatcctcta

SEQ ID NO: 563153 - DNA, 577 bp, Homo sapiens
  misc_feature (7)..(7): n is a, c, g, or t
  misc_feature (82)..(86): n is a, c, g, or t
  misc_feature (89)..(90): n is a, c, g, or t
  misc_feature (109)..(109): n is a, c, g, or t
  misc_feature (113)..(113): n is a, c, g, or t
  misc_feature (142)..(142): n is a, c, g, or t
  misc_feature (147)..(147): n is a, c, g, or t
  misc_feature (152)..(152): n is a, c, g, or t
  misc_feature (162)..(162): n is a, c, g, or t
  misc_feature (164)..(164): n is a, c, g, or t
  misc_feature (179)..(181): n is a, c, g, or t
  misc_feature (186)..(187): n is a, c, g, or t
  misc_feature (213)..(216): n is a, c, g, or t
  misc_feature (218)..(218): n is a, c, g, or t
  misc_feature (226)..(226): n is a, c, g, or t
  misc_feature (229)..(230): n is a, c, g, or t
  misc_feature (235)..(235): n is a, c, g, or t
  misc_feature (240)..(240): n is a, c, g, or t
  misc_feature (263)..(263): n is a, c, g, or t
  misc_feature (265)..(265): n is a, c, g, or t
  misc_feature (271)..(271): n is a, c, g, or t
  misc_feature (276)..(276): n is a, c, g, or t
  misc_feature (283)..(283): n is a, c, g, or t
  misc_feature (306)..(306): n is a, c, g, or t
  misc_feature (323)..(323): n is a, c, g, or t
  misc_feature (338)..(338): n is a, c, g, or t
  misc_feature (354)..(354): n is a, c, g, or t
  misc_feature (358)..(359): n is a, c, g, or t
  misc_feature (363)..(363): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (396)..(398): n is a, c, g, or t
  misc_feature (402)..(402): n is a, c, g, or t
  misc_feature (417)..(417): n is a, c, g, or t
  misc_feature (434)..(434): n is a, c, g, or t
  misc_feature (448)..(448): n is a, c, g, or t
  misc_feature (454)..(454): n is a, c, g, or t
  misc_feature (480)..(480): n is a, c, g, or t
  misc_feature (483)..(483): n is a, c, g, or t
  misc_feature (509)..(509): n is a, c, g, or t
  misc_feature (523)..(523): n is a, c, g, or t
  misc_feature (533)..(534): n is a, c, g, or t
  misc_feature (536)..(536): n is a, c, g, or t
  misc_feature (541)..(541): n is a, c, g, or t
gcttggnggtgaacgaattctcagcctgtgagatccgaccatcccattaactttgaagtttctcttgattaatagaagaacnnnnnggnnggtgaagggggggaggaanatgntaaaaaccttatgacaatcatccaaatgnggggnaaggncaaccgattnancaattccattttttnnnttttnnaattttttatattttatttttgtttnnnngntttttggntgnnatagnttggnagttcctaggggccctgggaggngngctggntttgnaaagggntgggggggggaagccctgtaggntgcggtgaccattttcnagagaactgagagtncgtgctcccaaaggtntganncaanagcttaatgtgaaaagaaantgnantgaaaggnnngggnggaaatggtgatganctgggcttatgtgaggntgtttatatttttntaaggnagccccagattttttttttcagttanagnctcagggaaacgaggttttggttggngggttctgcagggnttttttccannantgagnctctagtcccaaaaccatccttgagaaaatcgtgtg

SEQ ID NO: 563154 - DNA, 409 bp, Homo sapiens
ttccctgatgcgtcctcaggctgcctcggctgtacatgtatgcggcatatactttgactctggccatacattccacttattgtgtaccagaatcgaccgtacccgacatcctcgttacgctcaagaggtgttaggcactatactcagtgtctatgcccgtcacataaccagccgttggcatccgagcggctcacgagggaagcatcctcgtgagacttggtcacctggtctctctgactttcaaacctggtttcttacaggtcgttgtcagtagtgggagccttgcggagaggatagagctgaaggactaatgcaaatgaggaagtaagtcagggcgggctttgagaaggggacccatatcctacaggcaaaaagcaggctaggtgaccttgggtactacgctttggca

SEQ ID NO: 563155 - DNA, 138 bp, Homo sapiens
cctacagaggtgagactctgtctcacaaataaaaataatactaatacaaataaacagcaacaacaacaacaataaaactcttgtattatcaaagaacttccaaaatctgcttattatgtccattcaaagcgatgaaat

SEQ ID NO: 563156 - DNA, 162 bp, Homo sapiens
cttagacaaaaaggtttggagcagaaagaaacgtgctcatctttgaccttggaggtggcacttttgtatggtttcaatccttactatttgggattggattttttagggtcaaggctacgactttggggaaaaacccctttgggttgggagaggttttttgca

SEQ ID NO: 563157 - DNA, 239 bp, Homo sapiens
  misc_feature (10)..(10): n is a, c, g, or t
  misc_feature (38)..(38): n is a, c, g, or t
  misc_feature (64)..(64): n is a, c, g, or t
  misc_feature (72)..(72): n is a, c, g, or t
  misc_feature (104)..(104): n is a, c, g, or t
  misc_feature (204)..(204): n is a, c, g, or t
  misc_feature (213)..(213): n is a, c, g, or t
aaactttttngcacttacacagacgagacttcactgcntgaggatcatacgacatttcaatcgnacacaaanttaaaaaataaaacaaattttaaaaaaccatnttgaatttccttaaaattattccaatactttccaacttaaaattcagaacaaatcctcctagagactatcaataccaatatcttcacattgctcagctgntacatacgncccaccagttcacaactaatgacaca

SEQ ID NO: 563158 - DNA, 145 bp, Homo sapiens
ggggcctgccttggcccccccccgtggcccctttcctgggtggggtgggttttagctccccccccccccccgggtgggttgggggccccgggggtttgttcccccccgcccccgaaggggccgttttcaaaatttttttttccca

SEQ ID NO: 563159 - DNA, 1598 bp, Homo sapiens
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagcctcccaacaccacctccccggagtctcccgacaccacctccccggagtctcccgacaccacctcccaggagcctcccgacaccacctcccaggagcctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgctcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 563160 - DNA, 808 bp, Homo sapiens
gaataccattgttgctggaagtcttattacaaaatcaaacctgcatgcatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagagcagagcagctgagccaatgctaatgcttccacttctgcttctaatactgtcagtggaactgtcccagttgtccctgagcctgaagttacttccatggtggctactgtggtccgatcatgagaatacagtacctatttcaacgtgaggaacaagcacaatttactagtacccctgctatcaggatccacgtgtggaagtatccagtaatactgcagaagacacatctaagcaagaactgtagctgatttactccaaaaaagaagaggaggagagccacccagcaaaagaaaacataccttggaaatacacaggagaggcaacgcacgctttaaagattttgacaagaaaggcgggtaccatcgaagtgcttcatggagcggctatgaaactgttattatgactccacgatacgtgctggcaagttagtgaaaaaagcaggcttagtgctataagtcaaaaagaaaacaaaaaaaacattgggggcccggccagaaaatttaacacttgtgggcggggccagagtatgacatgcaagggcaagaacggcagaggggtttcaaaaaccgggccgggtggaaccggtgggctcgcataaccaaaaccccggggc

SEQ ID NO: 563161 - DNA, 964 bp, Homo sapiens
gtctgatacacttctgagcctcattggataatcttgttgattactacagggattaatgtatgttgcgtcgcctagttgcttgatttgctccacgagcttgaacgtgtagtcatgaactaggccactattgtgaccatacttgacacctagggttggagcccaccagagatccaggaagcttttcgtttagccatcgttaattaggggaggaggcactacgcacggaaaacagggtctaggacgttcgcgtcgcaagacgagtatgtgactgcgttatcaggtgcgcccccgcaatgaccagcattgctaacttaatagaaggcggctcccacgccaagctacaagaaactaggcttttggttgttttgaaccagaagatcatcgctctactgagggtaattcccttcacttatgggaggagcgttgcctgttccgcccgccaaagtcggacggacctattttgggagatggcgttgaaacccccagagaaaggcccctcgtatcccaaatattagaaggcgacgcatgggtggggggagcctttggcggaccttttttaaagaaacccttctttttggaccttttttttcccccccaccgtgcccgtgtttttaaaaagaggtgtgggggttattaaataaccttccataagggggaagtttgaggttaatataccgggacagggaacaacggggattcctttccaattttccacggcggcctttgttttggtacaattgtcggtacccaatattcccatggtgtgtgtttgctaccttgtgtcctattaggtcccatttgtatgggagcgggagaacagatgggtgttccgcccaggtatgatattcacgcacatccttccacataggggacagtttcaccacgacggatcaccaaaattcccctattaaaaaataatcctagtgaagttatgttggttcccaatggcggcccccatggcctg

SEQ ID NO: 563162 - DNA, 430 bp, Homo sapiens
  misc_feature (39)..(39): n is a, c, g, or t
tttttatcatgttaacaaaatgttctcttttgaagatcntagggttggctaattaaccaataattcaagtagagtgtcccagaaaaaaaccaccttgggctccctgtttggagttgggcgggctttgagcattgccaatggcccctactcacctgactttggatcctttccttttaaaggctttgcattttgcacccagcttcactaacagtggggtgaaaacatccttgggttgagtgtttcatttgggagttatttggccagggccttttgaacagaagggtccccatgaaggggtaaaaaaaaaatgggtaaaagtcagctttttttttttttttaactctaacccccttcaaaaatttttaactactttggaacggcagggcttaacctggtgataaaagcagttattaaaagtttacgttttcca

SEQ ID NO: 563163 - DNA, 141 bp, Homo sapiens
cctgaccatagaggatcccgtgatgttatcccaacactagcaatctaggtctactacatacaatctctgggtggatgatcttctagtactgtattttaaattaaggagtttagttataactgaaattgatttgttagtctg

SEQ ID NO: 563164 - DNA, 217 bp, Homo sapiens
ggtaacaaaactactttttttaatcatcagatttatactagctatatggatattcgcatatctggtcattatgcatctcagaattttattacatatttatataatcctgttcgctcagttattggatgagtgcaagctaatcatgttggtttataatagtagtcaattttagtaaaataaaaattacactatcaaactctttactttataaattgtc

SEQ ID NO: 563165 - DNA, 950 bp, Homo sapiens
  misc_feature (35)..(35): n is a, c, g, or t
gagagaaagaaataaacaaaaggaggaaagacgtncgtgccgtacccaaggtagcgtcacatagtttgttcaccacgggagttacaagactggttctcactaccgctgtcgaacaagagtcggcagtcactagtagccaagaggtcgccgcacccgagaatcagggcaccgcaccaggcgcacccggtgtccacagaggaaaccacccatggcccttatattcaagagactgccttattcaattacccgagcggggcctcctccccaacatgtgaggcgtcccacgccttgaacttgatttgcgccgacttcctggggctacacacagtcatgctccacaacactcgggggaccaaggttgttagagccaagcacgggacaagaaaactgttgtggaccagacagaacccagaaatgcctggggcaaatcggggaagcactcgtgcatgcttacagaccccgggggttactctagtccgccccacgcacgggcccccccaggctcgggggtcacgagcccccagagccgcacccccccggggggagcacgaacacaaacccggctttcgctaaaaacccatagtggtatggagaaaccccaagttgcggacaccaacttgtcgcgagtgattacacctgcgggtcaccccacggacacgcaggggtgcccccgcaagtaaacccccgccgccaagaacgagccgtttggagccaaatccccacaacgaacaggggttctgtgacggcgtgttttcagcccttatcctctgtgagagagcgcgcaattatgccgaacggagacacatatgtggtgaactctagagaaaagcggactcgcacttcttgatgggacttaaataggccgcgatctgtttttattccgaacgcggtgacaatttttggacatattaaaaaaagcacccctgtgaaattaaacagttcacaaaaca

SEQ ID NO: 563166 - DNA, 143 bp, Homo sapiens
  misc_feature (24)..(24): n is a, c, g, or t
  misc_feature (84)..(84): n is a, c, g, or t
ctcgtgcgaattcggcacgagttntttttttttggtagtaagaacacttaacatgaaatctaccctcctgacaaatcttttgtngtacaatactgtaatattaactatagggtgcagcgttttacagcagacctgtagaactt

SEQ ID NO: 563167 - DNA, 405 bp, Homo sapiens
  misc_feature (130)..(130): n is a, c, g, or t
  misc_feature (250)..(250): n is a, c, g, or t
  misc_feature (272)..(272): n is a, c, g, or t
  misc_feature (384)..(384): n is a, c, g, or t
cccgaaaaccgtcacgctcgacgtgcagaacatgacgtgcggactctgtccgatcacggtcaagaagtcgctggagaaggtgtccggcgtgagtgacgtccaggtcaatttcgaccagaagacggcgacngtcacctacgatcccgataaggcccagcccgaggcactgactgaggcgagagccaaggcacgggtggatcaatggatcgagtgcgatccatgaaccccaccttctaaaagatagggcctnagcttaccgtggtatctctggngagcagttccatggcagcaaggcttcgtagtctgagaccgacgacgcatacggcaggcgctcaagtacgtggcgcagccacgtatagggctcctggccgttgaccttggcgnctcgaccaagctggatatctg

SEQ ID NO: 563168 - DNA, 319 bp, Homo sapiens
  misc_feature (39)..(39): n is a, c, g, or t
  misc_feature (75)..(75): n is a, c, g, or t
  misc_feature (81)..(81): n is a, c, g, or t
  misc_feature (121)..(121): n is a, c, g, or t
  misc_feature (150)..(150): n is a, c, g, or t
  misc_feature (204)..(204): n is a, c, g, or t
  misc_feature (249)..(249): n is a, c, g, or t
  misc_feature (292)..(292): n is a, c, g, or t
ttcagggaaagatggaagatcttccagaacaagaaaaanatataaatgttgtagatgaattagaaatacaatttnatgaanttcagctagaactatatgaagttaaatttgagatattaanaaacaaagaaatactgcttactacacagntggactctcttgaaagacttataaaagttacaccttagattgacttgggtctgnttctgagttgttctcctccatcggttcgtgagtggcttctgctgntggctccatactgccccccacgactgtctttggaggcacattntagggtctggtaagaaaaacaggatga

SEQ ID NO: 563169 - DNA, 147 bp, Homo sapiens
tcttgacacgaggtggaggctgcagtgagccaagattgtgccacgtgctactccaacctagggtgacagagcaatgatgctggctccaaaaaaaaagaataagaaagaaaaaagaaaagagactagtcctttctttacttacgttgg

SEQ ID NO: 563170 - DNA, 721 bp, Homo sapiens
catgaagtcagtcactggaagaggaaggaagctctgcagatgacaaaagcacctgaggacacctgaaatatctcttggtgctggtgcacatttgagcagtagctcagaggagtggcatcattgaggaggaggatacatgtgttaagcaccctgctggccaaggtatggcccggatgttggaaactggctgtagagccgcagtggttcctgatattaaagaaatgttgtttaaagctgtttttcttacaccctatttgcctttgaaattttaaaagcattcactttacacatctgttttgcctttttacaaaactttttttaaagagagccctctgccaccaaaatatgcttgacctcatcatcctgagatcactgctatcaaaatatttggtgtatattttttccctagctaatttgtgtgtgtatatacattctatataattgttttattgtgtacaatttgtgtaactattatctgctttaaaggtttaacagtacctttttctgtcattaaatagtgtgcaaaagcatgtgtagtaactgcactatatgactgtctctggtcagagcataaatttcttcactggtctcctgtacagcggtctgcaaacttttaagtggctagctaatacatatttttagactttgctggtgatatggtctctgtcctaactactggactctgtttttttagaacaaaaacagccgcagctgtaagcaa

SEQ ID NO: 563171 - DNA, 427 bp, Homo sapiens
gattggcaagatgttagtttctccgtaggttgtatctttaaaaataaatgcaactatttaaggggtatgctgcactagtattccttagaggaatcagttctttaaagttaggaaagcgagtagccaggcatgtgttggcgaagtctgttcatcgtagctaagtgttaagaccgcccttctgtaacgttttcatggtaacgcccagttagagcgctgcatttaggtcgtgttaagcctattcagcccttgtaaaacaaggaatccaccctctttcaaactgtcaattccgtcccagcctgtatagtttagtcatctgtacatcttttcagccatcagccccttcttttccgactgattcagtatattaattacaaggttattgttgcgcgtgtcgtcacacgctcagtgtaataaaaacggcttgaga

SEQ ID NO: 563172 - DNA, 116 bp, Homo sapiens
  misc_feature (93)..(93): n is a, c, g, or t
agggacaagcaaaccacatccaaaccacagcagcatgaaaggggatgagtcagatctcgggaggtggtgcctcgtggaaggtgttcggctccngggggcatatcccacatgaacgg

SEQ ID NO: 563173 - DNA, 1184 bp, Homo sapiens
  misc_feature (185)..(186): n is a, c, g, or t
  misc_feature (203)..(203): n is a, c, g, or t
gggaaagttctaaagagaagaaaaaaagacaaagatgacaaggaggatgaaaaagaaaaagatgctggcaactttgaccagaataagctggaagaagaaatgagaaagcgaaacagaacagagtagaaaaatggcgagaagagcaacgtaacaaggctatggcaacaacataggagaactgcaannacaggcaacatcgacanagcatgcaaaccaagggcaacaacagtggcagtttcagcaggcacgcatgcatgcatgcacgcaagcatgcatccctgccagcacagctgcaacacaggccagggcaacatgcaacatggcagggtgcaggagttcagatcccattcagcatgcgtctaccaatggcacagcacagtgcaacagcaggcacagctcaaacacaacatttaacgactgcagcacagtgtacagacaggtgcgatgggcggcacacatgcaacacagcaagtctggagccaacaacgagtcacaacaagttgtcactcggttgtgacaacacaaaaaagcagttgtggacttctgatcaagaagacaaggtgagctgatggagaactgaccaaggatgccatggagtattcttcagaggaggaagacagtcgatcttcagacagcccttacagggtatcaaaccaaaaacaggcgaacagcttctagcaaaccagtgaatcactggcacaaaactcgagtactgagccatattaggaacaaacttctcatgttcgaacgtcccagcaccttagccaacaaactgtcttcacaagaaagagagcaacaatgtgatttcgacttggcacctgggcagggccattaccaggtcatagcagggaacacggtggccccaaacgcaattacataaccagggggcatcacgaaggtcgcaacttcccaagagagaaacggtggggcgatcccactcacaaacgagcagggcaagatcaacaaggcccacaagcccaatcaaacaccaaaaacagaaaccaggaaaaaaggtcggaccacaaaccagaagggaacggcaaaaacaaaagcgcaaaagcaaaaaaacacgagaggacagaacaacaccaaaacgaaacaaggaaaaaagaaagaaaaagcacaacaagagaaaaaaaacacagagaaagcacaacaaccacaaaagcaacacaccacagcaa

SEQ ID NO: 563174 - DNA, 133 bp, Homo sapiens
aagttttttgaaaaaaaaaaaccctcctcttttttaaggatggtttaattactgggccttttcctttttttttacccatccccctgtcccttagggtaaaattttcacccttaaataaaacttttcaaatata

SEQ ID NO: 563175 - DNA, 153 bp, Homo sapiens
  misc_feature (35)..(35): n is a, c, g, or t
  misc_feature (58)..(58): n is a, c, g, or t
  misc_feature (61)..(61): n is a, c, g, or t
  misc_feature (63)..(64): n is a, c, g, or t
gactcggagtggaatttaatggaatggaatggagnggagtcgaatgaagaggagtggngtntnntggaatggaatgtagtggaatcgaattgaatggaatggaaagcaatggaatggaatagaatggaatgaagaagtgaaatatgagctgag

SEQ ID NO: 563176 - DNA, 453 bp, Homo sapiens
ccaccagggaataccacttctgatcccaggatcgtccttgcaaattgctgtatttataaagatttttgggacggcgctgaaacgtctgttttagtacatcaagttctatttttgaattgagctcccaaggtagtttgttaaagaacttttagaaagctccatgtgttctttaaacattttttcccttttaaaaacaaattttaagacatttgttacagtcccaatatttttccttttatcagaatttttgtttaggcactcaggattattgtttctggccaaaagaaaaaagtggccaggctaaatcagtttttaaagttgatgtgtatttagggacattttaaaaccttgtaaacaatgtttatcatggccagaaagtgatttctgaatgtacctatgaacaatccgagtcaagatcatgattgcttagagatgttttttattaaagatcac

SEQ ID NO: 563177 - DNA, 353 bp, Homo sapiens
gacgtgttcgataagcttgattctggtacgggagtggtcagacctgtaatcccagcactgcaggaggccaaggtgggcggattgattgaggtcaggaattcgagaccagtctgggcaacatggtgaaaacccatctctcctaaaaatacagaaatgagccgggcgtggtggcgcctatagtcagctactcgggaggctgaggcaggagaatcgcttgaactcgggaggctgaggcacgagaatcgcttgaactgggaggctgaggcacgagaatcgcttgaactgggatgcagaggctgcagtgagccatgttggtgctggtgcactccagcctgagcaagaccttgtctcag

SEQ ID NO: 563178 - DNA, 597 bp, Homo sapiens
  misc_feature (14)..(14): n is a, c, g, or t
  misc_feature (23)..(23): n is a, c, g, or t
  misc_feature (25)..(25): n is a, c, g, or t
  misc_feature (41)..(41): n is a, c, g, or t
  misc_feature (51)..(51): n is a, c, g, or t
  misc_feature (56)..(56): n is a, c, g, or t
  misc_feature (60)..(60): n is a, c, g, or t
  misc_feature (69)..(70): n is a, c, g, or t
  misc_feature (131)..(131): n is a, c, g, or t
  misc_feature (135)..(135): n is a, c, g, or t
  misc_feature (144)..(144): n is a, c, g, or t
  misc_feature (151)..(151): n is a, c, g, or t
  misc_feature (157)..(157): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (179)..(179): n is a, c, g, or t
  misc_feature (199)..(199): n is a, c, g, or t
  misc_feature (206)..(206): n is a, c, g, or t
  misc_feature (210)..(210): n is a, c, g, or t
  misc_feature (219)..(219): n is a, c, g, or t
  misc_feature (221)..(221): n is a, c, g, or t
  misc_feature (225)..(226): n is a, c, g, or t
  misc_feature (228)..(228): n is a, c, g, or t
  misc_feature (234)..(234): n is a, c, g, or t
  misc_feature (236)..(236): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (264)..(264): n is a, c, g, or t
  misc_feature (281)..(281): n is a, c, g, or t
  misc_feature (293)..(293): n is a, c, g, or t
  misc_feature (314)..(314): n is a, c, g, or t
  misc_feature (324)..(324): n is a, c, g, or t
  misc_feature (341)..(341): n is a, c, g, or t
  misc_feature (346)..(346): n is a, c, g, or t
  misc_feature (359)..(359): n is a, c, g, or t
  misc_feature (361)..(361): n is a, c, g, or t
  misc_feature (406)..(406): n is a, c, g, or t
  misc_feature (409)..(409): n is a, c, g, or t
  misc_feature (437)..(439): n is a, c, g, or t
  misc_feature (447)..(447): n is a, c, g, or t
  misc_feature (449)..(450): n is a, c, g, or t
  misc_feature (458)..(458): n is a, c, g, or t
  misc_feature (465)..(465): n is a, c, g, or t
  misc_feature (476)..(477): n is a, c, g, or t
  misc_feature (507)..(507): n is a, c, g, or t
  misc_feature (509)..(509): n is a, c, g, or t
  misc_feature (523)..(523): n is a, c, g, or t
  misc_feature (543)..(543): n is a, c, g, or t
taaaggggaaaaangggtttatncncaaccatttgaaaaanaccatttgtnaccantccntcaaaaaannctttatgaacaaaaagccaagaaaaattaaaatcggagcttatgccaaaccaaaaaaaaanaacngagggaaanaaacttnaaaaanccttaacncnggnaatgggaanaaagataacccaaaaaaaanttccaanaaanagcaaaaantnaaannangtaaananaaaaaaaaaanaaagcnttncccaaggnattaaatttacaaattnaaaggaacaaanaaatttctatggcataaaaangggggtaaanccacagagggcattgcntagcnggccaaaaatggnangggccccagggtttttttttttaagcccagcaagaacctaagggnacnaattaaagcggggccccccaaaaataannngaaaaagnannggaattgngggaagnggaaaaaaaannaaaaacaataaggaaaaaccaaaaaacagntngcctaccaaaaccnaaccaaatcccccgcaaaanccggggaagccatttgggggggtttcccacccccggccctgaaaaagggcatat

SEQ ID NO: 563179 - DNA, 2142 bp, Homo sapiens
  misc_feature (1370)..(1370): n is a, c, g, or t
  misc_feature (1375)..(1375): n is a, c, g, or t
gaggggctgctttgtgttggtggttgcttgcgggtcttttctttgttgttggccgcgcgtgggtttcgggggggtctgtgtccgtgccctatgctttgtcgcgcctgtgcctgtgtggtgcccccgccctgtttgttcccgtggtttctggccccctcgcgttgtggacccggggcccctccgtgtggggaatttcgagggtttacacccccttcccctgtggccaccgggctttggggggtgacctcccgtgtggtcccccccgtcttcccgggttgtgcgtggaatcttgggcgcaggtgccagacagatgtgggaccccagttggacgccccccgcgggggcagcacggccattggggggccacacacccggtgtcaacttttctgcgccgcccttgaaggttgaatcccttgagaatttggcgcttgtggctcacaagccccctggttgagcgctctttgggaaccccattggcccccccaatttttctcttttggagggtcactttacccccggggcgttcccacaacatctttctcccagagcccccctccggcttattcccgatgaggcccccccctgggtgaaattgtattggggagatatgattctcctattgggccccacatttcccattcaccaccactggagtcccccccggtattcccgcgagatgcccgaaaaatactttttctaccacaaagggggcctctatcgcttttgtggaaatgaggaaccacctcttctgtacccggcccggttattgttgaaagggagaacctttgccaaccacttctgaaagagtttaacactggctccccaagaactctccctggaggcccgctgacacgcctttttgaccctgatgagggagagagaatgttatgaaattgtgagcccctggcccacgcgcactcaccacctggccgcaggcccttgctgcaccccctttttttgttggccctgaccccctgaggagccggtcccttccaccacccacgcccgcccagccccacgccacgattgaccacggccccacggcccccgccactgaggaggatgtgagggcgcggaactgggccgccccacgccccttgaactccacgccctcgagcccccacggccccacaggccacagagccacccccactgaaccacgtgcacaatgttgaaaggaaaggcccggaagcctgcccggggacccagactggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttnttagnagttaaaaaaaaaaaaaaaaaaaaaaaaaaaaaaaaaaaaaaaaaaaaaaaaaaaaaaaaaaaaaaaaaagaaaagaaaaaaaaaaaaaaaaaagaaaaaaaagcaaaaaagagcaacaaaagacaatacaacaagaagcgtgcagccagaagagaggggcaacagaatgattgacgagaaggcacgactacaaacacgcacgaagaaagcgaggcgcgaaccagaccactgcgacgagcaatagagagcgagcaagaaaacgatcgcataggagagacgaggacaacggaccgaagcccacccagaacgccaaggcaaaacacagaaagaaggaggaggcgccagcgaacgccagagcgagagagaaacaagacaaaagcacacagaagaagacaaagagcgagcaaagcacaggaccagaagcacaccagacacacccagacaccaacaacaagcgctagagacgagaacaaacagagagaggcagaagacgacaaacataatatacagcggaactaagaaatgacaaacgaagcgggacgcaagcagaacaaacagcagcaagcgacaggacgaagaagatacggagacgaggagaacgatatggcaagtcgagtgagcacagaaagagatagagacacacagaggcgagaagaagcagaacgaaagcagagagaaagagagaaagaggcacaaagcaaggccagagccaaagtagagaggaggaggagaaaggaaggggagcaaggagaggtggagaaagaag

SEQ ID NO: 563180 - DNA, 338 bp, Homo sapiens
gagttatctggtatccggaagctctgttcgaaagaagaaggtattggttgcaggtacctcaagaaaatctattatgtgaacaacagatatagtgaggtgaatcctcaggagagtaaataccctcccgtcaagaacagatgactcactatgctgtttactcttcaactctttttttttgagacggaatcttgctctgtcacccaggctggagtgcagtggtgctatgtcggctcatgggaaccttcacctccaggttcaagtgattctccggcttcagcatcccgagtagctaggactatagacatgcaccaccatgcctgagtacaacctgccggtgg

SEQ ID NO: 563181 - DNA, 408 bp, Homo sapiens
  misc_feature (18)..(18): n is a, c, g, or t
  misc_feature (22)..(22): n is a, c, g, or t
  misc_feature (232)..(232): n is a, c, g, or t
  misc_feature (238)..(238): n is a, c, g, or t
  misc_feature (315)..(315): n is a, c, g, or t
  misc_feature (366)..(366): n is a, c, g, or t
  misc_feature (399)..(399): n is a, c, g, or t
tagccgtaaaacgcgcanaccnattggcgttattgccgttgagaccaccgatataaacacctgtacttccatcggtcgtgattttacttccgcttccaagatcgacactggtgccatagtcattgatggttaggcctataccgttcgagttttcaatggtgaattgagtgggctgttagtgttgagctaatgccaataaatgatgcccgtcatcgttactcttaaatggtgnctggcntgtgcctaaagtcaggcatggggtaatagtcaccaattaaaggttaatggccgatggagaagggttttgaccaacancatctactgtgaagtcgggttaagctgtcagggaagctggtttttgccctnaataatggatcccttttggaaaacccagaagcngccgtttac

SEQ ID NO: 563182 - DNA, 174 bp, Homo sapiens
cacgtgtgggggctcacacctacaatcccaccactttgggaggccaaggggggaggactgcttaagcccaagagttggaaaccagccttatcaacacaatgggggcctgtttttaaaaaaaaaaattttttttaaaagaacccggcgtgaaggggggggggaaccttttaaatt

SEQ ID NO: 563183 - DNA, 186 bp, Homo sapiens
  misc_feature (20)..(20): n is a, c, g, or t
  misc_feature (108)..(108): n is a, c, g, or t
  misc_feature (129)..(129): n is a, c, g, or t
  misc_feature (134)..(134): n is a, c, g, or t
  misc_feature (149)..(149): n is a, c, g, or t
  misc_feature (152)..(152): n is a, c, g, or t
  misc_feature (164)..(165): n is a, c, g, or t
tctaaacgctaaaaaatttnaaaaaatctgaaacaaaccaaaaaactaaacattgagccctgaatctttacagccaaaacctaacctttggtcaattccttcttcaancccagatactcccgagtccancccanggcagggcttctgcnggntctcaattcttnnttttaaattttatacttcttt

SEQ ID NO: 563184 - DNA, 529 bp, Homo sapiens
  misc_feature (4)..(4): n is a, c, g, or t
  misc_feature (27)..(27): n is a, c, g, or t
  misc_feature (76)..(76): n is a, c, g, or t
  misc_feature (81)..(81): n is a, c, g, or t
  misc_feature (99)..(99): n is a, c, g, or t
  misc_feature (102)..(102): n is a, c, g, or t
gctncgtagtgtcgcgaaggctcccgntcctaattgtccgtaacgcgtgtgcagcctttgttttcctgtactggcnctgtncttaatgcgcgaattgtnggngtttgccaaaccgtattaacatgacagttaaatgtaaggctatgaaattacattggaagggagctttcaagtggtaggatattgactaactgagctccttcacttaaaatcagctgaataattccttaagtatacttcagacagtgtaattgtttcagctgttaagttaaactataaccttatcaggcaactcctgggtaagtaacacttagaaccatcaagagtggtttaaggggctggctatacccattcctctgtagagcacagagaaatcctattaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaact

SEQ ID NO: 563185 - DNA, 138 bp, Homo sapiens
tcctccacgcatcctgctactggctgccgggacctgaaccgactacctcatgaagatgctcactgagcgaggctacagcttcaccaccacggcgagcgggaaatcgtgcgcgacatcaaggagaagtgcgcctgggtg

SEQ ID NO: 563186 - DNA, 1650 bp, Homo sapiens
  misc_feature (106)..(106): n is a, c, g, or t
gcgtggtggtgtgtgagcggcggcggcctgggtgggggtctcggtggttgagggatagcttgaagcgctgggggtgttgttgctgccccccttcggatattggtgngggggtcctctacggtggttctgtcactaggcttcagctgctgggtgccacaggttttggggtgagccacgtgtcaacctgtggcccacacctgcgcgtgggggggttcttgtgcgtcaggcgcctggcctcgacgtggttgctccttttttgggggtgggcacacaagtgtgtgcgttggcgagcccggggccccacgggtgttgttggtcatacgtcggcgggctgccccgggtgggtgggggccacccactgcccagggttcgtgtggggaaccacttcctccacggggtgcttttcaggcgtgtgttggtcgcaaggcaccctttttgtaggggggcccaccgcgaagggtctttcttcggtggcttctatgagggttgcctcctgttgggtggagcacccctgtggcataccggcaatgcgtgtggcgtggtgccccgagcgggtttctggggagtggggcccctccggcgtgtgaagccttcgttgggacacccactcccagtggatcctcgaaccgaggttgtgtcgtgcgcgtggagtcccccttgggaggttgcggcccacgcctgggtgggcgccacaaaggtgtttgttgggggggccactccgcttcagtgtccagctctccggggcgtttgtgggcaggacgcgaatcgtgccccccctcctcaccttgggggggggctcgcacggtggatcctctcccctcctcggagggtccacaatcccactttaattgggggataaagggaaatggggtgtagcccgagatgggcgcggatgctccacagggcaacagatgggagactccacatgcgccccaccggggccacatagagcaggatgcccccagcgggtttgcttcacgggcatctctccattgatcgcctgtgtgacccacacacgccgtgtgcctggcacagtggaagaagatacccggggctattcacgtctccggggcccgctgtggtccttggaccacttctttccctcggaattcgggcacacacacacccagctgtctggagactcgttcactgtccacggtcccactctccgcgagaggggacccccctgggataggcactctggcgcagtagaaagctctcggagaagccacacctactggcttccagagcttgcgggtcccagagccaccaacaagagggccctctctgcgcctttctgcgtgtcaccgtgggacacaccccaacttctgccggcaccttgcccacgaaggccacacggaccgctggcttggtgtgtgccttcttgaaggcgaagaggcccccgaggaagctcctggcctacgataaggcgctgcgggcacgcgccttgaggccctcgctgccctacccctgtagcggcacactttcacgcggctcaccacggaaccctcccagtgcccccccttttttggacttcctgtggccacacacccgaagactccccatgtccccggcaccacccgccccccaaccacccgtgggaaaccccatcaaggcccccttcccattaaacaaaaataaataaataaa

SEQ ID NO: 563187 - DNA, 235 bp, Homo sapiens
  misc_feature (7)..(7): n is a, c, g, or t
  misc_feature (105)..(105): n is a, c, g, or t
  misc_feature (115)..(115): n is a, c, g, or t
  misc_feature (138)..(138): n is a, c, g, or t
  misc_feature (143)..(143): n is a, c, g, or t
agcaagngtctggaaggtgtctagctgggtagagagcctatttctaacagacacgcacatcgcagaaagcagcatgaacagctatcttccacatacttcccagtntacatttggncttaatgatcttgaatagatccnctctncatttttactcagccaggtttttgtactgattgtacaggtgttaaatttactttcaagcatttttttgtaatgatggttgtatataatttca

SEQ ID NO: 563188 - DNA, 203 bp, Homo sapiens
atcaccacctaactccatgctatctgatgtttcatgggcccccgcttagcggccaataacacctggtgctcctggtgatggacatcacacaatgtttaatacacacttacgccccacccttttcataaacatttactttgcccaattattcctcaccccttttttcatcctttgtcccaccgctttttatgtataaatgatta

SEQ ID NO: 563189 - DNA, 376 bp, Homo sapiens
  misc_feature (19)..(19): n is a, c, g, or t
  misc_feature (41)..(41): n is a, c, g, or t
  misc_feature (88)..(88): n is a, c, g, or t
  misc_feature (179)..(179): n is a, c, g, or t
  misc_feature (250)..(250): n is a, c, g, or t
  misc_feature (265)..(265): n is a, c, g, or t
  misc_feature (299)..(300): n is a, c, g, or t
  misc_feature (333)..(333): n is a, c, g, or t
ggcctaccctcctaccccngagcaaattcccccctgccctnagccctcccccaagtagctggaacctacaggcctcatgccccactgngcccccagcctaatttttgtattttcccgtagagaccggggtttcaccccacattcgtcaggttggtttcaaactccctgacctttgtgancccaccccgcctcggcctccccaaagtgcctgggattaccaggcatgagcccatcacaccctggtcaactntcttttgattagtgnttttgtggtatatctttttccatcatgttacttnnaatatatctatattattgtatttaaaatgtgtntcttacagactgcatgtagttgggtataatttttatccagtct

SEQ ID NO: 563190 - DNA, 682 bp, Homo sapiens
acccaccggcggaaatgtatagactcctatagggcgaactgggcctctagatgctggtgtatataactccgattatccaaatggacttctccaagtacatcgagaattagagacgcatgtcagtggatctcgacatacaacacatgttgtaatcgccataaccagactctcatgctagacccccgagctgtgggcccccatggtctgaagcacacagagcatatgcctcatgaagcgcgctactcacttcgctcagcatgggccaaggtggcccttgtcggcacatggagtggattctacagagtgatacatgcctcccttttatttcctgagtccatgccggaatgtgggtttccatttaacatggtggctgttcaccaagaaaatgccatgggacagcccccgtgactactacatcatggggtgagggtaatagacagtgtccatggagtgcttccggtgagagtttgcatgtgaccattagattattaagccatcatgtctgttgacaaaatgtcagtatcatggccagccgctctctttaatttcccatgtctgccaatttctggcgttgtccatgttgctactttaagggccacagccatggtttgattacattaactaacatcatggtttgcagaggcttggtgggtcccatgtatccagattgtttgaacctgtt

SEQ ID NO: 563191 - DNA, 368 bp, Homo sapiens
  misc_feature (40)..(41): n is a, c, g, or t
tctaggagtcagagtatgaatcaagaagaatggacttctnnttcttatctacctaatgccagataatgatgacagcaatgcattttctacattcatatcctcaatcatatgtttttgaatgcttactggaaaaccggtttaaaagaaaggtgactagttattggtcttgctctgacagccgtggaaaccatttgctgatgaaagcacaagcaacaacaacaaaaaagatgaataaactggatttcaacaaaaacacatttgtgcttcagagaacatagtcaagaaagtgaaaaggcaacccaccaatgggagaacacagtttcaaaacatatatctaataaaatatttgagtccagattaaaaaaaaa

SEQ ID NO: 563192 - DNA, 295 bp, Homo sapiens
gtacacactccccggacgcacgctgaactgatcgagctgcagcgctctgagacctaggattcctctttcgtctcaccgtaggtagggaagactggcattgtcttcgcaaactcatcactcgacatcgtactacacgacacgtactcagttgtcagccccacttcccactatgtcctcatcaataggcagctgtatttgcccatccatcggcggcttcatatccactagatttcccctcattctccgtgctacaccgctgacccaacagggggcatcctctaggagtcagcacctg

SEQ ID NO: 563193 - DNA, 153 bp, Homo sapiens
  misc_feature (67)..(67): n is a, c, g, or t
  misc_feature (131)..(131): n is a, c, g, or t
tgaggcagatttatatattccgtactttccctcttagtgtacagaagttcatgaattcccatttgcnagaaacctatgagattaactgatggaggaactaactctgaagggagtaaccacagatacatacngacatatagtaacatgagcgcc

SEQ ID NO: 563194 - DNA, 1348 bp, Homo sapiens
gaaaaggcagtcaccgttttccacttggggtttggtttgtgcaacaggcagggaggagtggggacgcgtttgttctagcttgatttccatggcaacagcagacggcacgcttggaccccagaacccagacaccctcatcctgtggccagaggggccggaccacgtgaccccatattcaggattccacacacagcccagaccgtcaccgatgacccggatggacatgcacttgttcccaggaacacacctcactcctctcctggacctcccattccgtacctggcctccctgcactctccagcacccatcctctgacccccaccccagtcttcaccagatgagaatcctgcacagctgggtggatggacctggcgcagagtgggagaggcatgcacactgacaggatggctatgacactgggacatggaaatcaaggaccatccgacgatactggtccacgagcaaccgtcgcaatcacgagatacatacgatgatgcaacagggcaatagggaagagcgcatgaacaataaccggagcaaaacaaacggaacaaaacaaacaaaaatcacgcacctatacacaacaaagaccactgggaagaataacactagcactaccagaaagacagcgcaatctgcaaaatcaatgcctaggagaagacgcatggagtagaggagcaccacagcacctaccaaggcaacgccaccgcaatcggatgagagagcgcgactagagagagcgggccaccaaacccgggcagcgacacagccgcaacacgcgcagacacagcaagacaaggagacctcccatgaaacacactgagaactagggaccggacagtgacacacaacacaaacagcaacataagcagagcggccgtcgcggaacaccagtgaatggcgcacagagcacacatgagatacaccaacaataacacacacagacaagcacggagagagcaatagcccacccaagctaggggcaaacgcacagacagtatccgagacccagatccatacactaagcaactcaagcataaccgaggaaacgacagcacagattacaggagagacgaaaaggcacacgcactggagaaaaaaggacaaaagaaccacgcggagacagcataccgatataggagaaaccaacctaaggacacaaaagtgaccacaccatacgatacgcatatcgacaaagcaacaggatacaccaacatagagaatacgaaacgatagcggccacaatcaatgataagtaaggaggcgacaccgacaacgagcaaagtactaagcgaaagacccaacagcagaacatacaaacgacacaccagtcaactgataaacgact

SEQ ID NO: 563195 - DNA, 332 bp, Homo sapiens
  misc_feature (10)..(11): n is a, c, g, or t
  misc_feature (183)..(183): n is a, c, g, or t
  misc_feature (185)..(185): n is a, c, g, or t
  misc_feature (263)..(263): n is a, c, g, or t
  misc_feature (285)..(285): n is a, c, g, or t
  misc_feature (311)..(311): n is a, c, g, or t
  misc_feature (326)..(326): n is a, c, g, or t
tttgggaccnnttttggaaacggccgcatcggtctttattctggttatccatgagcttgagattgattttgtagtcacccacctctaaggccatctttggcttcaaaatgatagattcttgggttgggtcgttgtactgaatgggtccagttggcacctcccccgtggtggttagttctggtngngaaaggaagaagtatttgggaggaaggtctgcatcaatgatgtttatgaacctgaggctttgggattcctctcaccanaaaaaatatagttccgaggttntgggtatggggggcgtttgtccattnacatcacgacagggnatccag

SEQ ID NO: 563196 - DNA, 158 bp, Homo sapiens
atatatcctctctgacctttaccatataatctatactagattattaattttataaaatctttactgttagctgggagaatatggatacagtaaatttaaagtatatacatgcgacgtaatactatatctgagttacaatgtgttcggaattggtgggt

SEQ ID NO: 563197 - DNA, 179 bp, Homo sapiens
aattagctagaaccgaagcccgttttggatcttcatgccctgggattctgcccgcacggaccccatctctgtgacttcctggagactcagcttcctagataggaagtgaagcttatcaagaagataggtgaccaccctgaccaaacctccacaggactgggatggcccgagaggactgg

SEQ ID NO: 563198 - DNA, 352 bp, Homo sapiens
tcttcagcacagcgagctgaatgtaccctcttgcgcctgtggaatcaaatgacagcgaggacactcccagcaagctcttcggggctagaggaaacccagcattatcagacccaggcactcctgtaccaacaccaggccagtcagacccagcccccatgtaccagcgtgggccgagtctttgccactgaccgagactcaggacccaatgtacgtctgaccttcagcctgcaacacctgtctgacgacagtcaaggccttccgcatccatccccctgactggagaagttaccacactccaaaccctggaccgtgagctgcatagcagctatcatctcctggtgcaagttcagga

SEQ ID NO: 563199 - DNA, 920 bp, Homo sapiens
aactaagtcatattttatatcttcttcgaaaccacacttatccccacctctggtatcatcacccgatgaggcaacagccagaacgcctgaacgcaggcacatacttcctatgctaccaacctgagtgaggctcgccttcccgcgtacgtcatgcgcgactgaatttacactacacgagacagccttagtgctggcactgaaacattctactgactcactctcactggccgcatgaactatccaaactcctgagccaacaacctgtattatgagtagcttacggcgatagcttttatagtaaagataccctcgtttagggagtccgacttgatgattcccttaaatgcccgtgtcgaaagcccgcctagctgctgggtcaaatagtagttgctcgtaggtaactcttaaaagtagggggtatggtataatatggcgtcaaactcattcttaagccccctgacatgaacagataggataccccttccttgtactatccctatgaggcataaattataacgaaagctccatactggcgttaggaaaaaagaacttaaaagtcgtgattggatagtcttcaaatcaggcacatgatggccctcgtagtaacagcgttctcatcagaatccctgaaggttcacggagagtcattgtcatatatcggccaggattaatctcaataatatgttgtataaatcaaatacgaaggtcaaggcgtattatgctcttaagatcaaattatccaataaagttttgtggttagaaggtcgtaagttgggtaaaccaattactatgggaattgggggggacaggtcggaaaatatccaatggggaaagcgaggcatcttttttgcacggggtgcccttaaatcttgaaaagttagtctttcccgaggtgaaaaaagggggcagggggggagtga

SEQ ID NO: 563200 - DNA, 184 bp, Homo sapiens
  misc_feature (51)..(51): n is a, c, g, or t
  misc_feature (91)..(91): n is a, c, g, or t
ccacctcagcccagcctagcacccagagagcaggaggctcctgggacccantggcctctggttgaaacgtctggaatttactacacagaantcagagaaagagagagagagaaatccgcgtcgggcaggccctcatgggccgcggtggtcggatcgcccccactggcgcacaccagcctactgc

SEQ ID NO: 563201 - DNA, 714 bp, Homo sapiens
ggcttcatttccgggtgaaactggcattgagggtactggggcgtgcgtgaggctgtttactgatgcttcctggtccggtggcctcggtccacggtaagccatggcatgatatgatcccaaggctaagaatatcatgccaaggaagcatcattggcttcttccgcaacaacttcggagtccgcgagccgtaccagatcctgctggacggcaccttctgtgcagagcggcgctgccaggggccagatccagctgcggagcaatgttgccccgtacctcatgggggagacgctaagtttggtgctagctagatagtatgggtgtgttcaataagcagtctagacataccatctggggaaaggcatttatactggggcaaaaggtgggattgcacaagaaatgcgcaaagttgcggaaattgggtctctcattgtcaaggatgttgcaggtgagtggtgggtccagaagtgtctgctttccattggcgtttgaccgagggggaaatactccttcattcaattaattgttgtggcgcgactaccaggggatcaggaatccgtctggtgacaagtaaaataagaacgcctgaaagttcctcctcaatgtgttattcattcagaaccactatggttttgggacaaccctttgtcccaagaaatggcgttgtaaaagcagtggcagcaggtccacctggtctcggtgcttgagaaagaaggc

SEQ ID NO: 563202 - DNA, 124 bp, Homo sapiens
gtacataccctatggtgccaagtgacaatggtgtgaactacaagattggagagacgtgggaccgtcagtgagaaaatggccagatgatgagcttgcacatgtcttgggaccggaagtcgagagt

SEQ ID NO: 563203 - DNA, 133 bp, Homo sapiens
tatgtacgcaaagactgtacgccaacacagtgctgtactgatggcaccatcatgtaccctggcattgcctgacaggatgtcgaaggagataactgccctggatcccagcacaatgaagatacaagaatcattg

SEQ ID NO: 563204 - DNA, 319 bp, Homo sapiens
attatgatacgaatcgagctcgtgtaccggtttcgccatgttccccagtgtaaaattacaaagtttttttgtttggtttttgtttttgtttttgttttggagatggagtctggctctgtcacccaggctggagtgcagtggcgtgatcttggcttactgcaacccatctcccaggttcaaacaattctcctgcctcagcctcccgagtagctgggactacaggggcatgctgccatgcgtggctaatttttatatatttatttgcttgagaaggcgtttttctgttgttgcccaggatggagtgcaatggcacaatctt

SEQ ID NO: 563205 - DNA, 223 bp, Homo sapiens
tggcgtatgttgcagtgagctgagatcccaccactgcagccttgtatttcccaagctcaggtgatccttccacttctgcctccccagtatgctgggactacacagcacacgccaccaaacctgggcttatttttttgtatttttagtagagatggggtttcgttatgttgcccaggctggtctcaaactcttgacctcgtgatctggccaccttgtgtcgtcc

SEQ ID NO: 563206 - DNA, 2850 bp, Homo sapiens
gacagactgccaaatggaacagacaagcaggttgtcttgtgttaaagaaaatgagatatgagtcagttactcccggaggcaatgctgctgttcagctcttgtgtttttgtggccagggtcttcatgaacactaataggggtaccaggccctcttccttgttagaagaaatcaggataacaaaggtatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaagtcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcagctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcatctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccatttatatgtggtattaaaaattaatgaaatgatataactttgatttaaacagttctgacacat

SEQ ID NO: 563207 - DNA, 192 bp, Homo sapiens
cgttctagaggatccacccaccggcaggttgtactggttttgggggagaagtggtgcatatgacaaggatggaagaggtcctatgacaggatcaagtggtggtgaccgcggtggcttcaaaaggtttggtggtcacagggattatggacccagaacaggtgctgattcagaatctgataattcaggtaacaa

SEQ ID NO: 563208 - DNA, 148 bp, Homo sapiens
gccgctgggagggggcctctgaggtttggatgccaggtgggctggaagaggccctgggtgagtggggctggcctgcagaacgggacttggggccggggctggtgcaaggtgcctcgtgcttgtgcggttggagctgcacacgtgccct

SEQ ID NO: 563209 - DNA, 2790 bp, Homo sapiens
gacagactgccaaatggaacagacaagcaggttgtcttgtgttaaagaaaatgagatatgagtcagttactcccggaggcaatgctgctgttcagctcttgtgtttttgtggccagggtcttcatgaacactaataggggtaccaggccctcttccttgttagaagaaatcaggataacaaaggtatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaagtcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcagctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcatctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccattt

SEQ ID NO: 563210 - DNA, 506 bp, Homo sapiens
gccagccttccccgcgagcggacgcggcagcgcctctgtacctcgctttttcttatttttcccccctttcccctttctttttatgtgtaggaccgttatcttgtctcccataccccggcgaggaccagtgaccccatcgggaggccgcatgcagccgggcgcgggggcaagacgccggagatcgacgacggaggcggaggagagcgcgaaaagagaacgagagagtgagacgggaggagaggaagcggaggaagagcaggggagagggagaaggcagggaggagagaggggggggggtgggggggggggcggagggggaggcgggaggaggggggcggggggggggaggggagggggggcggggagcgggggggaggggcgggatgagggcggagggggggagggcgtggggcaggcgggagggggcgggggcggggcggggggaggggggagcggggggagcggggggggggggggcggggggggcggggggagggacggggggg

SEQ ID NO: 563211 - DNA, 297 bp, Homo sapiens
ctagaggatccggggtaatcgatgccacttacatttttgtggaaagctagatagctcgtgtagacagtagacaacaaggtaaataggttttatgcccagaaatgggcctttggctaggcctttagtggtgtgggcagggaagttagctggaactagtttaggactctgcgttggatggcagtttggttggtgactggtggatacccggtgtacaccacatgatttccaaccccttttagtggccacctttgtgtttcagggctgggggctggggtcacaaggtgggcatcgcataaa

SEQ ID NO: 563212 - DNA, 790 bp, Homo sapiens
tccatgattatcacattctgccattaagggatattagtaccgtaatacgtgaagaatatgttaacttaagtctgaacttgctgggtgtaggctagcttctttgtattcttttactatccacccttgtcggttgaggtattcgtttcttgactaataaacccttctgatacttttagccacgaatatcagtctcataaagctattcctcgagtatagtttgtggctaacataaaaatgtttagcttatggtaataactatccgaagctgaactccctctagcaagatatttgtcagtgctcttatttagtatgcacttatgactatgcacttttgctgaaatattgtttgtaacactttgagtatattggccatttgataacaggttgtggtagtatgttggtctgtaattgaagttgcagatttaagaagtgttgttagctttgtaaatcatatatataggtgtatttatgtcctggtatatcgtcattccatctgcagctggagctggaatcccattgagtcttctatgctaccattcattttcttcacgagttcacaaccagaagagtgtgaaattcagtgaatgctgtttactaatcctgttacgagatgaatctcatttcaccaaaatttaattatgtttttcccgctagcagtgattgatcccacgtttgacagactcgattcactctgaaatttggcaagaactcaccacttaagggctccagccagtggcttactcagctgaactctagggttactactctttaattggtcccccatgggggg

SEQ ID NO: 563213 - DNA, 180 bp, Homo sapiens
ttagggagatgacctaaatgtatttttcagtcttacacccctgtttacttccttatatatactctgcgtctccaaataaacaaaactggtcactatgcccaaataagcacataccatccttttcctgtgcctctgccattcatttccttttcctgaaatgctcttccttctaatccccta

SEQ ID NO: 563214 - DNA, 632 bp, Homo sapiens
  misc_feature (521)..(521): n is a, c, g, or t
gttctcatcttgctaagcccaattgctctccctaacctgcttttggcttcaaagacttcagattccatctatcctggcattaacagtgtgcagatgtttaactctggactggcttcagctgtgctacactaatgggcgctgtccacataagcaatcttataaggtcgtcaatcaagaggccaaagtctgaatcccttctgtggctgacttaagcacaggatccagtccagagccttgttaatccctgatctactgtgccatacactcacttgcatgctaatatatgagcacgtacatacagcgtgcaatataccatgggattgatagaacgtgaaactgcaatagaatccttcaatcttactgttcaatgatcaagctgattagtgacaaatgcagatggaactaaatagactttccaagattacagaataccattgagcagatcggtgcctgactgtgattgaaatcgcactgcgaagtagaatatctctactacgacaccattgcttcacgatatcatnactgacgacacgtatagcagctcgcagattcttacctagagtgatgcatagtgcactatgtgaaagaccataaccatgtgtcatatgttgagtgactggtccgctaggggg

SEQ ID NO: 563215 - DNA, 295 bp, Homo sapiens
  misc_feature (275)..(275): n is a, c, g, or t
accaatggccgcagacgatcttcagatcacgttcaaccctgcctgggacttcaaaccacggatacatgccttgagtttgcgtcccggtgttcctttgtcttcggtggagattcgcccgcgtggagtgcagtagcgcatgcgtgttagcacgttgatgattgccggctgcggttgcagccacttagcgctggcgaccattccggcttatcgccatacatactgtgcagtaaattacggtagtccggcgccgtgttatttgctgtttccacctccgnttgccacctttccggccacc

SEQ ID NO: 563216 - DNA, 816 bp, Homo sapiens
  misc_feature (28)..(28): n is a, c, g, or t
  misc_feature (84)..(84): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (124)..(124): n is a, c, g, or t
  misc_feature (147)..(147): n is a, c, g, or t
  misc_feature (169)..(169): n is a, c, g, or t
  misc_feature (200)..(200): n is a, c, g, or t
  misc_feature (203)..(203): n is a, c, g, or t
  misc_feature (208)..(208): n is a, c, g, or t
  misc_feature (214)..(214): n is a, c, g, or t
  misc_feature (234)..(234): n is a, c, g, or t
  misc_feature (260)..(260): n is a, c, g, or t
  misc_feature (263)..(263): n is a, c, g, or t
  misc_feature (267)..(267): n is a, c, g, or t
  misc_feature (270)..(270): n is a, c, g, or t
  misc_feature (292)..(292): n is a, c, g, or t
  misc_feature (345)..(345): n is a, c, g, or t
  misc_feature (362)..(362): n is a, c, g, or t
  misc_feature (376)..(376): n is a, c, g, or t
  misc_feature (394)..(394): n is a, c, g, or t
  misc_feature (406)..(406): n is a, c, g, or t
  misc_feature (417)..(417): n is a, c, g, or t
  misc_feature (422)..(422): n is a, c, g, or t
  misc_feature (431)..(431): n is a, c, g, or t
  misc_feature (433)..(433): n is a, c, g, or t
  misc_feature (436)..(436): n is a, c, g, or t
  misc_feature (444)..(444): n is a, c, g, or t
  misc_feature (449)..(449): n is a, c, g, or t
  misc_feature (602)..(602): n is a, c, g, or t
  misc_feature (707)..(707): n is a, c, g, or t
  misc_feature (716)..(716): n is a, c, g, or t
  misc_feature (755)..(755): n is a, c, g, or t
  misc_feature (812)..(812): n is a, c, g, or t
accttccgtaaccatgtccaagtctctnaagaagttggtggaggagagccggagagaagaaccagcccgaggtggacatgagtnaccggagcatctccaacatncangangtcaacggcctctntaccttatcccaaatcacacaantggtcctcagccataacaagcnaacaatggtgccaccgaacatcgcagaactnaanaattnagaggngctcaactttttaaaaaacnaaatcaaggaacagcccacacagatnagnagcnttnagaaactcaaacacctgaaccntggcatgaacaggctgaacactttgccacgaggcttcggctccctagccagcncttgaggttctggactngacttacaacaacntgaacgaaaatactcttnatggaaacttcntctacatgacnacccngcgtacacncnatnaaagaaanaacanatttgaaatcctgccgccagatattgggaagctcacaaagttgcagatactcagccttagggataacgacctgatctcactgcctaaggaaatcggggagcttacccagcttaaagagctccacattcaggggaaccgcctcaccgttctgcncccagaactaggaaacttggatttaactggccagaagcaggtattcaaagcagagaacaatccctgggtgaccccattgcagaccagatccagcttggcgtgtcncatgtattngagtatatccgttctgagacatacaaatacctctacggnagacacatgcaggccaacccagaaccaccgaagaagaataatgacaaatcgaaaaanataa

SEQ ID NO: 563217 - DNA, 117 bp, Homo sapiens
aggtcgagttcttgaggatccccagttatggcccgggcgcggtcatacttcatttcatgttcacctatcatcctccatcgatcgtctattccgtactcctcacccttggtggcggga

SEQ ID NO: 563218 - DNA, 558 bp, Homo sapiens
aggtacccggaatgcagggtcaaacgcgcttccagtgttgagcacccaccttcgtcaaacacagtgacgacaaaccctatgtgtgcaatgtgtgccaccgtgcattacgatgggccgctggcctgagccatcatgccctcacccacaccgaccgccaccccttctttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccggccctcctgctcctgccgctccccgcactggacctgagggctgaaagcctgccccacctcctgtataggaagagggtatggtctgagatgtgcagactgggaccagcgctagcctgaggagctcagagcctaaggaaagactggcttatggggtacaagggtgactagaaccttcctgggactctggctatagtactttgaaattatcacccatataaaagagggacatggactat

SEQ ID NO: 563219 - DNA, 118 bp, Homo sapiens
tgtgcacattgtgctggcttagctggactgctgcgtgtgttgtaaccatgtggaagaccccagccccagtgagacggaaccgttctatcccagccatgataataaatgctgctctccc

SEQ ID NO: 563220 - DNA, 229 bp, Homo sapiens
  misc_feature (84)..(84): n is a, c, g, or t
tcgtctagaggatcccagcagttatacagactcaccaagcacagactgctgttccaccaagcacgtcttaccttagccacgatntcccaagccacacgtactaagggtggacttcaaagattttgtccgggtataaaccaattcccagggggaccagttactttcaatacagggtcaaattcagcaacaggtcctacaatccagtgctgttttcagatacaagcttcag

SEQ ID NO: 563221 - DNA, 1855 bp, Homo sapiens
tatggggcccaaaaattttattgggcgggtcaggaaaaaacccgggggaaggggcacccttctcctctcccactccctctctaccccaaaaagacacccctcacaaagggacacgaaaaacgcccacaaagccaggcggccatcaaagagaccttggagaggcaaaaaaactggtggaagaagactcatacgcgtggaacccgctcgagaagccgagggcgtggacggaacagagggcgcacaccaccgcgagccacacagacgcggaaaacatgagagagtgctcacagaggagcacgcgcaagggaaaacactcgcgagaaacatcaagtagcgcgccaccacaaaactaaagcctatcgcgaaaaaaatagtgcggcccccacaacagcagaggagaatataatcacataataaacagcgcgagaaaatatcacagagagcactgggagaatataatagtggcgcacacacgagcgagaggggcaccaccacaaagaacagcgcagcacccacatacgcgaaaaaaaaagcagggcacaccacgaagagagtcgatactactatccacaccaaagaagcagccgacgacgaagcatcatacgaaacaaagaggacacccaaccaagcgcgtaggaaagaacaaccagtcggcaccgcagaattcaccaagaactactcctccaccaaaaagaaaacccccctcttagcaaaagaagaaggagaataaggcaaccaccaacagcacacgagaagattcacgaaggaaacaaacactccatcgcgacagacacacccctgcgtagggatctccaaccaactctatgcgagagacaaaagaacacatggaaggacaccacccaagatagagaaagcggaggcacaaaacaaggaacggcaacctcctccacacaccgaaggggacaacacaacaataagaagatacctaacacacaggcgcaccagcagggaatagctgcaggagaacaccacacaccaaagaaggggactaattcacagaacgacacacgacacctagacaacaacgagacggtagacatatagaagctacaacgaggaggagctaatagagagcaccaacctcaccaaataaaatagtaggagcgggctaattcacagcgcagacttgagttcaaacatcctaacgcaaagaagaaacactctcaggagagcagaaagaaaagcataacatagcagctgaagagagacccacccgacaaggaagcagagacaggaagcaataaaaaccaccaaacagcacaaccaccaaccaggacaaggagaacacctctggagggggacgcatccaacacacagaagatagatgcgaccaccactctaaaagcagaacgacaacaacggagaaatataaccccccacaccacagacagaggaacaacgacaacactaaacaacgcagaaaaagccacacacaagcaaaaatccaatacaccagtatagacagaagagccgaaatagtaagaactacttgaggaacacaatccctcccccgaagaggaagatgcaagactccacatgagagaccgacagaggacagcagagaacacacaactaccgagagcacccccagataacgcacgacgcccgcaagagacaaaagtgacaaggcgacccaaccaacgagcaaatgaatgtgacaagaaacaacgtagtacaagcaaccacaacacaatgaggcggtgcgcgacagtacacaatcgattaccacaccaaacaacgacggcaaacgaacaaaatcatacgcaggcagaaaacacgtcagtgagcgatcacaacgaggaggaggcacacacaaacacaacagtgactccag

SEQ ID NO: 563222 - DNA, 247 bp, Homo sapiens
tgccttagcctacaaacggggaagtttttttcttctacttgttgatcctgtgttggagatttcccagggtatatggcattcctctaagtatgtctttcatttccagaagttttaatggttttttattcatgctatttctctggcgattttttcatccatatccggtattttttttttaatttctttaagtgggttttcaccattctctagtgcctccttgagtagctaattattcaacagtctcaag

SEQ ID NO: 563223 - DNA, 667 bp, Homo sapiens
taccggtagccagcccttgaccagtacgaggaagtttaaaagaagctggagatggccaacttattaagacccagagctggaaggcaccaagtggccccatccatgaaggattaattcgactgatagaacccggttccaagaaccctcccctgatccactaactggggacctgcacgctttcacctgaggcacgaaacttgaagagagagagaagaactggaaacgagaaaaagaccccgcgagtgactgagcttgctggcacgtcaccgctcacgttaatgtaagaatactgcccatggcccggagagctttaccctataagacccaaaagaaaccacgctcttggggccccgcggcgctggtggctcaccgccccgtaatcccccgcacctttgggaggccgaggcgcggtggatcaccctgaggtccacggagttccagacccgcctggcccaccctggtgagaaccccgtctgctactataaaataccccaaaaaaattagctgagcggtggtggcgggcgcctgtaatccccgctacttgggaggctgaggccggagaatcacttgaacgctgggaggcgcgaggttgccgcgagctgagatcatgcccttgtactcccgcttgggccacaccgagtgagactccctctccaaaccaaaccaa

SEQ ID NO: 563224 - DNA, 712 bp, Homo sapiens
tgcctgggccttggtgtagctggccgaagacgcggaggtccatgcctgatgaactggctgcgtgctttatggctacctgcctcagcccagccgccatatgtccaccatgcgttccgcccagatcttggcctctggcccttgcagagatgcatgcgcttctactgtggatcccagtcaccggtgtgctctgactgaagagaccaatggagtggatgaatgctggccccgctgtggggtgccagaccagttcggggtacgagtgaaagccaacctgcggctggcgtcggaagcgctacgccctcaccgggaggaagtggaacaaccaccatctgacctttagcatccatgaactacacggagaagtttggtgctggtaccactcgattggagtgcgtgttgcgcagtggccttcctgctgtgtgggagcaagtgccacgcccctggtcttccaggatgtgtgccctatgatggacatcctggctgcgtgcgacctgagtgtgagtgccgacatcattggtactcttatgcctctggccttccacttgcgacatgctcgcccgtttgattggcaccggttggcttctggcccacgcctatttccctgggccccgggctagggcgggacaccattttgatgccagatgagccctggacttctccaggcctgactggctggaacaacttctcttggtggcgtgctgacttggccctg

SEQ ID NO: 563225 - DNA, 346 bp, Homo sapiens
ttttaaaaaaatttttttcaaagtgttttggggaggagttttagggcttggggaaagggaggacccctttggaggaaatggcctttttttttaaaacaaaaaacacaaaacctcccaactgcctggcaagcccagtttcccttgtttgggccctaacgggactccaaggcaaccccccccccctcctggaaaggtgtgtgggtgtgagtgtgttcgagtgtgtgggctggtgttttaatatctataaataagtatatatggggttttttatatgtggataaataaagtctgttcatattggagctttgggagatgctggaattaaaaacaaaagtttcctcccgga

SEQ ID NO: 563226 - DNA, 439 bp, Homo sapiens
  misc_feature (146)..(146): n is a, c, g, or t
  misc_feature (149)..(149): n is a, c, g, or t
  misc_feature (162)..(162): n is a, c, g, or t
  misc_feature (206)..(206): n is a, c, g, or t
  misc_feature (217)..(217): n is a, c, g, or t
  misc_feature (264)..(264): n is a, c, g, or t
  misc_feature (312)..(312): n is a, c, g, or t
  misc_feature (323)..(323): n is a, c, g, or t
  misc_feature (383)..(383): n is a, c, g, or t
  misc_feature (428)..(428): n is a, c, g, or t
cggccatggtgccaccccatcaatgccatcctggctgtcgagaaggagggctgccagtgtgcatcaccgtcaacaccaccatctgtgccggctactgcccaccatgatgcgcgtgctgcaggcggtcctgccgccctgcctcaggnggngtgcacctaccgngatgtgcgcttcgagtcatcccggctccctggctgccgcgtggngtggaccccgnggctcctttcctgtggctctcagctgccgcttgtggacccttgccgncgcaagacctctgactgtgggggtcccaaagacaccccttggacctgngaacacccccnaactcttaaggccttcctctttcttctaaaggacccttccccggaagccctttccaaggnccaatcccggacttccttgggaggccccttggacaaccccccgancctttcccctt

SEQ ID NO: 563227 - DNA, 376 bp, Homo sapiens
  misc_feature (33)..(33): n is a, c, g, or t
  misc_feature (36)..(36): n is a, c, g, or t
  misc_feature (42)..(42): n is a, c, g, or t
  misc_feature (232)..(232): n is a, c, g, or t
tgttgacatcggtttaatagccgacgagatgtnagnaagtgntgatatatttgagcaaatctgataggatttatgatggatggatttaggatataagagaaagacagaaccccgaaaaaacttcagagcctctggtctgagcaattagaagaatggaagtacttttcaccaaaattaagagcagtagattttagcaggaagtcaagaatttttatttgatacattttagttngcaatatcaactagacagcctaatagaggaatataaatctagggctctaagaagtaaacatggaaatcgttgctacagagatggcatttactctaagagactggattggactgataacattgtgtgtgaaatgggaaggtggga

SEQ ID NO: 563228 - DNA, 350 bp, Homo sapiens
tctgagccggccccgattgggtcaacgcagctgtgctggcgtctgttcgtcgtgtcatcatccgattagcaggaatgatatgattcctacgccttctcatccgataaagagttggaagaggttgtggcggttacgaggattattatggtgattaagaatagtagtaggtatttaaagaatcggttgatgaaggggtctgagtgtatgtatcatatggagaattctataattgatcatgtgacgaatagtgctacgggaatgaatattcagcttggcaggggtggccatgaggccccggaggatggggtcaatgccaccttccagcacgaccctccaggaggcaaaaaaga

SEQ ID NO: 563229 - DNA, 430 bp, Homo sapiens
  misc_feature (3)..(3): n is a, c, g, or t
  misc_feature (382)..(382): n is a, c, g, or t
  misc_feature (419)..(419): n is a, c, g, or t
ttnttcccccccaagatagagtcaagctctgtcacccaggctggagtgcagaagcatgatcacagctcactacagtttcaacgtcccccgctcaggtgatccttccacctcagcctcccaagtagctgggaccacaagtgtgcattaccacactcagctaatttttgtattttggcagagatggggtttcaccatgttgcccaggctggtctcaaactcctgagttcaagcaatccaccttcctcggcctcccaaagtactaggagtacaggcatagcacttgctcagccataaatttttattattaatctcattgtaacaagtgagaaaactgagacccagagagcttaagtgaacttcctcgaggtcatagttaacttanctgccattagtttccaatttgaattcaattctgattnccaaataagtt

SEQ ID NO: 563230 - DNA, 191 bp, Homo sapiens
atctgtttccatcagttgttttggttcactatcatagccctctcttcctagatgtccatacatctgatctcccctacctagtttccctccccatcccttctctcatccagttccctccttccaacgactattatatttctccatttaaatattctcccttcacatattatttatgatcattctgtcgacgc

SEQ ID NO: 563231 - DNA, 159 bp, Homo sapiens
tctgcgattagatctagaggatcccgacagcacttaagtccgagctggcacacataaaccggtgtggtgttttttattactattatcatctgtgagtgacaccaggcgactgtaagtgcaacacagccctaactaaacgacttctgcaaggaacccacg

SEQ ID NO: 563232 - DNA, 136 bp, Homo sapiens
gataccaccacgcagcactagtaggaaaagtatctggggtcctctcgggaaggagcaatgagccatgggccttgattaaaaacccaaattatttaagaagccttgtgctccaatcttaaagaatacattacctcaa

SEQ ID NO: 563233 - DNA, 658 bp, Homo sapiens
gcgtctttccatatagtgagagggcagcgggaacaaataaactaacctgtcctttggggaaaagccaatcaaactcactaggattaggcattgctctatcactcctccatatctttggaagacggaggtcatgtttatcttaggtatgcattcaagcactaatgcttatctttgcacagcgggggagtaatcttatccaaatgcccttggagagaaaggctccccctgacagaactaccttacagaccgtttcctacagatagccgccaatcttgagtccttggtattcgttcaaccgtgctattttgaaggaacttgaaatggtatcgttgccagtattctaagaggccattgctggaagcagcctggcgacttgcgtcttccagactctgaaatctatctccatgcgagaggatgtcctatcgtcttattgtgcagacattaccatctcatccctagggaagggggtgcttcacacttcaatgcttagtagatccttgtgaggtgtgctccccttggcaccttcagtacattggggcaacacggcgtcccacgccctctaggatgatcccaaacgggattacatccggttactcgcctggggaactcggcctaaaaggacagtatgtgcccatgggtaaccgattacatattcttg

SEQ ID NO: 563234 - DNA, 653 bp, Homo sapiens
  misc_feature (206)..(206): n is a, c, g, or t
  misc_feature (317)..(317): n is a, c, g, or t
  misc_feature (334)..(334): n is a, c, g, or t
  misc_feature (373)..(373): n is a, c, g, or t
  misc_feature (409)..(409): n is a, c, g, or t
  misc_feature (485)..(485): n is a, c, g, or t
  misc_feature (488)..(488): n is a, c, g, or t
  misc_feature (498)..(498): n is a, c, g, or t
  misc_feature (501)..(501): n is a, c, g, or t
  misc_feature (509)..(509): n is a, c, g, or t
  misc_feature (512)..(512): n is a, c, g, or t
  misc_feature (514)..(514): n is a, c, g, or t
  misc_feature (549)..(549): n is a, c, g, or t
  misc_feature (551)..(551): n is a, c, g, or t
  misc_feature (554)..(555): n is a, c, g, or t
  misc_feature (558)..(558): n is a, c, g, or t
  misc_feature (571)..(571): n is a, c, g, or t
  misc_feature (575)..(575): n is a, c, g, or t
  misc_feature (577)..(577): n is a, c, g, or t
gacactgctcagggaagagcctgctacggtggactgtgagactcagtgcactgtcctcctcccagcgaccccaggctggaccccctgccgggaccctccacccttcggcccccaagcttcccagggcttcctttggactggactgtccctgctcatccattctcctgccagccccagacctcctcagctccaggttgccacctccntctcgccagagtgatgaggtcccggcttctgctctccgtggcccatctgcccacaattcgggagaccacggaggagatgctgcttgggggtcctggacaggagcccccacncctctcctagcctggantgactacgtgaggtctatatctcgactggcacagcaccnacctctgtgctggacaaggccacgggccagggccanacccaggcgcatccctacaggccagcccaggcctgccggaaggggccgcacctgctgtgtccctgcgagacatcancgnacgtatcagnggncagcagcncanantgccatggctgatactgtggaccccctggactgcncnttnnggngagtcccaggaanagcngncaagccacgagggacctgcacaaggatggacatggcgcctctgcttggcctctgtgggaccactatacgacagatg

SEQ ID NO: 563235 - DNA, 419 bp, Homo sapiens
  misc_feature (319)..(319): n is a, c, g, or t
actccactcataccactcgaacatcgtcttaccccagtatccctcgattccggacggcgatcgatccgaagccccttcaagccccctcacctggacaccaccaatcccacctgtcacacccccctggcacccggactcccccctctccccctccctcgctccacggagagggggagaagcctcggccataaagaggccccatcccaggggaccacgccatccacatcccgaccgatatcggacctgcgaccctcctggtcccaacccacatccgctcctataggcgcttgttccccggctggagtccctctgggggggnactaccacccgcccataccgctctcctctcaatccccggtctccctcgactactccaggacgcacctagcccccggaccaaacacgcctccagtgtcctc

SEQ ID NO: 563236 - DNA, 814 bp, Homo sapiens
  misc_feature (8)..(8): n is a, c, g, or t
  misc_feature (174)..(174): n is a, c, g, or t
  misc_feature (198)..(198): n is a, c, g, or t
  misc_feature (461)..(461): n is a, c, g, or t
  misc_feature (548)..(548): n is a, c, g, or t
  misc_feature (553)..(553): n is a, c, g, or t
  misc_feature (556)..(556): n is a, c, g, or t
  misc_feature (568)..(568): n is a, c, g, or t
  misc_feature (573)..(573): n is a, c, g, or t
  misc_feature (579)..(579): n is a, c, g, or t
  misc_feature (590)..(590): n is a, c, g, or t
  misc_feature (711)..(711): n is a, c, g, or t
  misc_feature (764)..(764): n is a, c, g, or t
gctttatnagcagctagggaattctttatttagtaatgtcctaacataaaagttcacataactgcttctgtcaaaccatgatactgagctttgtgacaacccagtaataactaagagaaggcaaacataataccttagagatcaagaaacatttacccagttcaactgtttaanaatagctcaacattcagcccgtgngttgagtgtgattgccagccttcccagtatacaggtccttccgggaggcaagagacctttcggctggtctgcgggtgcctcccaatgctggtcctgtggggcttctttctgagtctcgttttcttcccccgcggtctgtggtctggcactcaagtgttcgggtttccggggaacgtggctgcctccgtgttgggtccttgcttcgccttctcgtcttaacatgcccccttctgcccttaaagccttccctgtttccacaaatnacttctcttcatctgtttctccaagtttctgtagctccgtgtacttctcccccaaccgttggcgggttggcttggggtttgggttgngtggntcnaaagctctttgnccggncccatncactgggtagnactctcgctctaatccgatcctcgtggtaccagatgtcttggatgggagctttggttttgccatatcgcactcgaggcctttggaagacgggctccctcagcggggggaaggcgtcatatncgtcaaaccacaggggcttctccttcagcaccccggcccgaaccaggtcccgngtccgagagaagatgctccctacggtttccagccggctgcctgccatgat

SEQ ID NO: 563237 - DNA, 1054 bp, Homo sapiens
ataaatataacatgaaaaaaaaaaaaaaaaaaaaaaaaaaaaaaaaaaaaaaaaaaaaaaaaaaaaaaaaaaaaaaaaaaaaaaaaccgggacggggggggggcaacgggggccccgggggtttaggggggccccccggggggattgggcccccgggccccccactcgttggtggccctctttcttatacggtagttctccaacggcggggtattatatgtgtagcggaccactaagaggtagttaatcgccggggggtatgaggggatggggggcgcccctgcggggaaaaaaaaagataacccccctaaagaagagggaccccccaaacatgggggggagaaacacaacaaaacataaataaactgggcacccccctcgattgtgatgagaagggagcgaccacctcagcagggaccacccgcagaactgcaccaacacaccacttcgcgctagggggaccacacagacaggacttcgctcgaaggaattacccaccacgccgcatactgacgcaccaaaataattatactccaccccacacaaccggaggggggcgccgtcgcgcaccacaacacggcgactgaaagagaggagcaataacaacaccacagccccacaagagagtaaccaaaaacaaggccgcgggggcagacaccccacaagcatgtgttgccacacacgaggagaacaatccagtgggatcagacaccacccacgactcctcgtggacaccctcctaacagaaagcgaacaccacaaccaagcactcactcgagctgacgcagacgaacagctcccaaaagaagcttcgttggaagaaccaccacgcagggggatgatcgtcgcccccccccacccagccaaagtggggggattactaaaccaggcgcgggacgagccaccacacaacagagggcatcagcgactggaccaaccacactgcaggcgccctgtggaacagcaggacaccacacaagcaagtagtagccaccaccagacagagagagatcaacacgccgcaacgcgaagaggacaacgtagagcacactcc

SEQ ID NO: 563238 - DNA, 115 bp, Homo sapiens
cgacccagtgccacttgtctcaccgtgagagagcacataccccaacctaccactgcggtagtattacacttgtctccacccgtgagacagcactcaccgggtcctcccagggatc

SEQ ID NO: 563239 - DNA, 150 bp, Homo sapiens
ccagacgcggggtttctcatttaacgtttttaatgggtctcaaaattctttgacaaatttttggccaagctgcttccattagaagagtacttgatttaaaaactaataactccaaaactgccacacgcaaaaaagaaaaccagggtccag

SEQ ID NO: 563240 - DNA, 421 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (47)..(47): n is a, c, g, or t
  misc_feature (151)..(151): n is a, c, g, or t
  misc_feature (200)..(200): n is a, c, g, or t
  misc_feature (204)..(204): n is a, c, g, or t
  misc_feature (316)..(316): n is a, c, g, or t
  misc_feature (341)..(341): n is a, c, g, or t
  misc_feature (348)..(348): n is a, c, g, or t
  misc_feature (367)..(367): n is a, c, g, or t
ccaattngncnttatggccgggtgccccgttgggtttcagacttgcntggggcctgtaggccttttgttttggcaaatttctcccatttggaatggggaacatttactcaatgcctgtacccacattttatttaggaagcaactaacttgnttttgattttacaggctaatagatgaaagggacttgccttggcttagangagnctttggacttggactttttgggttaatgctggaatgaattaagactttgggggactggtgggaaggcataattggttttttattattttattttatttttttgagacacagnctcattctggtgcttaggctggagngcagtgncatgatcttggctcactgnaagctccacctcctagattcaagggcttctcatggctcagcttctcaagcagag

SEQ ID NO: 563241 - DNA, 409 bp, Homo sapiens
  misc_feature (20)..(20): n is a, c, g, or t
  misc_feature (39)..(39): n is a, c, g, or t
  misc_feature (47)..(47): n is a, c, g, or t
  misc_feature (82)..(82): n is a, c, g, or t
  misc_feature (106)..(106): n is a, c, g, or t
ggagaaacccggggaccccnggtaaaataattggaaggngccacccntggaggggaattaggtgaagggtaaaaattaaaancctccaattttacctattattggncccatccagacagataaccagtttgttaaaaatgataatagccaacaatttgattatgtgtgccttatgtatcatatgtatgtatcctgtatcctatatatgcctcatgtataaatgaaataaatgactaatatcacaagggaaaggaggaaggaattaggattatttcattattataagttacactacctatgaagcagtatagttttatttgaaaatgaacttgcattagttgtaaatgtatattgcaaactctagagtaaccacttaaaaaggaaaaaaaaagaagcataattgatacac

SEQ ID NO: 563242 - DNA, 1177 bp, Homo sapiens
gtaccagcaaaaactctaacaccaacctatctatcgaccccgccggaggaggagacacccatatctataccaacacctattctagatattttcggtacaccctgaagttataatatatctatatcctaccaggcttcggaataatctcccatattgtaactatactactccggacaaaaaagaaccatttggatacataggtatggtctagagctatgcatatcacactctggcctacctagcggctttactcgtgatgagcaacaaccatactattatacacgtaggaactacgaccgtagacacaacagaagacatatttacaactaccgctaccataatacatcgactatcacccaccggcagacaaagtatctagctgacatcgcacacacctccacggaagcaatatgaaaatgatactgctgacagactgctactagagcacactaacagagtatacatctatctcctataacaccgataggtgcgactgactggcacatacgaaatcagcaaacatcatcacatagacacatcgcacctacacgacaaacgtcactaccgacagatagcctcaaatatccactaatgttcataatcaaataacgacagctgtatacggccatcatacagaggacatacaataccactgatctatcccctaaacctcagggcaacacccctatacaacacctacgaccaaaaatccaacttaacactaatcattaatgccattcggacgataaatccaaaactatcctaaccccaaaaacaaatatactggagagatatccgggaaatgacccacgaaagatacaatacgggtactaacccgaacgcaaaaaagaaccaagtacacacttcctactaatcatggaaggcaacatcattatatcctccaacaaccactaattactacttaactccaccataacatgtacaacccccacctctcactacacaatccaacacaaaaactaacctaaaaccagacactactaaataaaaccccaacaacacatataaaacaacataaacccaacacaacacaaacacacatatgaactaaccacacactaccacactacacaaaccacaaatcccacacatatatctaaacccaacactaatccactaaacataacaaacatctcacatccacaaccaactacac

SEQ ID NO: 563243 - DNA, 1068 bp, Homo sapiens
attgagcaacgagagaagcgccttgcgactacgggcgtgcccaagcattggacgctaaggaatgaaagtaggtgtgatcggatttctcctgaagtgaaagtgattgagtattagagtggttgaaaggcgagcgctggtgtattgtttgcacacttgattaaagagagagtatcggagagaacagacggcgtcgtgcaactatggagacgatggggaaggcgggaataagtaatctgtagattggatcagtccgaagggcgatcggatagttgtgtcatgctatggtcgatgtactatagcgtagattaatggcaaatcagatgatcgaataggttagcgaattatgaggcatacatatttgctagatgcattgaagtttacattgaacaaggatagtacccaagatgggtctcgaaataggatactgctcgtgtgtatctatataagcgtgtcccatgtgatggcttaatgtggagatctatataacgctcggaatgaagcaatatgaaatgtgtgctagtgcctagtggggattcgaaccatggagaagtgcgcttagtactgcataactgagtgtgagaccgacgtgcaaccgaatttgggacttggtataaggagaaggattaacctgaaagtcgcggaataattactctagggcggtgtacggcgaaccgtttgcctggcgatggataggtagagagcgtctatataacctgcacgatcagcagcaagcggtctgaggatcacgctccaagggaagtacgcggagcaccagccacgcccgttcgctataattcgaacttcgaagggggaccctataagaaagtggttccagggttccagataactcccagggggagactgacaacgaacttgacgttgtgaatagcatcgatgtatagaacccccagattgcagtgggttggcgatagaaccgaaagagtttgagtttttgcgataaaggcgaaaacaggttgggaccaaacgtgacgcaccttgggaatgtctcaaggaagcaagggttgtttgtgttgttagacatggaacttgtcacggagaaaagcgtgg

SEQ ID NO: 563244 - DNA, 1674 bp, Homo sapiens
  misc_feature (455)..(455): n is a, c, g, or t
tacaaatgtgaagaatgtggcaaaggctttaagtggttcctcagaaccttactaatgcatcagatagattcatactgaagagaaaccatgacaaatgtgaagaatgtggtcacacgcttttaagatggtcctctgcaacttactatacatcacagagaacttcatactggaagagaaaccctgctaacatgtgacagcaatgctgtcgaccagtctttaaaccacgtcctccacgagaccgtaactgataccattaagcagaaaatccatacctgggaggaggagcacctcctagcacaactgctgcacagccactgctggccaccacgccttctttacagtgcagtctcttctacagcgaccttcaaactatactcacaattacacgaagaaactttcattacgtggaacgaagagtaacctcctatgcacacatttgttgcacacgaacagtncgctgagccaacacaaccccactatgtcgtcacctttggcgctcccttcccacacgccgtactaatcactctgacagcacgcgcatctcacaggacagaaaggctccccattacattgctgcgcaccataatgcatctaatcccaccgttaagacaacaactgtggtatacacagggcaaatggtgtgtgggggccacacaagagacccgcttatactcaacatgccataacagggtcgtccgcatataccaatgaggcatctattcagcccttcaacaaaagcgagtataagatcgcaaccgaaacgcttcttccaagtataacccatggtcacaacgcaagggaacacaacatacgccgccataccaaagaacagcttaggttcaagaacaagcggaacactacggattaggaagcgaaacaacaggcgcccgtctattcgtatacacaccgccaattagctttcccgcgtgttacaaactgggcccctattgttcaaccttccttacccaccagcccactactactttaggatcagcacacaccttatccccaactaactacacacatgtaggctgtaacagaatatgacgcgacgcacagatcgttcttcagcgattacaccacaccattcacattacgagcgacgaaattgatgagcctatccggacttgacgagcatcagagaaataaagctaccgctaaagtgttaatatgggcgttcatctattaggcaaactatcagacaagacagatacatctaaagttacgcacaaggatggccaagatcgatcacaatcctgcaaatttaagtcagtactgacggactcgcgacaaatcacacttggtcaccggtttatacgtatcacacagccgcgagatacaagcgaggacaatgacttttatcgggtccgacacaaacacgtggatcatgattcaagcagtcggaaggcacttatgtcgagctcgcacgtctcaatatcatcaatatatcattgcgaccttgactagacgctgcgcgatatggtggacagacgcaactagagttatcgtcctcatgacttgtgtcactcaagacaacagctagcttcaatgtcagaacagctatcttgtgtggaccgacgcaagactgtgtgcactggctgcgcaacaagcacgctccgcctgtaatacaagcacattgtgagtactgatgcacgcacataatagatacaccgc

SEQ ID NO: 563245 - DNA, 268 bp, Homo sapiens
  misc_feature (1)..(1): n is a, c, g, or t
  misc_feature (29)..(29): n is a, c, g, or t
  misc_feature (37)..(38): n is a, c, g, or t
  misc_feature (40)..(40): n is a, c, g, or t
  misc_feature (52)..(52): n is a, c, g, or t
  misc_feature (151)..(151): n is a, c, g, or t
ncccgcgttaagtaactcctcattcgccntctgtctnntnggtttgactgcncatgtaagtggaatcatccaatatttgtccttctgtgactggcttatttcacttagtataatgtcctcaaagttcatctatgtagcatgcatcagaatnttcttcctttttaaggctgagtaatattgcattgtatggatataccacgttttgtttgttttgtttttccattcatccatccatgggctgcttccaccttttggttactttgacgcg

SEQ ID NO: 563246 - DNA, 187 bp, Homo sapiens
gtgctggtggttctttacatggcccagttgcctattgttctcctggccaaaagcacaccaagctgccagaaatactagactgtcctagatattctattcaccagccaagacttctagttgtaccttaaacacattagaaagaccagcagagatctagttgagtcggcccagtccagaattgccccga

SEQ ID NO: 563247 - DNA, 251 bp, Homo sapiens
ggtatcagtcctcataaaaaaaaggttgcttttgaacaaattcacatttcaggaacacctttatttttggttttaattttcctcttaggtattccgtttaaaaatcattgtggtattagaaacaggtaaggaaattaaagtttttaaaatggtttcattctttgcaatatgcaaaatttagattttactttctggtcctgtaaagaacctgaagtgaatttacacttaatgggtgaattaatccagaatta

SEQ ID NO: 563248 - DNA, 989 bp, Homo sapiens
agagaggccgtgcccctcaggtactggtttcttgcacctacaagagagttggcaacatcacgtaagcaaagacttcagttgacatcacacaaaagctgtcagtggcttggtttctatggtggcactccctatggaggtcaatttgaacgcctgaggaatgggattgatatcctgttttggaacaccaggtcgtatctaaagaccacatacagaatggtcaaactcagatctcaacccaaacttgaagcaatcgtctgtcctaggatgacagtggacccagatgttggatatcgcgtgatttgcatcgtatccaagctggaaacgagatttataccgtgtgcgcataccaaagaaatacattctagatgcaaccacaatcctcgctaaacaattgcttttgtatcatagctaacgtgtgctcctctatttgggtatccaatgtctcggcaagaaattactatgcaatacatcttacattattaacaggtggacctgactcggtaacagagactcgagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattcccaccagaagcaaagggaaatcaccctgaaaggttttagaaatggtagtttggaggtgtgggtggcaccaattgttgctgcacgtgggttagacatccctgaggttgatttggtgataccaaagctctccaccaaagatgtcgagtctaccattcttcgatcgggggcagccgactggaaggacgggggtgcactggttataccagggagaaatcagttccgggcggacacacggcgacttatccacggaacgggtccttcgagaaaataagac

SEQ ID NO: 563249 - DNA, 452 bp, Homo sapiens
cagaaataggagtcattagcgcgtgaagcctcactagggatgttacgagcgtgggctgcagccagggatgaggggtggtgcttgatttgggaggactgtctatgcccatttgtctcatgtacacgagagacaggtgcccccaaggaacggcagggtggcgggcggaaaagtgaaccgtgtactgcaagttaggagatgctgcatgttcccaccctctcggatacaactcagtgcacacaggaggtggcctgataagtccgagacaggagagaccggcagtcacaatggggttctggcttaggaagggaagggcctggttatcactgtgggatcctgctaacagcagccaaccttctgctcacaaggaagaaagtttggtgttgaggggggtgagagaaggctgaaagaatgtgagcaaacatattgctgagcctgccgtctaggagcgtaat

SEQ ID NO: 563250 - DNA, 463 bp, Homo sapiens
  misc_feature (173)..(173): n is a, c, g, or t
tcaaagataaactttgagaatatcaagtgtcaaatgaaaggttagttttgcatagtgtttatattttagatttagcaaattaggactaataccttctgaccttacaaatcacaaatcataattcatcttctctctcccctgtgtgcttcttagttcttcatggaaaaacttanaatcatcaacacaaccacatgatattgacaagccaccctgggcaatcatttagaagcatctaccaaattaggatttggtttctaaagtctgtcagttgacagtttgttgatgaagtaatcccctctgcatttaacttcacagttcctgttgctcttccacttcctcatccaaactcttcagtttctcctatacaaaggctttcgtcgctccctagtagaaagtagcatcaacagcttatgccccttttcacgaaattcttgcctatcatttgttgcctttactaatgctg

SEQ ID NO: 563251 - DNA, 145 bp, Homo sapiens
aacaccaacccataaacaacaagcgcccaactgacccaggatggggaccacagccagagcagccttggacttgacctatctgactgttgctcctgctgtctctgagggggatttaccgactacagacagcggcagctgcggcccg

SEQ ID NO: 563252 - DNA, 470 bp, Homo sapiens
  misc_feature (32)..(32): n is a, c, g, or t
  misc_feature (111)..(111): n is a, c, g, or t
  misc_feature (173)..(173): n is a, c, g, or t
  misc_feature (201)..(201): n is a, c, g, or t
  misc_feature (251)..(251): n is a, c, g, or t
  misc_feature (258)..(258): n is a, c, g, or t
  misc_feature (267)..(267): n is a, c, g, or t
  misc_feature (270)..(270): n is a, c, g, or t
  misc_feature (276)..(276): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (306)..(307): n is a, c, g, or t
  misc_feature (315)..(315): n is a, c, g, or t
  misc_feature (317)..(317): n is a, c, g, or t
  misc_feature (328)..(328): n is a, c, g, or t
  misc_feature (337)..(337): n is a, c, g, or t
  misc_feature (343)..(343): n is a, c, g, or t
  misc_feature (453)..(453): n is a, c, g, or t
ccaggagagagtcagtacattagacttatagnggaggagcagaactgaaccctggcctgtgaaataacaatttcaattaaaagctgtctggccctgaagaaagagaaatgntcctggatatagctggtcctctgagctggcagagctgagcctccctcgggtcttctggtggnaagatgccaaagttgaatagtgtctgtnggcatgatgaccaagtccttgtgctttgggcctcttccctctggtatttnggggggngtgccagangcncccggnggaggtactgggggggnccagngncaaatnnagcggctngntttcttggggngcatctggngaattncggggcgaggccagtgactcccagcggctccagtgttggttggcgggcactttgggctttccagggagagaggttgcgggggagggggccatgcagaaggcgagggctgncttggcaattttgtctg

SEQ ID NO: 563253 - DNA, 448 bp, Homo sapiens
tgcacagctagagcgtgatctctgttgctgctagagcgtgtccgtgtctgccgggctgtgccgagccatggaaccagtgggaagaccttcacttgcactgcttcctaccccgagtccctctgagccttcttgagatgggtcagatggactccctgagagccgaggacgcggctgtcttctactgtgcggtttgcagtaatttcagctgtgcgatctttgactactggggccagggaacccaggtcaccgtctcctctgcatccccgaccagccccaaggtcttcccgctgagcctctgcagcacccagccagataggaacgtggtcatcgcctgcctggtccagggcttcttcccccaggagccactcagtgtgacctggagcgaaagcggacagggcgtgaccgccagaaacttcccacccagccaggatgcctccgggggactgta

SEQ ID NO: 563254 - DNA, 174 bp, Homo sapiens
gacaaaatcatgcacagaagcagaaaaaggcaaacagagaagaaggaggaacccaagtagctttgtaggcttcgatgtccagaacctcttgcccttcagcctgtgtgcctatgagccagtcaccaccacagctacgcgatatcctaccatgtagatgctacacagagtcccaga

SEQ ID NO: 563255 - DNA, 175 bp, Homo sapiens
  misc_feature (147)..(147): n is a, c, g, or t
tgcaatactatttttttttttctctctctcttttttaaagacagttttggggtaatctttttctttggcttaagtcagagatggaagggggaaatgagcaaaggaaaaaacaaccaacaacaaggagaatgaagctttcccttctgntatcaaaatgctccggagaggagggact

SEQ ID NO: 563256 - DNA, 450 bp, Homo sapiens
aagatgttccaggcaggacgagagaaagggctaagaggacactaggtatgaaagaaacagaggacaggacatctcagcctcagaaccaccctagatgccagccagaggagaggccagaaacatgtgactgatgaaggtgtccactaaagcttcacacaaaactgcctagagaggagctggatgcagctgtggcaaagaggataccccacatccaggtgtaggagaaaccttgagaaagcagcctgcctcttctctcacactctttcactccatctctgagtcttcctttccctttttgatctccctgtgttgcccacccccaaggaatagggaggggatctctcatccctccgcctctgttgtccctggtctctgcaataacctaatgatttctcatttagttgtccagggctggatgcagaaaggctcgttttgattgcttgttccgct

SEQ ID NO: 563257 - DNA, 352 bp, Homo sapiens
gactccatctgtggcttttcaggagaggccaaggccctccttagtacattattagaactttctgatcccagggaaatccacacgtgtgtatcagcaaatgggggctgctaggacagtgtgtcttaagtcaagggcctcttatcacacagacatgcacagaaaacattgacataagagctttgtggaggaagactatgggctgatcccagcccctgtccactgtcaggccatggtcagtctgtggctgatggcgtacacatccatctgtgcttgcactccaatacaatagaacataaaggaaaaatctgggccaagatcagtaaagataaggaccaaagacaagagctgggat

SEQ ID NO: 563258 - DNA, 183 bp, Homo sapiens
cttgcagaacattttatccaatggctgcagaatacacattcttttttagcacatgtatcattctcaaggatagaccatatgttaggtcacaagtcttaaaacattaaaaaagttgaataggatgaaggatgttgtgtgaggagagtggaatacaactagaaactaataacaagaggaattttt

SEQ ID NO: 563259 - DNA, 945 bp, Homo sapiens
cgagggaatactgcagcagactagtgaggaaggatgtcctgatccagaaatgagatgatggtgttcacaatccaggaatgggcatggagggatgcataaatgtaaatggatttagacagaagcattttatagaatttgccatgaattttgtaattggatgtggtagatgacaatcagaatagatctcagggataatgcttaggtaatagatctgaggcattgtttcggattatctgaggtaatgaacctacgcttaagaaaccaatcatggtttaacacaaataaccatgtattttactcgtgcacatcggtgagtctagaggtgtgtttacatacgtagagctacgttgattgtgacagatccctcatgaacgtttgtatatgctagcatggatgcgcgctgcgagtgtcacctcaaggcttcttacacatgcctgcacactctgaggctgggatacattgtcgacacaggctgtcgtgctgggacaagggtggccccctgggggcagtctctcttacagtgtggtctttccgtatgtgaatgcgcctccaggatagcctggactatcgtcaatattgccgcgctgataggctgtacagagccaaactgtgaccacgagaagctggcagaaaactgcctggtcttatctacccagaatcctcaagaggtgatccagtgtcccttttactgttgtacttgattcatcgagtcgcagtaaacatgggcattgtaaggtacaaggggcacgaagggagatagctattggcgggaggaaacggtggaaaaattcctgggcagggtagaaaagaccactgatgtttttgggtggggtaaagggggtctgcgctatgactgggaccccggagaaaaccgtgttggtggcccgggaaattagccttgagaggacaagataaatgtgaaaataaatgatcacatggatgacg

SEQ ID NO: 563260 - DNA, 228 bp, Homo sapiens
tatagtctcccaagtctctctggacacaaatgagcgggtacctacagaggaaaaccctccaagaacacaggagactgggcatgggggctcaagcctgtaatcctagcactttgagaggctgaggtgggaggatcgcttgagtccaagagcccaacaccagcctgggcaacatggcaagaccttgtccctactggaaaaaatgaacatcaaatgattattgggaccttg

SEQ ID NO: 563261 - DNA, 982 bp, Homo sapiens
  misc_feature (2)..(2): n is a, c, g, or t
  misc_feature (100)..(100): n is a, c, g, or t
  misc_feature (118)..(118): n is a, c, g, or t
  misc_feature (211)..(211): n is a, c, g, or t
  misc_feature (215)..(215): n is a, c, g, or t
  misc_feature (227)..(227): n is a, c, g, or t
  misc_feature (289)..(289): n is a, c, g, or t
  misc_feature (296)..(296): n is a, c, g, or t
  misc_feature (300)..(300): n is a, c, g, or t
  misc_feature (312)..(312): n is a, c, g, or t
  misc_feature (319)..(319): n is a, c, g, or t
  misc_feature (347)..(348): n is a, c, g, or t
  misc_feature (362)..(362): n is a, c, g, or t
  misc_feature (368)..(369): n is a, c, g, or t
  misc_feature (382)..(382): n is a, c, g, or t
  misc_feature (413)..(413): n is a, c, g, or t
  misc_feature (436)..(436): n is a, c, g, or t
  misc_feature (501)..(501): n is a, c, g, or t
  misc_feature (720)..(720): n is a, c, g, or t
  misc_feature (728)..(728): n is a, c, g, or t
  misc_feature (833)..(833): n is a, c, g, or t
  misc_feature (894)..(894): n is a, c, g, or t
  misc_feature (912)..(912): n is a, c, g, or t
  misc_feature (914)..(914): n is a, c, g, or t
  misc_feature (982)..(982): n is a, c, g, or t
cntggcacagatgaaaggtaatactcaccagctcctcacatgggactcagtgacaatgtcagctacacaccatggaaggagaacaaacccgatgtaaaangcacctagctggggagangctgtggtgttcactgcctctctagcaggtttgcttttgtgcactgtggctaagtctggatgaataatattgggaagggaattatcggttgcntggntcctttgctggntgcttccctctcctgattggtgtatactcgccatgtggtaggtggtcttactggtgactgtngtttccnttcnggaattcttctnctctctnccttttctgctctagaaggttggggaanncttcccccagtatnattttnngctgcggcttctnaaggctgttaaaaagcatcctaacttaatancaaataacaacagttaccaaatnttagacagataagtggcctgatcttaaatcaatcaatggaaaggtagattcataaattttaaatnttttctggtgaccagtccattaaccatggggttaatgcctcgtctgaaggaagatgtttacgctgcatccacgatccagcaggcgcggtgtgctcttggcaactgtgaatgaatagctaccgtttcccttcaacacaccgcgctgccaccggtgaccgcatgtcaagtgctgaagttagaagagaccccacgttggcaaaggccccccaggcgatgatntgcctgangcggccaggtctgtgggaaacaagacttacgatctcaaataatgacccccaagtgccctcgcctcttcctgcttgccctgtgcgcctcgacctcctcacgggganttccaaatgagttccatttccctctcagttctaggcactctggaacatctttgattaacangggtttttcatttctttncnacgccattggtgacttttgacttggaatgccgattccttctcctggaagaatggctttcgttgttgcn

SEQ ID NO: 563262 - DNA, 917 bp, Homo sapiens
gcaggcctgtaaacccagcacttcaggagatcgatggtagaggatagcctgagtgcaggagttctagaccagcctgagcaacatagcaagaccccctctctaccaaaaaaaaaaaaaaaaaaaaaaaaaaaacaaacaacaaagaacacaacacaacacaccacgaacacacatatacgagggggccgcgaacaaagaagtaatacacacggcgacacgcgagcgcgcacacggaatcagagaacgcacacatcacggagagcagcggaggcaaacatccaccgcacgagcaccacactgataggaaggaggacagcgaaacaacacagcgcgaaagcagcacgcgcgaggagcccacaaccgaagtcaaataacgacagcgcagacaggaaacagagccacagagaaaaacaacaagagaaacaacagccacccaggcagcgaagaaaacagaaaaaacagaaaaaagaagaggacaagagggagaggccggggggaagcgaagagacagggggcgggtgcagacgagagctgacgaaaagcgagaaaagagggtgagggaggacgagggaagagagaggaagaagaagaagggaggcagaagaacacgagagaagacgagagggagacgcggagggagagatactgaaggaggaggacagcgcaggagaagatgcgacgtggaggaaaggcaggagggggagcgagaaaggtgcaatggaggaagtcggagcagcggagatggaggagagcgacagagagaaggagaggggaggaggaaggaggagagagaggagaaaggggaagaaaaggagaagagaagagcgcagccagcgagcgagagcgacaggagagggaccgagcgagcgagagcgaacagagggaggcagccacccggaccaggaggcgaagagaca

SEQ ID NO: 563263 - DNA, 996 bp, Homo sapiens
ggctgggtgcgttgtggctgcctcgccgctgatctcgccacgggctctgccagcagacagccttggcacacaggcacaagggctggatgcccagagatggagagtgcccaaggggagatgtgagcctggcagtgtgcttgtcctgctaacctgtcgctgaatgtccccagaagctgtggccctcagtgccaggcctagccttcctccggcccagcatgcgcctgtcggtccgtgagtggttgctgcgtggcagcctggcttgcgccctggtcctggtgctggcggttcagcttgggacagcaggtgcttagagttgcctgggctgtgtgcttggctgggcctgcgtggatgcccccggtggcgtgcccattgctggtcctgagcagggagggagctgtgttgattgggtgtggacaccaaagacacttttggtaattacctgctactggccaatggcctccattgccttgctcatcttacggtgtgggttggccgtagccgtcttccactgtgggcacccgcggttcgacttgcggctgccattggctggaggcgcccacaccgtgatgggtgccgctgctgggcgatcggaggacacctggcattctatccgcgcagctgttggcttggcccattgctgccaagggaccttggtttccaaaagcttacttgggcccagtcggagaaagccttgctgggccttggcacttgaagggccgggggcgttgaccggcattgcacggggtgcctggaacagcacaggcaagtgaacagtcgaccccgtatgcgagtcacctagtcgcacgcgtagaattatgcccgccacgctagctgggacagaaatgccagggccacccggcagcgtcgccatcctcgaccaacaccacaccgtgactccgctatttataacccgtgcgttccaaacggttccagtaccgagatccataaaccgtagtacagacacacgctgtgtatagccaccagcgttaccattag

SEQ ID NO: 563264 - DNA, 643 bp, Homo sapiens
  misc_feature (11)..(11): n is a, c, g, or t
  misc_feature (357)..(357): n is a, c, g, or t
  misc_feature (418)..(418): n is a, c, g, or t
  misc_feature (449)..(449): n is a, c, g, or t
  misc_feature (488)..(488): n is a, c, g, or t
  misc_feature (498)..(498): n is a, c, g, or t
  misc_feature (508)..(508): n is a, c, g, or t
  misc_feature (544)..(544): n is a, c, g, or t
  misc_feature (551)..(551): n is a, c, g, or t
  misc_feature (580)..(580): n is a, c, g, or t
  misc_feature (617)..(617): n is a, c, g, or t
gaacgccagantctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctatgctgaggagtnaatacccttaccccagctgtcctctgcgcgtttggcttttctattattcttctccataaanttaaagttagaaaagcttctgctgcttaggngccggggcgcggctagctacacgccctgctaatcccagncactttgggnaggccgaggncggggtggtatcacgaggttcaggagtttcgagacncagcctngtccaagatggtgtaaaccccgttctctnactaaaaaatacaaagtaattagtctgggcgttggtnggcggggcgccttttaaatcccagcc

SEQ ID NO: 563265 - DNA, 430 bp, Homo sapiens
tgtgttggtccccggaaattcggccattatggccggggtaatgggcaggacatctccctggaagatagccgcctaaggttcaatcttcgggctcattaagctgatgactggggtcatgtagcccctaactccagactccaccagatgtgcagggttagagatgtcctggattcctataaggtccctattcaggatagacctaaattggatgaactcagggccagtaatctgccccccaattggcctttccctgagcagggggcctgctcattagatctttggatactttaccatgtgaaatactaccagaactgttctctaaacccactttttctgtagaggaaggtatcatctttttttttctcatattacaaatggccaaataccggactttctattttcatattggctgaacccattttttaaagga

SEQ ID NO: 563266 - DNA, 857 bp, Homo sapiens
taatgctagtggaggctgggttttaatcggacgagggtagcatatcacatagacagatatctccaagagtgctggagtgaccagcatcgcctgctgaagcccacggctgtgccatccatcttccacctgacctgagaagaagagtggggtgctggagtgccatggcctgcaccctggagaaaagatgccagcaaggccacagtggtgtgtgtgaggtgtggacactctgatgtgcctgccaccagcatgatgtgaggcttgcaggttgtgtcacctgtcctcgatgtgtgaaaccctgatggccaagccatgagtcccctgcaggattgaaagcaagcatgctctgcaagtgtgaatgccacacccagtggctggcccaagttgatgtgcctggcccagccacggatgcaagtgcccatgcaatgcatcttgtgaactgtgactccagtgatggattgtgacttgtgccaccatggttggcatgtggcaagtcaagggacaaatgcatgaatgctgtcttgccacatgattgctaggctgatgaagagctgccaacttcctccattcgaaatggtgggtgcgttgacaaggataaagaggtgtgggcatattctatggattgacttatacgcccccattgatactgggggcgtgcaaatttatcggcatcacttcattctgtacagtattctacctccaatgcaacaccccggagaaagggcatcttgtcaccccgagagccccattgaccgcaaagaggctgaaaggaagatgttggaaccaaagctgcagtgggagcagcctggaccccgaaaagggccttgccagagcctaccaaggtcatcagttacgggaac

SEQ ID NO: 563267 - DNA, 109 bp, Homo sapiens
gtggcgaattcggcacgagggcggagaagatggcggacgacaaggattctctgcctaagcttaaggacctggcattactcaagaaccagctggaaagcctgcagcggcg

SEQ ID NO: 563268 - DNA, 344 bp, Homo sapiens
ccctcttccaaccccacccaccaataaaaagagatttccaaatgcatcatatagtcatcaagacatggtaaagtctgtttcaaaattgtattcattctagttggtgtttagaggcatcttattatggttttaatttgcattcctttgatgactgatgatgttgagcatcttttcacgtgcttattgccattcctatatcctctttcatgaaatgtttttttctattttgcccatttaatttgggttatgtcttatcattaagctgttaagagtgtctcacatattctagattacattttcactctcctagtggtgcctttccaagagcagcttttagttttggt

SEQ ID NO: 563269 - DNA, 890 bp, Homo sapiens
  misc_feature (144)..(144): n is a, c, g, or t
gctggttattcactccgaccatgccctctgaaagcactctatagacctgaagcaggttcgcactgctctactccctaagacattaggcagcgacttcctgggacacgtacctgccgggggcgcactccacgaagtaccctaaangctcagagttgcgccctttcctccaatgctggaattacgttgtttccatgttcccgagacttgcacgatcatattaccttcgaccgaaagtgacacggtgaccactctcgtgggagctccgcacgtgggaccaagtcggcaggagggcaggtatacatacctgggaccgcaatcaacatccggatggtaggtttctatctacccgcaacagtgccctttgttggccctccatttcctgtaggctactatgtaatgaccaatgggtaatgctgtggcgccgggaagaaaactacgccctgtcctgggaatgctgtgaaaagcccaactcctgtttcggaggccagaacgaactagcattaaacgaatggtcatcccccgatgagtctcaagtaggcctgagaccggcattgccgctatggagggaaagcgcccgacgagttgaaccgagttagtctcaggaaccccattgtatcttccgccttgtgacccccttgaaatccggtagttgaaacagggcttgggtactcggagttgcgggcgacgggaccaagagactttctccagattcgtggcttgattaatcacccctttgtccacacaaactgtctgctgggtaacgtgccataatcggcacggtacgaaagtgcctgggtgactcataaattgatagccccacgtattacttttttgcacgacagtttgccgtgcccatgaggtgccctcccaggcgggaacaatggcacaac

SEQ ID NO: 563270 - DNA, 391 bp, Homo sapiens
ccctcttccaaccccacccaccaataaaaagagatttccaaatgcatcatatagtcatcaagacatggtaaagtctgtttcaaaattgtattcattctagttggtgtttagaggcatcttattatggttttaatttgcattcctttgatgactgatgatgttgagcatcttttcacgtgcttattgccattcctatatcctctttcatgaaatgtttttttctattttgcccatttaatttgggttatgtcttatcattaagctgttaagagtgtctcacatattctagatgtcctttgtcagatatatgcattgctaatttctcccagtctgtgggttacattttcactctcctagtggtgcctttccaagagcagcttttagttttggt

SEQ ID NO: 563271 - DNA, 170 bp, Homo sapiens
tctctgcatgtgtcatagttacagtgtcctttctctccttcctttccagccactgtgtcttgaaaatgcttgtcctggttgagcgagcccctgccctgtaccctcgctctggtatggagcaaggagagaggcccagcagacaaggcaggaagaatcctgaaggcggaggg

SEQ ID NO: 563272 - DNA, 769 bp, Homo sapiens
aaggcaggacaggcccggtggtaatacggacgaggtggttccaggagcgtggccttgtgggccatggtggtttgacctcttcagacccgtccggtggcctggaggccggagtgctctcctgagtgtctgcccctgcagtggctatcttgtacgcctgctgctggtgctgtgatgtcgctgtgagtgtgcttggcagtggactctgattttgtgttgtgtcctgctgctgcccctgccctgcctctgtcctgtgctcttgaagctatgtagattgatgtgttgccatgatgtgtgcatgtggatgctctgcctgtgtgtgatgatgtggcttgtgcccctgtagtggacatgttgcccagtgtgaatgtgatgcccctgtgtcctccagggcacttgacttttgcccttttttccctgtttgatatgtcatgtgctcatgatgtgtgcttgtaaattgtctttgtgtgaagatggtttcttgtaagccccttggcccttgtgttgttgacgtgatggtgaaattgtgctctgtgcctggctgcctgtgcctgtgtgctatctcttttgtgctcccaaagagaagtgacagttgttgggagtatctgcctgtggcttctcttttgtgctcccaaatgagaatgacagtgtttgggagtatctgccggcgctgtccaggtcctttagtacagcgtcactccatctgatgttgcagaagctgggctgaacctgcggtgtgtgggcatagacctgggctgggtcttgcgcagcc

SEQ ID NO: 563273 - DNA, 280 bp, Homo sapiens
tgctgttgactatttttgattaaactgctcgaggttagggctacgcatagtggggtatctaatcccagttcgggtcttagctatggtgtgttcggatatgttaaagccacttccgtagtctattttgtgtcacgtggagtgttttacaactcaggtgagtttaagcttaattggggagggggtgatctaaaacactcttcacgccggcttctattgacttgggttaatcgtgtgaccgcggtgcctggcacgacattgacccaacacatagtctgcagca

SEQ ID NO: 563274 - DNA, 190 bp, Homo sapiens
gtaccgcaggctctctactcagcctcctgaatacgctgggactacagcatatgacactgttcctggctaatatttgaatttttttttggtagagagagggttccatatgtggcccagacggtttctaactccgggcttcaagaagtactcccacttggggttcccaaaatatggggataacagacctgag

SEQ ID NO: 563275 - DNA, 180 bp, Homo sapiens
ttacgacccgaagacattcctcccagcatgacaaaatctgctcagctcaaaggctttgggacatcccctggacactgtacagcctccatcagagatatgtggcccttcaggccatgggagagtcggacactcaatgacggcactcagctgggggtacccactcccgtcttcgggtcgttt

SEQ ID NO: 563276 - DNA, 390 bp, Homo sapiens
tatatttgaaattcctttttaaattaggtgggtgaatggtgtaaaacttcactatatgttctccctgtccgttacttgacttgctcatctcctgccaatatatgtccattttaaaaaacaaacaaccccatcaaaaagtgggcccaggacacgaaccgacacttctcacaagaagacatttatgcagccaacaaacacatgaaaaaatgctcatgatcactggccctcagagaaatgcaaatcacaaccactatgaggtatcatctcacaccagttagaatggccctcattaaaaagtcccgaaacaacaggtgctggagacgctgttccgaaataggaacacttttacactgttggtgggactctaaactagttcaaccattgtggcag

SEQ ID NO: 563277 - DNA, 102 bp, Homo sapiens
gccgcagacacggccgtctattactctgcgagagattcatcgggtagtggtggttattactcatccgagtactactacggaatggacgtctggggccaaggg

SEQ ID NO: 563278 - DNA, 1570 bp, Homo sapiens
acgctgaggccacgggtcccggaccaaccccacctccagtgcaacagcagtgttttcaacacatccacacagcatgggcaacaatctgtgagcaaaatttgcccttcccacatggacagacttgtcccatggtcatcacactttgtcatgcagcaaccaaagcataacacagcacagcaaaacgcacacagtataactgtgcccactaacccaagatcacactctgctacccagaccatgcaaacacaactttcgggccaggacttctgtcccctctgcacagaattcagacagcaggacaacacacagcctctcccacaaacatacccgacgcacattacacacacattcgccatctgcacgacccatcacgccattctcttacactcgaacgtgcagaccaaacaacggacaacagtcactgcttgggcgccacccggcaccacggggatcccacacccttacatcgccttagaaggacacaacacaaacagaccaccacatacacgctcgccatggacactggacacaccgcaacattgacacggacacacatgcccaaccaccaaacaaccgaggaaccgcctgcacatgcgcacggcaccaccagagaaacaaacacgcagacctacaaaacgcagccaaagacgccgaaagacatcgaccaaggactgacaacaagacacatgcatggcggataccaaacgacctacacagaaggcgcccccaccacactaccccaggaaacaacaacgcagaacgaaaaaacataagggaacaccagaaacactgggaacgaaccgcgggcccaatcggcagagcaaaaccactaacaacaagcgggcacaccaccaagcaatgagcgctacaccacaacacacacaccactagcacacacaacaggacgatagggcaacttcccagcagcatgaacaccacataacaagggacaacacacacacaccggacacaaaccccacagtaggcagcaacgacccggaccaggaaacaaccgggccacacaacaacagaccgacaaaccgcgacaacaccgaaacgcaactaatggcgcacaagagaagacacaccgaaacacaagcagaccaccacggacaccgcacaaacggacacggtaagcacagaacaaacgagacaacaaagaagaacaaacaaaagcaggaaggcagaggaacgagaacaccagacagaaccaaccgaatatcacgcgacgaaagcaacgtagagcaatagagacaacccaaaccagggcgcacagtagaacaccagagaaaccatcgagccgacagcagacgacacgagaccccgacaagcacgagcaccgcgaacgacacaagacacaagcgggaaggacagaacgaacagcatagtaaccaacgaaaccaagacaagacagaagcgaagaaagcgacgacggcggagtgcggacgaagacacgtagcagatagaacagaaaaatgcacagagaaggagacgccgaacaagaacacagcaaggcagtcgagaacaacgactcacgagcgcttcctagacacagggaatagccgcacca

SEQ ID NO: 563279 - DNA, 414 bp, Homo sapiens
ttcccaaaaaaaaaaaaaaaataaaatgtccggaaagacattttggttttggaggaccagttgaattgattggtaaccttctatggcctaaataataatctgatggtagcctgccaaggagtatactatgatatataattgattctcaaataatagatgttatttcatttgtaatgcattaaaataaataaaaacctgtaatgttgtagaggtattttctctgaatagcaaatcattaatttacacatctgtacatgtattctgaatattaagccctttaacacctgtatagaccaaggcaagaatacaaatgggatagaattaaatatttgtattggcaaatatttacatgattatacaatatgacaaagtttttaataaatctatagataaacctgagccatttaaaaataa

SEQ ID NO: 563280 - DNA, 558 bp, Homo sapiens
ggaccccaaagccgtgaatactgactcattcttaccctgcatgttatacaatggtatatgatggctgcctccttatgagactgtaaggggagctctagtaagttcccttaagcaccacagaagatcatcatggcttggtcccacttttaataggaaagaatccaagttacaccagatagtgtatacttagctctcctgaagaagaccagttcagtggattaatgtctacatttacatatagtattcaaagacgaaacttgtgaatctttacatatcaacatgcccacgttaataccagtggtgataatggtttgaattatgggtgagtgtacagtatcagagatgtcagatgcactagatatatctataaataaaatcagggctttacggtcaacaatatactttggcctgacttaagtgcctgtgcttagactcttagaaaagactaaaatgaaaatggccccgctataattgtcaagcttaacacagagcttgtgcggaaggtccctatactgttgagtgtcagcgatctccaggtccacgatatgttctcgtggc

SEQ ID NO: 563281 - DNA, 128 bp, Homo sapiens
cggctcggaccgtgactgtatcttcaacacaacataactaatgaacagacgttggtctccatctcttgtcaatgaggaaaggcaaagtgattctttgattccaattcgaaatggtgtggggataaata

SEQ ID NO: 563282 - DNA, 298 bp, Homo sapiens
gccatcccccttcgtaccagaggtatctcatgcttcttctccttcttagatgtgcgaaccagtgaattgatgtggggagtgagttgactgattattgcggcgcttgaatccagggccactgctagttcttgggactggctctccagatccttcagggtaggagaggatgcacggccctccccgtagatacctgttgctgaatccccaggtgagtgggaaccaccagaagtggctgtgtcagggctactgccattgattttctttttcctgttagctcctgctggaatgccaaggctct

SEQ ID NO: 563283 - DNA, 258 bp, Homo sapiens
gcaagcgtaaatatgactaggagctcgggaaagctgcccggttcacctgtgacttcgcacagtttagggcccatatcatgctctgcggataaatcccacattcaacgaacagctattcctcaagtaactccctgcaactccctgctgcctctgctgaatgcgcacgcaccatcctatgggaaagcatattatcttatcccgaaaatcatccacttacaataagccactatgaaggcaaagcgtgaaaccccagattgg

SEQ ID NO: 563284 - DNA, 960 bp, Homo sapiens
tggcgccgacgtcatggtggagcgagtactgcgcaagcctctttgccatcctcctcccccaggacccctcgttcgagatgtcccctggacctgtatgtgctatgcgggggcctctggggaggccctgctggagacgctctggctacagttcttggtcctggaacttgcgaggccttgagcaggccgaggcctgggccagtgtctccacagatctgctccaactgctgctgcccatgatcgagctggggtgcccatcgagctggccctactgctggccgtggtgcaactggatctgggggtgagcgtgcctcccatgatgaggtggagggcttggtggagaagatccggttccccatgatgttccctgaaggagctctttgagctgctgttcaactgtccctgtactggagcctgtagggcctgttccagaagaagactctgcaggccctggtaattccacattgtgtccttccatttgctgtgcccggtgcatgggcctgaacctcggcgtggatatctacgaggccccggttttagacctcgaccacctggagtgcctttgtgagtgacagttcctggagtgccggtggtctccactggtctatcagtcagcacgggggcttttggtcgaggtattcttctgattattttcatgacccctctgagtaccagattgacatcctaacagtacttctaaaatcaaacaagccacattcatcttccgaggacatatggtgtctgaccgtggaatactcccgaatacagaactgatgaaaaaggtttactgatcttggacaaacccgtataagtgactaccaggttgggggatatggacatgataaaaaatcctaagctgaaaggttagggacacaaaaaggaagggaatcagtgaaaacagaaaacaaaaacggagaagaagaaacacacacagatagtagaagaaagaagatataaaaacaa

SEQ ID NO: 563285 - DNA, 787 bp, Homo sapiens
gggtgtggccggagtaggggggtttgacgggcaagtagggacgttgctgacacgatagcgtcctctgcgagtgtggagccgatggacgacctacacttagcaacatcatctcagcagcgcagtctgaagtggatcttcgttcgggggcaaggtgtggtgtgggcaagactcacctgcagctgcaatgcctggcagatgcagctctccaggggtgcgtgagagtgttctgatcatctctcacatgacccagctacacaacgatctcagcatgcttttcgaccacgacagttctcgacatgggtgtcctagccaaggtcaaaggctatgacgacctctttgtctatggagattgaccccaggctgggcgtggcggagctgctctgagcgcgttcgttctggcaggaggacaacgatgctgagcatgggcaagaagatgatgccggaggccgatgaggcgcctctccctggcatcgatgaggccatgagctatgccgaggtcatgaggctggtgaagggcatgaacttctcggtggtggtatttgacacggcaccacacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgccgtacatccgtcaagtcagcgaacagttcaaggacctgaagcagaccaattcatctgcgta

SEQ ID NO: 563286 - DNA, 143 bp, Homo sapiens
cattagctgacgttagtgtcttagtcagttcgggctgcattaccaaacatcttaagctgagtgacttgtacagcaacagatattaattttccacattcctaggtgggaggagtcagagatcaggggccacgcattgccatgct

SEQ ID NO: 563287 - DNA, 355 bp, Homo sapiens
aggatccccccagtattctgctcttgaaagcagcaggagttgagtcagtttaaatttgggacaggccagccgtttttcctcaaatcacctcccagatcactagcagccaggtgcttgatcttcctgacaggagcttggaagcgcgttctgtgggggatgtgatcagcattagaaaataaacccaaaggtactgatcttcagggaaccccagtccaactgctgggccacatggctccacgagcaggatcacagtcaggcagcctcacccaggcatgcagcatattagggtcccacgttgtaaacgcgcagcagatagacgaagttttgctgtatcatatcacgaagcaggaactgg

SEQ ID NO: 563288 - DNA, 930 bp, Homo sapiens
ggcccagcacgatgatgagctgagcgatcagcgtgggtgaataatccatcaccaaacatcaggaacgaggatgtgaggctgctgggagggacagatcaacggcaggagaggtgggttccctgactcctttggaaagagaactaggagataaggagatgagatgatagacgatccctctgcaccatcaaggctccagaatatcccctgcacgaatgtgcccagtgtgagaatcgtcctttgctgtcttcctggatagatcgatttcacacgaactcgaatatacgatgaggggcgacgctgcacggatcgcgccggatgccgggtggctttcagctagctgtccccagaactgaggatcggatcttgcgctgcaccgttgtcgacgtcggtagagggtggtagggcgaggtggggggacagggtggtgggacagcgtgtgctcagtcggggagggacttggtctgttgccttccacatgtctagtctcgggacgctgtcggggcgcgtcagtcctgatgcttgggggtgtcccgagtgacttgtgcagctatggctatgtcgggttggcgggataccacaaggctcccgaggaggtggtggggggtgactcgtgctgtcggcgagtctggggggtgcccctgggacggtggcggtcggatgcactccagccaaggacagttccgggacgtgcgctgggggcgctgtcacgggaacgcgccgtcaccctatgagcacgtcgcttgccgtcgaactggcttctggcgggaacagactttggcgtgcggttcctggctacggactccgtgcgtcgtgacgaaggtcgcggcgccaccagtttgcgggatagcctctggccgatggtttgtggccacgggcttgtcccaacaggccgcggggggcgcgccggacttccttcggcccggaggggcc

SEQ ID NO: 563289 - DNA, 489 bp, Homo sapiens
  misc_feature (446)..(446): n is a, c, g, or t
acccaatgtctgtacccccactgtatctaggaaataactagcttgcttttgattttacaggcttataggcagaagagacttgccttgtctccagatgagactttggactgtggacttttgagttaatgctgaaatgagttaagactttgggggactgttgggaatgcatgattggttctgaaatgtaaagataaaggatttgggaggggccaggggcagaataatatggtttggctgtgtccccacccgaatctcctcttgaattgtactcccataattcccacatgctgtgggagggaccaaggtgaaacaactgaatcatggaggcggtttccccactactgttctcattgtagtgaataagtttcacgagatctgatggttttatcagggatttctgcttttgcatcttcctcattctctctttgcctgctgccatccatgtnagacgtgatttgctcttccttcccttccaccatgattgtgacc

SEQ ID NO: 563290 - DNA, 302 bp, Homo sapiens
  misc_feature (1)..(1): n is a, c, g, or t
  misc_feature (63)..(63): n is a, c, g, or t
  misc_feature (70)..(70): n is a, c, g, or t
  misc_feature (74)..(75): n is a, c, g, or t
  misc_feature (83)..(83): n is a, c, g, or t
  misc_feature (94)..(94): n is a, c, g, or t
  misc_feature (103)..(104): n is a, c, g, or t
  misc_feature (113)..(114): n is a, c, g, or t
  misc_feature (119)..(119): n is a, c, g, or t
  misc_feature (123)..(123): n is a, c, g, or t
  misc_feature (149)..(149): n is a, c, g, or t
  misc_feature (152)..(152): n is a, c, g, or t
  misc_feature (171)..(171): n is a, c, g, or t
  misc_feature (180)..(180): n is a, c, g, or t
  misc_feature (183)..(183): n is a, c, g, or t
  misc_feature (192)..(192): n is a, c, g, or t
  misc_feature (213)..(213): n is a, c, g, or t
  misc_feature (302)..(302): n is a, c, g, or t
nttgcacatttgctataagcaaagtcttgatgatgagcgcagggatgcagtgtatctatcagntattgantatnnaaacttanggatgggggcngatagcggnntccaattannctaancatncctgtaaatttttggaaagagagganaanattaaaataattcacttgnaatgaggtnagntgtatatgngaaggtttttagtagcatatntcacaattgttgcagatgagaatattaaaaatcattctatggtaatatattcactctgatgtgtttgcatagtctagcgttattttttn

SEQ ID NO: 563291 - DNA, 117 bp, Homo sapiens
gatttttggagacctctgcgccatgagagccaagtggagagaggaggcgaattcgaagcgtgaggcgcaaagaggagagatgagcacagagtccacgtaaccgtagctctgcacacc

SEQ ID NO: 563292 - DNA, 358 bp, Homo sapiens
agagaggatatagatcttcatgtaaagtattctttctcagggctgtcctctcatctgcggagcaatatctctgtttaggtaccagtaccatgctgtattggttactgtagacttgtagtatagtttgaagtcacgtagcatgatgcctccggctttgttcttttggcttacgatcgactaggcattgcggactctttttttgaaccatatgaactataaagtagttttttccagttctgagaagaaagtcattggtagcttgatggcgatggcactgaatatataaaattacctttgggcagatgacatccggaggcctaatcgaggatttcatcttccattatgcccaactccagtc

SEQ ID NO: 563293 - DNA, 313 bp, Homo sapiens
agacttcgaccaggttgagactgtcttcaaaaacaaaaactaaaaacaaaagctattacaaatattcaattattcttgttttctcacttcccactgcaaggaagatattccacttgtcgcaggtgtggtaggttgatgctgcctgagcttgtaagtgatctaatatgaccgaacaccaagccgtaaagctggtcttcaatgcccggtgggtttcattgcagtgcctgtgcttatttgctattacaccatgctgcctttgtccaccatactcacagtccgatcagaatgtttgaacctcctccagtgtttggtg

SEQ ID NO: 563294 - DNA, 351 bp, Homo sapiens
  misc_feature (102)..(102): n is a, c, g, or t
  misc_feature (202)..(202): n is a, c, g, or t
gggttcaagattcaatctatgaacccaacatttttaatactatataccattctctttttgtattaatttcctattgctgctgtaacaaatttccacaaactnagtggcttaagacaacagaaatgtattctcttccagttctggaggccgacgtctaaaatagatccatagggctgtgttccttgtggaggctccagggganaggggttttcttgctctttccagcttccaggggctgcttccgtcctttggctcttggcctccttcctctaccttccaaaccagcaccatagtgtctctgaatatccttcttctgtctcctttcaccctcttgcctcccttttataagga

SEQ ID NO: 563295 - DNA, 270 bp, Homo sapiens
  misc_feature (71)..(71): n is a, c, g, or t
  misc_feature (101)..(101): n is a, c, g, or t
  misc_feature (107)..(107): n is a, c, g, or t
  misc_feature (113)..(113): n is a, c, g, or t
  misc_feature (174)..(174): n is a, c, g, or t
atcggatcccgtggtcagggcccccagggccaactctcaatccccacccccagtaataggcactcatgggnacctgtgtcccttgccctctcctgagaagngctaanatcganatgtcacaagtcacgtgcagcaggacctgggtccgaggagagagctgtaggaaaggccagngccctgaactcaatggcggactggggtggtccccaccagcaacagccaccttggcccgacgctccacatcagattcctcaaggcgctagagtgcgg

SEQ ID NO: 563296 - DNA, 269 bp, Homo sapiens
cctgtcatctcttggcctcccaaagtgctgggattacaagcgtgagccactgtgccccgccgaggaacagaattttaaggatacatttccttaatgggtccgggggtttctggaagcggctctttagtttgagtagacctaaaaatgctagggactctacttctacttatacagagggcacggatagtccatggcatgaacagttttagagatacgcaaaataaatgcattggatactcataatttactacttataagaggcaaagaat

SEQ ID NO: 563297 - DNA, 559 bp, Homo sapiens
ccctttttggctgtcgtgccgacagcctgacagctgcagtggtgacgcacgagtgactgtgttgcagtgtgctgacggtgagccctgaagtctgtgctagacgtggccgcgctgggagggtctcgcggggagtggccgtcggggtgagtgcttgcttacctgtttccgagcggctgggcagctatggctattcttcgtgtgtctgtggtgaacctggctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgccatcggctcccagctgt

SEQ ID NO: 563298 - DNA, 132 bp, Homo sapiens
agccttgtccatcacttatcctttcccatctatcatccttctcccttcatggaatccattccttcatgtctaaaaacacattcaacgtcttttcttttttttttaatttatattttttatttttaatggaaa

SEQ ID NO: 563299 - DNA, 373 bp, Homo sapiens
  misc_feature (131)..(131): n is a, c, g, or t
aattttgtatttttagtagagatgggggtaactccaatgttggtcaggctggtctcgaactccccgatgtcaggtgatccaacccgctcggcctcccaaagtgttgagattaaaggcgtgagccaccacgncccggccccagacttttttttttaaaactgcatgtgtacatcaaaaggtaatttggtgttaagcaaaggtagtcaacttatgattctataatcatctttctgtgctggagtaaaaatgtaattccaagacatacacatgcacacaaacgtgtgtacacatagccacacacactcttcagaactgccgagtaatcagctggtttgtattacttaaagaaaacacagaaagacaaagtcgacgc

SEQ ID NO: 563300 - DNA, 283 bp, Homo sapiens
cccatcttttaaaaaaagtaaaaattaaaaatatacttcatggttcatgtcatagccctagagaatgaaaaatttgccgttggttgtccattaagtgatccgttggttaaatatccctaaaagccaacggtattccatggggattttggttttctttttatcattgtatcaaactatatggaaatcatatggttagatgtgattatttgataatgttagtccatttgaatccattttagatatttcacaattaaagaatatgaaacttcagaaaaaaaaaaaa

SEQ ID NO: 563301 - DNA, 431 bp, Homo sapiens
gatgaaacagctaatacgggtaatcggaataacacagatgtaaagcccatatatgggaaaacagcctgaactgtagcgcatatatacatgtgtatgtctatgcaaagattaacgcaattcaagctgtgacagagtgtacagagaacatgtaaatcttcctaagatatctgcatagctccgttcagcttcatcttaggctatgaaacctttgaaactcaagtagcagtatacgatataccactgtacttcttcctatataaatcttggagaactccttctccccgccccccaactcattttgtgtagttttctttgttgggtataatagagacagagtcttgctctgcactccaggctggagtgcagtggcatgatgttggctcgccatagccacaacctcgaggctatcatggagctgaacctgccaacgg

SEQ ID NO: 563302 - DNA, 321 bp, Homo sapiens
  misc_feature (88)..(88): n is a, c, g, or t
  misc_feature (153)..(153): n is a, c, g, or t
atttgtagaagaacagaaaagccaactgaaggcaagtcctataagaaaaatccaaattgctttgggaggcctggctgggcggatcatnaggtcaggcgtttgagaccagtctgggcaatatgatgaaacccccttctctactaaaaacaacanacaacaacaacaacaacaattagccggacatggtggcgggcacctgtagtcccagctacttgggaggctgaggcagaagaattgcttgaacctgggaggcggaggttgcggtgaacctagatcgtgccacttcactccagcctgggcgacagatcaagactccgtctg

SEQ ID NO: 563303 - DNA, 313 bp, Homo sapiens
cagatcataatagggttcgtgcttactatgagaatctaatgctgccactgatctgacaggaggcagagctcaggaggtaatgcaagtgatagggagtggctgtaaatacagataaagctttgctggcttgcccactgctcacctcctgctgtgcggcctggttcctatcaggctacagactggtagtggtccagtctggaggttagagacctgagcaagccaggcctgatttgctcaggtctccctgtcggtatgtccgctgagctgtgcaagccatgtctggcttgctcgagtgtgtggccatcttgtgagg

SEQ ID NO: 563304 - DNA, 150 bp, Homo sapiens
tgccaagagaggcatgtgattcgaatatctcaggccacagggactgctgcagtgcctctgatatcgacgcagatcagccgatgatgcgatgaacagtataggctggcccggagagatgtgcgcgatgaatcgcccagatggctcagcagc

SEQ ID NO: 563305 - DNA, 395 bp, Homo sapiens
gcacccatgggcctttcatacatatggtattgtcggatatatagtctatctgatatgatagcttatgagcataaagagcatgcatgatatgctggctcacagagttgttacgaatttacttctctacatggcctctaccaatcatgctctattggccttggatggatcctggcagagctccatgtagacatctgcggtcggtattgccttgaagcgcctggggctaggactccctagccattccttctgcactcctggcaggctgagtgaaataaagtactcgtgtgtttcatgctcgaggcctctcgtatagccagtccggtcaaaggcacacagtcagtgagtcaggctatgtggcacatgcaatacaccagaggtgttcctcagggtcagag

SEQ ID NO: 563306 - DNA, 189 bp, Homo sapiens; identical to SEQ ID NO: 545746

SEQ ID NO: 563307 - DNA, 120 bp, Homo sapiens
tgtatctaccatgacagtatcacatagaagttcaccgccctaaaaatctttggtgcgtctattcatacctccccctgaactccgggcaacagcgatctttttactgtctgggtaccgaga

SEQ ID NO: 563308 - DNA, 460 bp, Homo sapiens
  misc_feature (460)..(460): n is a, c, g, or t
tatcctggtctccaatgctgctgtcaaccctttctttggaaatctaatggatgtcacagaggaggtgtgggacaaggttttgagcattaatgtgacagctacagccatgatgattaaagcggtggtgccagagatggaaaagcgaggaggcggctcagtggtgattgtgggttctgtagcaggcttcactcggttcccttctctgggtccttacaatgttagcaaaacagctttgctggggtcttactaagaactttgcagcggagttggccccgaagaacattcgagtgaactgcttagcacctggactcatcaagactcgattcagcagtgtgttgtgggaggagaaagcaagagaggacttcataaaagaagccatgcaaatcagaaggctaggcaagccagaggattgtgctggcatagtttccttcttatgctctgaagacgccagttacatcan

SEQ ID NO: 563309 - DNA, 130 bp, Homo sapiens
  misc_feature (62)..(62): n is a, c, g, or t
  misc_feature (119)..(119): n is a, c, g, or t
tggttgaggcctttttttgctttcttcttcttttctttttttttctttgtctatttttctcntgtcggatttcttcttctccttcttgctctttgggttgctttgatctccaccttcanccgtccccatc

SEQ ID NO: 563310 - DNA, 171 bp, Homo sapiens
  misc_feature (93)..(93): n is a, c, g, or t
  misc_feature (139)..(139): n is a, c, g, or t
aggacgaggagcagaagccacagcagaggcctgacctggctgttgatgttctagagaggacagcagacaaggccacagtcaatggacttcctnagaaggacagagagacggacaactcggccctggctgcagggagttnccaggaggtgacgtatgctcagctggaccact

SEQ ID NO: 563311 - DNA, 411 bp, Homo sapiens
ccctcgcgatagaacactcctgtataccggcctaagaattgtcccccgtttagtcacaccaaactttctttgcacaccttatgtagatatcgatagctcagcacactcatgttgccgtgttacacattcgaagcctcagaaacacctaagcgttaacagtcacacacaatatcctccccgccggatgtattaatatcgcgcatatccgaatacgcccgcccgttctgcaaatgcataagtattcagacggattattccatgctcaacacaagtaatagctcccaagtcaccacctacacaatgtgtcctatgaggaatgtatccctaccacaaacactgcaagtaggagtacaatatgcttatcagaagcacaaggagctcgacgataacgatcaaggctttgctctgccg

SEQ ID NO: 563312 - DNA, 925 bp, Homo sapiens
  misc_feature (52)..(52): n is a, c, g, or t
  misc_feature (136)..(136): n is a, c, g, or t
  misc_feature (158)..(158): n is a, c, g, or t
  misc_feature (162)..(162): n is a, c, g, or t
  misc_feature (170)..(170): n is a, c, g, or t
  misc_feature (182)..(182): n is a, c, g, or t
  misc_feature (191)..(192): n is a, c, g, or t
  misc_feature (194)..(194): n is a, c, g, or t
  misc_feature (208)..(208): n is a, c, g, or t
  misc_feature (214)..(214): n is a, c, g, or t
  misc_feature (226)..(226): n is a, c, g, or t
  misc_feature (274)..(274): n is a, c, g, or t
  misc_feature (280)..(280): n is a, c, g, or t
  misc_feature (297)..(297): n is a, c, g, or t
  misc_feature (925)..(925): n is a, c, g, or t
tatatattgatgaatatggtcaatggtcacatctatgggttaattctttccnaatcagaaccaataattaggatagattttttgctctcttcattacattgtgaagtgtcttgtgtagtcatattctcttgttggnatgccagcttgttcaaattttntganaatttgtnggtacatatggnctccaagtnntncccctccttctgcnacagtntcattgtttttnttcatcacctcagcatgcctgcttgggtgatctgaacacatggggggnggtggngggtgggggtgattttnaatggtcactgttttcttcacatgatcctgactgatgtcttcatacatgtgctcaactgttaaaggctgccgttgctcatcatagccaaacaaccataatcgtggggtctggtaatttttatcataagtgatgttaaggtcataagttctggtttgccaaatagcatcttctccgccagcttcagttttggcttttcaagcttcttctattttccttgtttctagggtagcctcatctgtttccaacaatccactctcttcatattcttccatatctgcagcttctccttcatcttcatcttcttcctcttcacatagtgctgagcaatcttgaagccttatattgtccttattttccagtgtgatctctttaacggcttccgttattcctgtaatacctgtgttgtgatatgtatctacccatccgccatcaccatcatcttcttcaatgatagcttccaattcatctgaatattccatctgtttgcaccgcttatagcacggcacatttttggttaccaaaaaattgtttgcctgttggtaggtatgccttcactttcaattcttcccctgtagcccattgccatgttggacagtggtgggctaggtgatctccagctgccacaan

SEQ ID NO: 563313 - DNA, 603 bp, Homo sapiens
catggtggcatgagtctgtgttcccagctacttgggaggctgagacacaagaggttgcttgaacccaggaggcagaggttgtagtgagccgagatcatgccattgcactccagcctgggtgacagagcaagactccgtctcaaatgttagtctaaaaaattaatgaggcatatataaaaacacagaaacatgtatttacaaaaagttgacattttcctgaaaaaaattacagccagaaattttactgcagagttcttattctgacataatccttttccttatcattttttaagtttcctttcttttcttttcttttgaggtgtggtctcactttattggccaggctgcactgcaactccggccttatgggacccactgctttggcctctcacgcgctggcttaccggctgagccaggctcttcccttaagttgtcctaacactacctgttactccctctccctcaccgtcctcaccagagccgcgtctccctcatctcccctcgctaggcgctcgatctaccttctctctcctctcacccatctcccgcccatgcctccccattggctacacccctcgtccctcctgtcccctgcactcgccc

SEQ ID NO: 563314 - DNA, 154 bp, Homo sapiens
agaacaattcgttaaaaaaagagccttatggcttttttttgaaaatgatttgttgccaaaacgccagtgtgtgctgcaatattttggctctgactaatcatactaattactgccgcaccatcaacaccaaaaggctaagacagccgcttcaatt

SEQ ID NO: 563315 - DNA, 1224 bp, Homo sapiens
cgcggttgcctggagccctgaactgagtgctggctgtgctgggagcccgtgttggctgtctggtcttcgcgtcgtgcccctgctggatgccatgactgcttgccccctgtgctgctggtggatgaatgatagtgttgcctgatgctgtgctctgtgtgccctgccactgctgcctgccactgatgtgatgccctatgctgctgacctgctgggctgtcctgcctgatgcatgcttggccctgtgcattgtggccctggggctgcgcagcttgccctgcctgggtgcgtgggttggagctgatcagaataattgttcagcatcaaccccctggagaacctgacaggtgtacattcagcatgtctggacctcccctggttggtcttcagtgatcacgcgtaatgctgccatgtgccatagcttatcctgaccctgggctacttcttcaaaactcacggagattcaatccccagaaatggcagacggatctggaatacttttctgctacggttcaatgcatttggactatgtgtgtatcagagaatgacaccctcaagcatctcacaaacgacaaccacaactccggaaagtaccaatgaccagcgggcagtgccccgagcttccaccccagtacaccccagtgccctggaggactcgggcccggtgaatatctcatgtctcaattcacccttaacctgtgaaccactgaaacccttcggagggtatacccggacaacgtaacgtcatcatgtacctcaaaccatctatacgggcatcagaattgtgcgtttaccggcatgtgaacggccacgacggagataaacagtcaccgttacacctgacataacagacgtggcagcacgcatgcctgcgccctcaaaggaaactgtgacaaccgagtgtaatcaaagcccatgccacgcccgaacaggcagaccgtggtagagacacgaaacggaaggacgacccggaactggggatccgggacctgtatagcgaacgcagcagcctcggacctgcagcctccgaacggccaacgtgctcacgagaagtacccagcacacagccatgcggacaacggcgccgagaacagcagaacaggcagcccacacgaggacgcagagcagcgagtgcccgaagacagccgcaacgcccacaacacgacgagcagaaagaagaggagagtacagcgcaagccagcagtcgcaagaactccgctatcgccg

SEQ ID NO: 563316 - DNA, 761 bp, Homo sapiens
agcggaggacttgggaggccgaggtgggtggatcaactgaggtcgggagtttgagaccaacctgaccaacatatagaagccccatctctactaaaaatacaaaatcagccggatgtggtggctcatgcctgtaatcccagctactcaggaggctgaggcaggagaatcgcttgaactcggaaggcggaggttgcagtcagctgagatcgcgccattgcactctagcctgggcaacaggagcgagactgcgtctaaaaaaaaaaaaaaaatcctaacagacaagttcataacaacgaatgctcttggagtacatacaaggtgatctggagctcttcacatgtagaatcctatgagatgggacccggagttttaatatcacatggttacaaataaggaagactaaaaggggtaactagcctgcttaagactacagaactggggaggggcgccgggcgcaggggctcacgcctgtaatcccagaacttggggaggccgaggcgggcagatcacgaggtcaggagatcgagatcatcctggctaacacggggaaaccccgtctctactaaaaatacaaaaaattagccgggcatgggtggtgggcgccggtagtcccagctactcgggaaggctgaggcagagaaaaggcgtgaacccaggaggcggagctttgcagtgagccgagatggcgccagtggaatccaagccggggcgaaaaagagagactcgggtctcaaaaaaacgaaaacaaaaacagaactgga

SEQ ID NO: 563317 - DNA, 283 bp, Homo sapiens
cccccccccccccccccttattttccttttgtttcctggtgattaggccaaagtctgggagtaaggaaaggattaggtcctttggagccaaaaaaaaagtagcttggaactttttagatgatccccacccacctggcctccttgcttttccaatgtgttaccaaaaacccgtgggttataatgtaaaataatgtgctttttgccccaggggtaattccttttggtttgctttgttaaaactgtaaaaccccccgacccttaataaattttttttgggtagcca

SEQ ID NO: 563318 - DNA, 104 bp, Homo sapiens
gacatgtagtcctatgagcttaatttattaatgcaaactgtaccttacaaagccacagttcctaatactaggcacatctgcattaaataatttcgtgttgtgcg

SEQ ID NO: 563319 - DNA, 409 bp, Homo sapiens
cagacacgggccagaatgtgtgtgggcacatacgtagactctgagggacatctctacaccgctcccatatcgcgaacacgggcaacatctacaagcccaacaacaagggcatggcagacgagctgagcgagaagcaagtgtacgaagcgcacaccaaggagatcgacctgtgcaaccgcgacccttaacaccttaacgatgacctggtcaagaatgactttgaagatgtgaatgcagaaccacgaagggacacacaggtttgacgcgatttgggggcaggtttaccacctttactgtgacgtactgggtttaccggttggtgtgtggcctctttggcattccgatggcacttatctggggcatttactttggcattctctctttcctggacatttgggcaggtgtacct

SEQ ID NO: 563320 - DNA, 308 bp, Homo sapiens
atgacgcaggacttatgcaggaggagaatgtacagtgtacagtatactaacattagtgctatatagggtgatagataggtccaattgggtgtgaggagttaagtaatatgtttgggattttttaggtagtgggtgtttggagaagcagagggtgaacttgctgttggaggcagtcttcttgaggatctttattgcacaaccagcctgggttctcaagcaacagcctagagaatttcttattgccctgttagggaacattaactgagctcctcagagaagaacaatcctcctggagaacactctggaaa

SEQ ID NO: 563321 - DNA, 203 bp, Homo sapiens
tactcctcaccaagcatgacgtgagagactaagcctcgctgatcgccttcacaatatggaatctgcttctactccatcgtggactcagcagccttggtgctcaggtgccagatgcaaagaaagcatgtacctacatcagatctaaccttgatccagcaatgtggattcctcttctacgtgcccaggccagccaggcctctcag

SEQ ID NO: 563322 - DNA, 874 bp, Homo sapiens
ggtaggaggacgccagtcgcggggatcttctcctcgtttctggacgtgttatctgtgctcatgtccctaatgtgtctcggcttggaccgaggggctggggtgcctgtgtggatcccgcaaactgacgtgcgggtgacggtgcttgctaggcgcggtggcctagtgggctaatggaggcccgtggggcgcgacgtcagacgcgtacagctgtgatccaggtcggagcatgggaagataagtacgccgactgtgggtggtcggaggcgcatgccatggagtcgctgccccgtgtgcgcagctgatggagggccatgcttcgaagctggccatctggatgcattgtccgtccggagcccgctggtgcgaacgtctactcctggagggtcgatcgtgtctggcaccgcggcgtctgctcggtgctcgacaaagttcctggggccgccgtccgaggtggacctgcgggatcgtggaccgtgatccaggccgccaggaatgacgcagtgggtataagtcgatatctaaaccaggaaggaaggttcaaggtagcgacgcagaaattgcaggttagacatccagtgaatgagaaaaacatgactgcagcatggtatgacctttctatgacaagacaagtctcggaatccatttggaacggctgaaggacaagatcgagggggacgcactaggcgacagtggggtcagacacgggcatccgtgcattcatccttagcaggagcaactatcggtcggacacgtgatgatgagtctgggggtaagacggacaagaaaaacaaactcaaggatcagaacctacggttccaagtccaattggcgaagaccgccattccagtcatggtggtcgccggttcaagccaaa

SEQ ID NO: 563323 - DNA, 1255 bp, Homo sapiens
gcccacacccacgtcttctatctcacgcagagttttcggtttggtgtggaaatagcttatgtgggagctactatcttggcatgtttgcaagcagagtccaggcaacacaagcactttggttggaggaaaccatctagagctggccattagaggtgacgcaaaggggcaagtggccttgtctgtcccggaccaacagccaaacgtgtttgcatgaggccgtacggcgtgacggaacggggaattcccattcaagagctacattatgacttgggcgggactctaaatcactctctggatcatgggaacagacatcatatgatacttagagaatccatttcatatcaggccaggagagaaagcaacaggaaggcaaagcaaaaaaccttcgatccattacaaagaccacaaaatacatatacagcaagactgaggtagcaccaaaagaacacggcttagagcatggcatttcaaacgaagcggctacatgactgaaccccgccatgccccgaagggcaaccaggcaggcatagaaaagacccaaagaacacagacagcaggcccgaaccagacactaaccaatcaggaactgccacgagcccgaggagcaaaagcgactccgcccaacatgcccaatactgcaacactgagagaacctaagcacacaaggtacaaatccgatggggacaactgcagccaacaaaacagcacaacaacgaacccgaaaggaacaagaacaaaaagacaacacgaggaacagagagcaccaagaggaaaaccccacaaggagcaccagaaaataagagcggcaacagaaataccgacagaaaaagaaaaggacataacaccaatggaggcatgaaccgaccggtgacatgcagagacagcaaaaaacacgagaccaacaacagcgccacacacaagaaacaaaagcccagcaaacacccacagaacgcaagagcgggggagatgacggcagccaccaagaaacgaccaagaaacgatcagtacaaacaaagaaaggcaacgaacgaaggcaggcaaagagcacaaaaggcggcgaaagggaaggcgacaggaagagaagaggacaacgacagagcgggcggcaaccggcgcaccccgccccacgcaacaccggacggggccgcgggcagagagagccgcacggagcgacgtagcaggcaaaaaagagtagagagcggcgcgcgacacgcgccgagcaagacccaaagcgccaagagcaggaggacaacac

SEQ ID NO: 563324 - DNA, 359 bp, Homo sapiens
agttcgacggagactctctctcacacacagtattaagacacacccacaatgacacacataccttccaaaggcactacacttacccacaccccatccaattactcacactcacaaattcccaagccaaatacatccacacacacagacacacacatcattctcatacccatacacacacacacacacacacacacactccaaatacagccccactcttacagcacacgcacactccaaatacagccccactctcacagccccatgcagacacatccaccctctcatatatcatcatccggattcatcccatatagaccatggagatccactggatgatgatatatgagagtctccgtcga

SEQ ID NO: 563325 - DNA, 906 bp, Homo sapiens
gcatttgagcttcacacaccccttcaggcgctggccttatccgggctatggccttttaccaggcccctcgtgttcccctgtgtggacgctctccccccgtagccagcggccgctgaaatttcggatctaccacgcgcttcaataagcggcgcccccccccacggcgaggagatgggacccttttggaaacgccggtcccactgccaaagttccatatgtgctgggcaataaaacgcgcagggttgtcgcgcttggggacattcaccctcccggggtgcgtccaaagacacggcccgcgctgcgtcgctgccacgaagacaacgtcccccccgggaatttcccgggcggcttcgccctatcccccggggtgttaaaaccattggggggcccctcccctcggaaagggggccgccccgtcctccccgcgggtccacgaggcggagccccctatgcgcaggtgtccaggcgtctccccggcggccgcagtgcgcccattggtgccctcccctgagcgttgcccgccgggggctggccgtcttcttcaagcgcggtctccttgtggcgaattttgggctccttgaagttcgtggcgttttatcgcccctggcgaaaggctccgcaaacacacaccatcgtggcgtccagagccccaatcacacccggcctggcacattacaagagtctacatacgcccgcgcctaccgagaatgggcaaaggccaagagcgccatccaccctctggtaacaacccctcagggcacgggcagcacctgggtcatccccccggcaataccccgcacacatggcggaggtcgcaagccggtagaacaacaccgagcacacccgttcgaatagaccacccggccccaaatccgggaaacccgccttttccaaacaaacacgaaa

SEQ ID NO: 563326 - DNA, 239 bp, Homo sapiens
tccagtacccgagcatgcttgaatggctgtcaaggtcagacgtgtattcagctacatgcgtctgcatgcctccctggtacaagtaccgtcgacacgtgagcaaccgtgctgacctccaaatatcgttaagctggagcctggtcgacgtgtattcaccactgaggtgcatgcctccctgtacaagttccgtcgacacgtgagcaccgtgctgacctccaaatatcgttaagctggagcct

SEQ ID NO: 563327 - DNA, 328 bp, Homo sapiens
attactgagtatgtggaaggcagcagagcgggctggcgaggagcacagctcaggagctagactgcctgacttccaatcctggctctgaggctggctagctatgtgaccttgagcaaattaccctccttaaacaagagcttgcttcctggcaggggacacgcgttccagtgagaggcccgagctgacctatatgcacaccctgttacttggggagcacaaccggctggccacagagctcaagagcgtgaaccctaggtggcatggtgagaagctctaccaggaagcccggaagaacgtgggggccagaggccagatcatcacataccgt

SEQ ID NO: 563328 - DNA, 133 bp, Homo sapiens
tcagggaactatctcagttattccacgatcttataaatgctcaatatgtgttccttgttgtcccacagcagacatcaatcccatggtccactacagatccgtttgtcggatacagtagggagaggggatcctc

SEQ ID NO: 563329 - DNA, 310 bp, Homo sapiens
aatccagcagcggggtgctgtgctgttagctggtgccggacccgttgacatgcaggtcaccacagcgcgtggggtctggtctgggcggccgggctcttctacactcactgccacggggtctgatgctgctggcaggtgtgggacggccttggagacgggctgtgagctttgtgacccaggccccaagaggagagccagctgccggggagacccactcgggggctttgtgaagaccacgtcacagacttcctgcctggaggccgggtgtcccctgccagcatccgctgcctggtgtcctctgcctggcgcc

SEQ ID NO: 563330 - DNA, 1806 bp, Homo sapiens
atgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaatacgaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacagggtatgcaatgattaaaacttttaagtgaattgatagttgcaaaagaaaggataatatttaaggtcagtgagtagcaagacaatctaaagtttctgtaatatctggctctctgttaattatagagcaaagtttcccttacagaatccttttatgaacagcaagctagagtctatccctagtggttatagcacctgctgcgtttttcaggagacagttaggccagggtgatttgaatggatagatgtgctgttttgcctgcttgtagaattcagcccagtctttggtctctctctctctctccctcctccacctctccctctctcttcttctgcaccagagcctaaggctgcgccaccaagatgcgtcattttttccagaggcttctttttttttttttttgagatggagttttgctctgttgcccaggctggcatgcagtgctgcaatcttggctgactgcaacttccacctcccgtgttcacacgagtcttttgcctcagcctctggattagctgggattacaggcacgtgccaccatgcctagctaatttttgtgtttttagtagagacggggtttcaccatgttggccaggctagtctcaaactcctgaccttaagtgatctgcccgccttggcctcccaaagtgctgggattacaggcatgagtcaccgtgtcctgcccagacatatcaaatttgacaggtattgtataccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtggcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaaaaaaa

SEQ ID NO: 563331 - DNA, 236 bp, Homo sapiens
ttatgtctcttttctctcctttaatctggaaatagtttctcatcattttttctcttacagggcactaacactcaggacagttattggcagactaattcaggatggtctgggtttttcactaattagattcagctatatgcaatgtttgggaagagaaactacatgtgtcaatatactggttcttctgaaggggatcatggtcagggcggtgcaaacaggtcaattaatcctcattc

SEQ ID NO: 563332 - DNA, 195 bp, Homo sapiens
tgaggatcccccgtctatttcactgagtgggatgcgctctagttcctcgtagcggcgttccagcagcacgagctcagggtcggccccagggaggtgtttcatcaccaggttgtgatcccacatggaatgtcctgcgtgacgaaagccttcacctcctttaggcggctcagctgtcatcccccgcaggtctctacc

SEQ ID NO: 563333 - DNA, 1023 bp, Homo sapiens
  misc_feature (610)..(610): n is a, c, g, or t
  misc_feature (1021)..(1021): n is a, c, g, or t
cacccaattcactcatcaagtcagtcttcacgttatgacccaagcagaatggcatcagtccatgatactggaatagagattcctcgcggcgtgcactagggctctagttagtaccaccagcgatattgtgcctcacagcacattgtgtaacgcgggtactcactatccgaacctacatcgcaaagacatagtaccgtgctcgaatttgatgcccgcaaattctccaatacaaaatgtctcccatgcgcgtagtgtcgacataaagccccaggaagaactttgcctcagatctcataattgttcgtcgcaaggtatgcttaggaagaagcctaccggaggtgctcgcaacgatggtaagcacgtgggtgtccccaccaatttgtacaaaaaggcgtctcccagttacgggatcgtcccttggagagaagtacttggaaccttttttgtagtaacaccacgccatgtatgtctcacggccctagagggcagctacgacagaccactaacatcagagtcttccagccctattcagcgttcccagagtactgaggacgcactatggcttggacgagtactggacaccgatactcgtgggtcgtattacagatancatggaacgcattcatccaggcagctcaaaccaggtttacattggtccatttaactagaattccaacggctctgccgtatataggggtgatgtaagcagacccttaaaatgtccattggaagccgtggttcaaaaattgataatccacctctattaaatgggtcctggcaaacgcttggtattacatacctaaggggactttgaaccatctggagtgttggcacacggacttaatacttgcacaattacgccgcacgcggcaaagcaccaaattccataaccagttggcccacgaaaacatacctcacggcgttcgcaaaagtacctttccaataacccaaaacgggaatataggaccacaagacgctgtaacgtcgtgttacattgtcctcaccctctctactttccggnca

SEQ ID NO: 563334 - DNA, 391 bp, Homo sapiens
  misc_feature (14)..(14): n is a, c, g, or t
  misc_feature (191)..(191): n is a, c, g, or t
gtcactgctgtcangtgtcagtactagactatttatcctgtatgttgttgctgttgtatgtatgtattattgagacggagtttgtcttgtgccaactagagtgcatgtgtgtctcggtcactgactccactctgtgtcaagcgatcattctctgctcaagctccaagcaagtaggatacaggtgcccacancacgcctgtttatttttgtgttttagtagagatggggttcaccattttgggcaggctggttgagaactcctgaactcaagtaatacggccgctctgtctcccaaagtggctgggattacaggcgtatttcactgtgtccagcctgaggttctgtttagaaacaacagtctatgatagtataatacctctcttttttgtac

SEQ ID NO: 563335 - DNA, 640 bp, Homo sapiens
atcagaggatccccttcgaaggtgttctggtttgccttataccctacatacataatcaagaagggcttcacaaaactctcaaaactattaactgcttttctactaatgcactgcccaaattaaaatcttttcaacaaattgaaacgatgaagcactgtgttgagcagcagtataaaaatgctaagatgcattcctactgctaaatgagactggtaaataaataaataaatgaataaaaggtgtatccctgtgactaaaaggcaataaacaccaagaatttcagtaacagtgaatttgatggctcaagatgataatgtcttttcttttttgagactaagactctgccactcaggctacagtgcggtggcgtgatctcagctcactgcaacctccacctcccatgttcaagtgattctcgaactcttaagctcaagtgatctgcccacttcagcctcccaggtagctaggactacaggcgcatgctgccacgcaccggctaagttttgtatttttagtagagacggggtttcgccatgttggccaggctggtcttgaactcctgaacgcaagtgatctgtctgacttggttcccaaagtgctgggactacaggtgtgagccactgtgccaagacatttaaca

SEQ ID NO: 563336 - DNA, 345 bp, Homo sapiens
  misc_feature (7)..(7): n is a, c, g, or t
gcgcggnatcccattggataacggatggggaaggaggcattgtgagagataaggtgataaaatatatactctacaatcctttggtgataaagcaagatgggaacaagatgctaacttccaagggtattcgtgatcataacaagctaaactcaggtcccctactaggctctgctggaagacagaaccgtgatgctcagtcaatctcagtgccaagtgtcatgctgacccctgcaagtgcacacggtcccaggccctccatgacgagtgtatcaagaaggcactcagattgtgactgcaggctctgacgttcacctgcctgagctgacttaatgcctgtggcacacc

SEQ ID NO: 563337 - DNA, 100 bp, Homo sapiens
atgtgaaaacactggaacaggtgctgggcgtgactctgctggtacgcactacccgcaatctggcgctgaccgaaagcggaagtcagctttatgaagagtt

SEQ ID NO: 563338 - DNA, 492 bp, Homo sapiens
  misc_feature (11)..(11): n is a, c, g, or t
  misc_feature (73)..(73): n is a, c, g, or t
  misc_feature (76)..(76): n is a, c, g, or t
  misc_feature (96)..(96): n is a, c, g, or t
  misc_feature (103)..(103): n is a, c, g, or t
  misc_feature (109)..(109): n is a, c, g, or t
  misc_feature (137)..(137): n is a, c, g, or t
  misc_feature (167)..(167): n is a, c, g, or t
  misc_feature (173)..(173): n is a, c, g, or t
  misc_feature (178)..(178): n is a, c, g, or t
  misc_feature (197)..(197): n is a, c, g, or t
  misc_feature (204)..(204): n is a, c, g, or t
  misc_feature (221)..(221): n is a, c, g, or t
  misc_feature (225)..(225): n is a, c, g, or t
  misc_feature (228)..(228): n is a, c, g, or t
  misc_feature (244)..(244): n is a, c, g, or t
  misc_feature (246)..(246): n is a, c, g, or t
  misc_feature (255)..(255): n is a, c, g, or t
  misc_feature (287)..(287): n is a, c, g, or t
  misc_feature (417)..(417): n is a, c, g, or t
  misc_feature (470)..(470): n is a, c, g, or t
  misc_feature (472)..(472): n is a, c, g, or t
  misc_feature (476)..(476): n is a, c, g, or t
  misc_feature (478)..(478): n is a, c, g, or t
  misc_feature (486)..(486): n is a, c, g, or t
  misc_feature (488)..(488): n is a, c, g, or t
ataataatgancagaaggattacacagctcacaaaaactttccatataagacgcacgatgttaaaccacagcngangccatcccacacagttattnatgaganttcttnttagcttctaatggtaatcatttttgtntcagagtgcaattgagactaattattagtnaaggtntacanacattaaaaggtgcatagnaacattngggtggggggggggtgnaaanggngatgaaaacacaacancngggctttanttttgtgattggtgtccacatgattgcaaggngattactttctccacctgattcagcttagtgaagataagttgtcctccaaatttaaatagtatcatacagcattgtgagaaatttgattccatagaacaaaatatttccagtccttagtatgatcttggnttttcttttctacctttccaattgtccaaaattctcataaattaaaatatttntntatntntatattangngggg

SEQ ID NO: 563339 - DNA, 464 bp, Homo sapiens
ggccggtccctgcatgggaattccccccaggtttttttataatgggacacccatggcctgtgaaactttccagtacggcggctgcatgggcaacggtaacaactttgtcccaaaaaaaaagtgtttgcaaacctcccgaattgtgggggcctgcaatctccccaaagtccggggcccctgccgagcctttatccaactttgggcattttatcctgtcaaggggaagtgggtcctcttcccccacgggggctgccagggcaacgggaacaattttttctcaaaaaaaaagtccaaaaagtactccggtgtccctggtaatggttataaaaaaattttgcgcttttccaaattacaactggccggtttccaaatcaaaaaatggccagtttttttcccggggtcctttggcaggcagccccaaacaacctgggtccaaataaaaactaaattgtaaaccccttttt

SEQ ID NO: 563340 - DNA, 850 bp, Homo sapiens
ggttgtcacctcctcacatatgtgctgcagtgcggtggtgcggtgcttctggctgtgtagcgctccgtgtgcgtgtctcctggtatgaggtgtgccagtggccccactacgctcgcgcttttggccttgggagcgcgcctggttacccggcagcaggtaactgtgtgcctctgagctgttggctgtcgtggttttaggtctgtttggttttttgattttgtttttttggttggtggttaaaattttttttttttttttttgggtttctggatcctccaagtgggggcagatttatgtgggccacgcgggtgattggagaaaaaaataaataatttctcaacaagagaataaaaataaaggcccttcccaaaaccaaattgatttaaaaaacaaacccttttggcgaggatgggacgagaggatcctatggtcttggggggcccagggattctacttccgtctatgaaacggttctccgaaaagagcatcgctcgcttggttgggctggggacagctcgggctcggggttcccaacttcggggtacatcccgggtccaagtgggtgggattggacctttttttcacggttaataaacaaaggcgcgggtttggcggcccaagtgttgggtccccaacaacaatgcaactacagctacactctcactcgcagaagcatctgactgccatcacatccactatgttcgcctagccctcctactaaaccaacgcgactacttctgacatccagcacaccacgagcacccgtatctcttgcggactagttataacatcagactgtgtgcatcactgccacctgatattgtgtaatgactcctcgcgacacacacgg

SEQ ID NO: 563341 - DNA, 448 bp, Homo sapiens
gaagttactcctctgtgtcctgatggtccttgacttggccttggactgtccttgacctccaataccttagacagttgcaggtgggaacagtgtagcttgaggttctaaaatgctttgctgatggaaaaggttttgttctgaaaagtgaattacaataggaaatggatttgcattactgacactatctgctgtgggctttgcctctattgatttaaagcaaaagggcacaattagtggccttcaaagagaggggaaaaaaaaataacctaactctgtcctagcacgttcaattaacttgtttactttgaagggcacatacctcccatttttacatctacagcgtagagcaggcgttgcctagtgtcgtctgtgatggcaggatcatggctctcagacaggattatcttcggttcatagaagtaaggctactgtctaacattaagcacaa

SEQ ID NO: 563342 - DNA, 188 bp, Homo sapiens
  misc_feature (93)..(93): n is a, c, g, or t
ctgccaggcggtttagttgggtttcggccgggtttttcccgtcccgacgttgttaaacggcggcccgtggattggattttggtggcccttttntagagctttggcgttgcctgcccgggttcgttagcttgggtccttttgagcggcgcttcttcttctttggtgcggggaggcgaccgaagggggga

SEQ ID NO: 563343 - DNA, 344 bp, Homo sapiens
  misc_feature (183)..(183): n is a, c, g, or t
tttttaaaaaacccccccccccccccgtgttttaaaggggggttggccaaatcccccccccccctgtggggtttttaccccccagccataaaaaggggccccaaagggggttgaaacccccccctctttaattgccggggagattcccaaaaaaaaataattttttttttgggcttcccccanggggggggccccccggcccgggttaaaaaaaaaaatcccaaaaaggcccggggtggggttggggttgaaaacaacaagaagaagaattaagcccccctccccccccgggggggggggattttttttttttccccccaaaaaaacaggatcggccctttcca

SEQ ID NO: 563344 - DNA, 671 bp, Homo sapiens
  misc_feature (515)..(515): n is a, c, g, or t
atagcggagtaagccgcctacctggaagtacccgtatataacttgctaggaagacatgtatataactagtatacgacgagagcggcagcggcgaggtaggacctgcgagagtagtgtggtatgccctagtactagtacgtactagccggccggcccggaccctaggacaccataccagctaggcttaacaagatagtaacggagcgcaagaggacggcagcgtacggcgaaggtgacctagtacctgcatacctacaagacggccctagggggtaggcagagctacaccgtagaccgacctaatataccgagccatatagaccaagaggagaaggggaagatacacatatacgctagactataccacaggtttagcagaaatagtaaccctagccttacgcagaggaataacctagtaacccggatacagacacatttacgaaagctagtagcagagacctacacctagcgccaatacccaaacggcttactagtagccgatatatacagcccgngaaaactacagacgctagggcggaagcctagtaacgcaagaagctaggataaaggacccagggtaagcggagagacgcggcccctacccgcgtaggacataaccggccatagagcctactatagcgagtagacctactagggcttacgtacctaca

SEQ ID NO: 563345 - DNA, 453 bp, Homo sapiens
tgtattcattcatctgctgatgggcatttgggttccttctaccctttggttactatgaatagtgctgctaagaatatgggtatagatacctcttggagaccctgctttcaattcttttggatattaatagtttggatacttgtcccccaaatctcacgttgaaatttaatccccaatgttggaggtggagcttggtgggaggtgattggatcatggggaggatttctcatgaatggtttaggaccctccccttggtgctgtcctcaggagaattgtgtgtggtatctccccttgctcactctcttggtcctggtcttgccttctcaccatgtgatacactgactccccctgtgccttccaccatgactgtaagcttttgaggcctcaccagaagccaataggatgcacagcaccatgcttcctgagccaattaaacttttctttataaattaa

SEQ ID NO: 563346 - DNA, 538 bp, Homo sapiens
  misc_feature (92)..(92): n is a, c, g, or t
atgacccaccaatcacatgggcctatcataatagtaaaacccagcccatgacccctaacaggggccctctcagccctcctaatgacctccgngctagccatggttgaatttccactttccaattccataaggttcttctatattaggcctatctaaccacacacatctaacccattattaccccaagtgtagtggcgcgagtgtaacagcgagaaagcacataccagggccaccacacaccacctgtccaaaaaggccttcgatacgggataatcctatttattacctcagaaatttttttcttcgcaggatttttctgagccttttaccacgtccagcctagcccctagcccccagattaggagggcactgggccccaacaggcatcaacccgctaaagtcccctagaagtcccactcctaagacacatccgtattactcgcatcaggagtatcaaatcagctgagctcaccatagtctacatagaaaaccaggcgaaagcaaataattcaagcactgcttattacaattttactgg

SEQ ID NO: 563347 - DNA, 170 bp, Homo sapiens
cagcaacatagatgaagcgtctagctggtgcaggctgtactagacgtcgggacaggcttgcgtaactgaagaggggaggagcagctgtggcaagggcgtccaggcagagggaacagccagtgcagagcgcctgaggccagctcagtttgagagatcactgtgcccccctg

SEQ ID NO: 563348 - DNA, 815 bp, Homo sapiens
  misc_feature (11)..(11): n is a, c, g, or t
  misc_feature (87)..(88): n is a, c, g, or t
  misc_feature (136)..(136): n is a, c, g, or t
  misc_feature (161)..(161): n is a, c, g, or t
  misc_feature (207)..(207): n is a, c, g, or t
  misc_feature (286)..(286): n is a, c, g, or t
  misc_feature (296)..(296): n is a, c, g, or t
  misc_feature (323)..(323): n is a, c, g, or t
  misc_feature (347)..(347): n is a, c, g, or t
  misc_feature (363)..(364): n is a, c, g, or t
  misc_feature (367)..(367): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (455)..(455): n is a, c, g, or t
  misc_feature (463)..(463): n is a, c, g, or t
  misc_feature (725)..(725): n is a, c, g, or t
  misc_feature (732)..(732): n is a, c, g, or t
  misc_feature (737)..(737): n is a, c, g, or t
  misc_feature (742)..(743): n is a, c, g, or t
  misc_feature (745)..(745): n is a, c, g, or t
  misc_feature (753)..(753): n is a, c, g, or t
  misc_feature (762)..(762): n is a, c, g, or t
  misc_feature (766)..(766): n is a, c, g, or t
  misc_feature (768)..(768): n is a, c, g, or t
  misc_feature (772)..(772): n is a, c, g, or t
  misc_feature (774)..(774): n is a, c, g, or t
  misc_feature (776)..(776): n is a, c, g, or t
cctccccttcntcaggagtaatctgtgcggatagattggctggacttttcaatggttctgggttgcaggtgggcactgtatggctgnntatggagcgtacagccccccaggagtcagagcctcagcccggctgccntggtggaaggtacaggtgttcagcnccttcagaaaagggcataaagtggtgggggacaattctcaaaaaantaaaatgcattaaccattgctggctatttgcttacctagtaagaattggattcatttttgaccagattattcttctatncttttttgcnataaatcaaatcccacatatctacaantggtatgaagtcctgcaccccccnttgtatgtctctgtcnnttnttttcttntntntnagggtgggttacactcatttacctcccctctcccccccaaattatgacacaaacgagtatgtttcctctctagnaccctgtnatgccttcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagacccccatattatctgttctcttcgttcacaaaacagccttcacttgtttcagaatttgatggacacatactttgatganccggagnttcanatgcnntntttacacnttttgttgnaatnancctntncntttgtagaagagtttaaataaaaaaaaagagaaataaaa

SEQ ID NO: 563349 - DNA, 1677 bp, Homo sapiens
tcgggctccagccccttttgaaatttgagtctcgcaaccagcaagttcggaatcccgagataccggatcctctgcgcaaaatgttttctcccgaaggtgaaaggcgggcggcgggagccgaaggcggactcggagcgctccgccgccgccttcaggacccgcccgcaggcccgggacgcgccgatgcgggctgcagccgaggagcagccccgaggtccgaggtccgcgccgctggcgcgcggccgaggagacgctcggctgttcgctgttgctggtgttctaaactatttatcttgtgtgtgtacatttgtgggtggagtttgtgcgcctggtttttttgtttggaaaacactgcgtggtcaatgtggttatgggggggagtgatgcatttttttctagtcttaaaactaaaaacttgagtctaccatttcttggttgcactgaaaataccgcccagcctgatggtgttcccgtgctgtccctcccccttcccttctccccgcgtctacctccccaccccgttctgttccccctccctccttctccctctccctcaaatccgtgagttttggaagccccagggcctctctcccccgcccctcctggatgaggccaccatcccccaaaccggcttgttttgcagtttccccaggatcctggaagctcgctggcgctcgagggtggcggggacacgggggggtgggtgaaggttcgttaccttttctagtgcgttctatcatagttaacggttgcacacttttttaaaaaaagtaaatggatttgccacaattaaatgtcataacatttatgacagaatataaaatattaacatattttaagccaagttttaggtgtattttttgaatcttggttataaacccaattttaaagggcgatgtatccagcgttgtgaaggcaacagagtgtacccatatttatatttttataaaatacctataagactgtgaatctcttgtgctaatggctgagttaattgaaggatcgttttgcccctttttagcctcccagagcttcgaggactcaattcgaacccgaaatcctgccgtgggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaatttaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgtgtgagaagaatatattgataatgtcagtgaaacaagcagacattgaaatggaggcacagattactccacaaggagttcttctgtatattttttctagatgcaaatacctttttaattatgttaattaatgttaagactttctaggcttatatcgaagctgtgtgtgggtcacggggtgatcactgctaactggataaagtttgtgcagcacattcctgagtgtacgatattgacctgtagcccagcgtgaaaaatttataaataaatttttcattgatctttttatattaaaaaaaaaaaa

SEQ ID NO: 563350 - DNA, 141 bp, Homo sapiens
cccgagataagtcgtatactagtgacggagtaagtcggtgcactttgcctggcccagatcggccctgggtctgtctccaaaaagtgtgatgacatgccaggcacgggtgactggaaggctcaggattcagtgaactgacca

SEQ ID NO: 563351 - DNA, 722 bp, Homo sapiens
  misc_feature (258)..(258): n is a, c, g, or t
  misc_feature (363)..(363): n is a, c, g, or t
  misc_feature (383)..(383): n is a, c, g, or t
  misc_feature (398)..(398): n is a, c, g, or t
  misc_feature (430)..(430): n is a, c, g, or t
  misc_feature (438)..(438): n is a, c, g, or t
actctaccccacgaatggagggctatcattcttacttgtttgtgctgttgataatgataatacttttaggaccttaactgaaaagctgcttcgtgttgaagcctgctgcatgcactgctctttcagttgttgaggtcagcccctcagttttttctccaccttgaggcctttgaaactgtaaaagcggaagtcgttttgtgttctggatctgtaacgtgaccataccgttcaggttcatgctggcatccttggagtagntttgctaatgtgagaatttctgaggtgaggatctcagacacactgaccagaagaagcttgttaggcaatgtgtggaagtggccgaatatacttaaaaagaggtgngcagaggcaggcggatcacntgaggtcaggagttncaagaccagcctggctaacatggtgaaacccngtctctantaaaaatagaaaaattagccgggcatggtagcgtgtgcctgtaatgccagctactcggaggctgaggcatgagaatcacttgaacccgggaggcggaggttgcagtgagccgagatcacgctgcacaggaatttccaaaatacgtacttgcaaagtaatacagaaacgtgactttcggcagctacccaagatgatgcctattttcagtgttgatgtattcaggcaggaaaaggtttacttggtggaaactcctgttagaatttcattcggggtggaaaggatct

SEQ ID NO: 563352 - DNA, 251 bp, Homo sapiens
cgaatggattattcagccatgaaaaggaaagaaattctacagccgggtgcggtggctcacgcctgtaatcccagcatttgtgggaggccgaggcgggcagatcacgaggtcaggagatcaagaccattctggctaacatggtgaaaccccatctctactaaaaatacaaaaaattagccgggcgtgtggcaggcacctgtagtcccagctactcgggaggctgaggcaggagaatggcgtgaacccaggag

SEQ ID NO: 563353 - DNA, 150 bp, Homo sapiens
acagccacagtcgcatccgaacctaccgtctgattagctaggacttaaactgacttgagtcgtggcaaaagttaacaaaaaaggagaaaaaatgaacaatcgatgaggttcataggaaactaactaccaggtcactatcaaaacccgtct

SEQ ID NO: 563354 - DNA, 370 bp, Homo sapiens
tgtctcgtgtatctggttcctactgggtcatcattccgtacgacacgagaggtcaccccaggactccgtcaagttttattccggaggaccttcttgtcggggaagaagttcctcgagcggagagtcgtgcgtaccccacaagacgcctcccttgacgggaaccgaaagaggacgtccgaagaaccgacaatacctgggcgtacctcaaattaatacgaatcgtatataaaaaccgtatgatcctaaagaagggggatcctaaaccggttttctccccttcctagttttaaaccgtccgacccccttgttgagccgggggtgactacctctttttttgtttgtctaccttcatttctgctctatctttgtg

SEQ ID NO: 563355 - DNA, 406 bp, Homo sapiens
  misc_feature (193)..(193): n is a, c, g, or t
ttaagtaaaaactattaggatttttctcacagtaagagaactttttggtgagtgagacagacaaagacagtgtcaataagacaaggtctcaccaggctggccttgaacttgcagaggttcttttgcctcagggttccaaatgctaggatttatagggggacctgctgtgcccggttaagacagctggctttantcctgtaattccaaagtgccattgttccaagaaggaagacttactggttattttggatcattgatttttctaaaagatggaaaatccaacttttataaatactcttagcaaataatatggtgtttgctctatttcctacttggaatttaaggaatgttctttagaaaatatggtactttttcttttttttgaattaattaattttttttgatg

SEQ ID NO: 563356 - DNA, 935 bp, Homo sapiens
ccgaggtagctcatgcagagccaggagaagacctggaacgcactagggcaccttttcaggacacagagggctggagccaggttctgatcccgaccttgcctcctggtcacgtgtacctggcctgtcgctatgtgcaacaggacgccgccgagtcccgcattctcctccaggcacaatggctgagtgaatgccctcagagcgtgcgcggagcactgtggctgccccaatgggcacggacctcgcgtggagtaggaccgagacgagtaactactctggcgttgagcagcagaaccttgccgtgccagcgttcaaaactaacccgtgggctggttaccgtgaggactaacagtgacccctagcactgcgctgtctcgcgatgtaccaaggacacaggacaaacaagagcataacgcgaacacacagcagaaccccacaaccggacgcaccggacaatggcactccgggctcggaaacgtccccgaggagagcacacaaactctaccaagagataaaaccctgacacagccaacacgccattcaggttgacgttgggctcccccgcaataaaccttagcaattcctaacattccattggttgacccgtggctatcgaaacgtacccagagcaccgctaagattacatacaccattccaacacatgagaccaatacccaatcttggtcactttgcaatagtcatctggaaacacttcacgcctacataaagggcaacactatccattgtatgatacgccccagtggaacgcttcccgtgggacgcgacctgtacctcaattccgcttcaaactaacagcaatagtaaagtagtggccgagacaatggaagcaaggtgcacacagagcactaggcgaggagggcgttacccccctcgtcacacccatatcaaatcacggctctgggtcgaacatagggcac

SEQ ID NO: 563357 - DNA, 335 bp, Homo sapiens
ggggcccccccccccaattttttttccccattttgggtttttcccctggcccacccggttatgggaaaaacccccaaattctgggccggggccccccggtttggtttcccccccaaaaaatttccggtttttggttttggttcccccttaccaaagggccgccaaaggggttttttttttgggggtttggggaaaaaaccctttgggggtttttgggaaacccttttccccccccaccccaaaatggttccttggccaaaggcaattttggtttgaatttttgattgggaaggttttttgcggcctttttaaaaaaatttggccggaaatggtta

SEQ ID NO: 563358 - DNA, 141 bp, Homo sapiens
  misc_feature (126)..(126): n is a, c, g, or t
  misc_feature (129)..(130): n is a, c, g, or t
gcacctatagagaagagacgagatgctggtggcaggcatgaggacagcaatggttgtatcaactatgaagagttcgtgaggcttatgctgaaggggtgacgggcccactggggctggagctcagtncgnngtgcgttgctg

SEQ ID NO: 563359 - DNA, 754 bp, Homo sapiens
tatagtatgagacataactctaaccccaggaaagacttctcccattaaaatgatggttgcaggtcccttgaggtttctacaggggtgcttgtctggggaagatgcacacagacatgaaatggcagtgatacctatacagagactcccaactcacagtgacacagcagcatggacagagtgaaatgcatacagaaatagcctctcacatatttactggctcattgtttagctgaggggtttccaaagctgagactgctctttcgtcttccatttagtgaagatatcctactcccccaccaaaaaaaggaaaaataccaagatattattggattctatcttttaatttgggaaagatgcctgtggattttatttctccaaacaattcctttccatagatgtgatttctggtggtaagaagcctatcagtcttctacctcagtgatttaaaaaaaaaaaaaacaaaaatgaaaaacaattctgccagacataaatgtcctctgtttgtatttatgcggtttgctgtgcccaatcgacctttctgcccaggtttaatgatgccacttaaaaagccattcacacgtcccctctcctttcagagctttcaagctgaaattgatttccttattcaaccccccctcccacttcccactggctgccaacccatgctccttcccccaacctgattatatggaagtgctgtcactgggcagagggttttttttttttttttttttttgccacgtctattaagaag

SEQ ID NO: 563360 - DNA, 720 bp, Homo sapiens
  misc_feature (586)..(586): n is a, c, g, or t
  misc_feature (620)..(620): n is a, c, g, or t
  misc_feature (682)..(682): n is a, c, g, or t
ttctgtttttactttctagcctctttctaagatgcaatgatttgaaacagcttgctttactttcttttaatttgaaattattgtccaaaattcacatttcacaagattacattagctttccttctgtcagggagagtatacatagaaagtgtagtgatttttttcaaaggcttttctagcctactctaagtacttgattccacttagggatatgccaaggggccccgtcccattggattgagtgttagactgaagtttactagtcctcgttagtcttttgatttaatcatttatgctgctgatatgattggattaataaagcaaatctgaggaggtgatgtcagcgcagctgccaggacacttttttcctttcctctcagctacggatttctaggctagatttgaaaattccaggtgctatcatctttttgataatactgatatttttcagtgttgataatttatctcacttttgaacatctccaggtaaaatcatcagtagtatacttagacttattcatacaaataatttttttgcagttatctcatgtactttatggccttgctttaatactacataatgttntaaaggaaattcatggagctttttttggcataantgtgggatagagtcaatttcatttctcttgaacattatctagtggctttctgaagtcagggnttcgaattttcatgcattttacttggtactttttgctc

SEQ ID NO: 563361 - DNA, 130 bp, Homo sapiens
ggagtcgtgaaccgactgcatctgtgctcagcctccccagtagctgtgattacaggcgtgcgccaagacgcccagtgaagtttttctagtacagatggtgtttcaccatcgttgcccaggctgtcttgaa

SEQ ID NO: 563362 - DNA, 253 bp, Homo sapiens
tagcgctggaacaacacatacactcagagatggcagacagcagcaggactacgggctgatagatgtaagagcccagaacgatctcttcagccacatcagcgcaatgacgtgggtcctgctgaacctcaactgtgacgggctattaccagggtgaactacgacgaacgagaactgggcggaagattcagactcacgctgcagacgagaccactcggcccatcccggctcatcaactcgggcacagactcattaa

SEQ ID NO: 563363 - DNA, 230 bp, Homo sapiens
ccctgagataaggcttccgcgcccagcttgccgcctacggtgaaaagacaaccctgctcgtcgacacctacgacatcgacaatgcggtacgcacggccatccgcctcaccgagggacgcctcggtgcgtgtccgtatcgactccggcgacctatccatcgtcgctcgtcaagtccgcgacttgctcgacgacctcggcgccccgaacactcgcgtcatcgtcactagcga

SEQ ID NO: 563364 - DNA, 921 bp, Homo sapiens
  misc_feature (19)..(19): n is a, c, g, or t
  misc_feature (75)..(76): n is a, c, g, or t
  misc_feature (94)..(94): n is a, c, g, or t
  misc_feature (97)..(97): n is a, c, g, or t
  misc_feature (112)..(112): n is a, c, g, or t
  misc_feature (126)..(126): n is a, c, g, or t
  misc_feature (128)..(128): n is a, c, g, or t
  misc_feature (145)..(145): n is a, c, g, or t
  misc_feature (157)..(157): n is a, c, g, or t
  misc_feature (159)..(159): n is a, c, g, or t
  misc_feature (162)..(162): n is a, c, g, or t
  misc_feature (172)..(172): n is a, c, g, or t
  misc_feature (174)..(174): n is a, c, g, or t
  misc_feature (186)..(186): n is a, c, g, or t
  misc_feature (192)..(192): n is a, c, g, or t
  misc_feature (194)..(194): n is a, c, g, or t
  misc_feature (198)..(198): n is a, c, g, or t
  misc_feature (200)..(201): n is a, c, g, or t
  misc_feature (209)..(210): n is a, c, g, or t
  misc_feature (215)..(215): n is a, c, g, or t
  misc_feature (218)..(218): n is a, c, g, or t
  misc_feature (226)..(226): n is a, c, g, or t
  misc_feature (228)..(228): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (263)..(263): n is a, c, g, or t
  misc_feature (285)..(285): n is a, c, g, or t
  misc_feature (297)..(297): n is a, c, g, or t
  misc_feature (299)..(299): n is a, c, g, or t
  misc_feature (328)..(328): n is a, c, g, or t
  misc_feature (330)..(330): n is a, c, g, or t
  misc_feature (338)..(339): n is a, c, g, or t
  misc_feature (344)..(345): n is a, c, g, or t
  misc_feature (362)..(362): n is a, c, g, or t
  misc_feature (371)..(371): n is a, c, g, or t
  misc_feature (396)..(396): n is a, c, g, or t
  misc_feature (398)..(398): n is a, c, g, or t
  misc_feature (405)..(406): n is a, c, g, or t
  misc_feature (419)..(419): n is a, c, g, or t
  misc_feature (422)..(422): n is a, c, g, or t
  misc_feature (475)..(475): n is a, c, g, or t
  misc_feature (841)..(841): n is a, c, g, or t
  misc_feature (847)..(847): n is a, c, g, or t
  misc_feature (850)..(850): n is a, c, g, or t
  misc_feature (852)..(852): n is a, c, g, or t
  misc_feature (882)..(882): n is a, c, g, or t
cgccccggggagctcggancgcgtgcacgcgtggcagacggagaaggccagtgcccagcttgaaggttctgtcannttttgcagtggtccaaanaanaaaaaaatggaaaangggaggcatgaaananatcttttcgttgttgtnctttcttttgcnanaangaggcaaaananagcaagtaaaanattcananacananngcatgtannaaaanaanaagtacanantgggtganananggcatccttacctggaaccttangggttggtttactgcgtgaacngcatctgctcananaatgggaatgtgctttgcagccgagtcanangtccaaannttcanngcctttctcctgtgcanattcctcanctgtgctgccctcgctgcccagaanantccttanncccagtgaacaanaangtgaccagcaagtcttgcgagtacaatgggacaacttaccaacatggagagcngttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggtggaaggtctgtcccgctttcctggggccagaagtcaccggggagctcttatggattccagcaagcatcaggaacattgtgcaattgtcanaataanaananaacatggacaagtgtgtgtttcaatggaanactatctcatgcgagtctggcaccaaactccggcatttg

SEQ ID NO: 563365 - DNA, 364 bp, Homo sapiens
aaactaattacccactcatttatcgacctccccaccccatccaacatctccggatgatgaaactcccgctcactcctcggcgcctgcctgatcctcccaatcaccacaggactattcctagccatgcactactcaccatacgcctcaaccgccttttcatcaatcgcccatatcactcgagacgtgacttatggctgactcatgcgctaccttcacgccactggcgcctcaatatccctaatctgcctcacgctacacatctcacgaggcctatattacggatcaatcctctactcccccgggcatcgggcttatccgactgcttgccactatagtcacagctatcattggcttcgtctcctgg

SEQ ID NO: 563366 - DNA, 290 bp, Homo sapiens
accttcttttgaatcctacctctgcctcttactagccacatgacttgggtcttagcatgctcatctattgaatcggcggacacttaatgctgaccccacatttgtgctgaggattatgcaaataaaatctgtaatttgtgcaagcatccaccaggtgcctggtcagacttggatgctcaattaaggcctttgggtgggccatgtattgaattggattctcacaattatggccattatttagggtcctggtgtcctaatctatgtactgaggacatccttgcttgttttca

SEQ ID NO: 563367 - DNA, 352 bp, Homo sapiens
tcacctaaatagaacttctggcataatttccattacgactggatagtctttcttgcatatcactaatggagttggaataaagagacgtttgcctatccctgttaatgatggttgtgttgaagaatcttcctcggtcacgttcgtgttcagatctcttatgttataattagatcagagactggtagcatcgtaacactctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtca

SEQ ID NO: 563368 - DNA, 568 bp, Homo sapiens
cttgagcatcatctcatcccgtatcttaaaatgcgttatctgtttgcaaactgctgatttcttttggagaatcatccccataaacttctcataaagcatcaatgattttaccattcttccacccaagcttcacactaaatttgatgtttggttttgcttcaattttagtagaatttatgttgctctgacaggtgctcttttcaaacttacgtcttacctttttagtgcctcaaactacatcctgttcaggcatgttataacaagttagtatgagcttattttggtataaaaaaatttggactccataattttttcataatatgcatttttcattaccttttggaagacaactcatatcaccttgagcttcttttcatatgcctattttccatatgtatatcttctttggtgaggtgtccttttcagatgtttgtacatttaaaaatcagttattacccactcccaccacttctattcaacatagtactggaagtattatcaagagagagcaattagacaagaaaaagaaattaaagatatctaaattggaaaggaagaagtacaatga

SEQ ID NO: 563369 - DNA, 145 bp, Homo sapiens
tccagtttgagatagcatgggcacgtagcgcgactccatctctacaatacataaaaattatgctgggcatggtggcgcatgccgtagtcccagctacttgggaggctgaggcaggagaaccgcttgagcgggagagcggcggttg

SEQ ID NO: 563370 - DNA, 287 bp, Homo sapiens
ccctttaggggaatgactctgacttttagacggtgtccacccagtgtgtcaggtgctgcaaagcgtttttggaaaaggcccccttaggcaggtttgtgccctttttcggccagcctgactagacccccccctgaggtcctgcctttttcagtcggggtgtaatcccgttccagggccccaagcccagctctttgttcagttgacttactgttttttcccctaaaaagtaattgtaaatggaaatccgttgtgtttggccggagaatccataaaaatttttttttcca

SEQ ID NO: 563371 - DNA, 368 bp, Homo sapiens
cgggcgagctgtgtgccgccgctacttccgaaaccatcatgcaggtggccgccacgcatttccccatgacagagtgggccgtggcagacatgcttggctgcatcatccactccgagttctatcgcgccaaggtgcaggcacgctgcccgggcccggtgcacaagctgtcgttggcctatccggcgccggacgtgaggcaggacctgcggtcggcggtggatgatcacagccgcctgcggaccagcgcgtgggtgtggtcaatccgaacaagtgcgttgacaaggtcgtgcgcgcgttgatgcgtgaccccgggctggccgcacgcaccgagtaccgcgtactcggcggtgtcagcgagcaggagcgca

SEQ ID NO: 563372 - DNA, 122 bp, Homo sapiens
aacatagccccaatatagtaagatctatactaataatcctagatgaaatgttatagatgctatatgatacaagtggtggccatgagtgaggaaaggagctcacgcccagagagccggaattc

SEQ ID NO: 563373 - DNA, 938 bp, Homo sapiens
atgatttctgtctgctctgagcggacgttaaaatgggcccccggtcccccgaccgcaccctccttcctcagggcacttactaagggaggggtctccctctcaccatctccccagtggcctgcccgctccaaccgctgcctgcgggctcccccccgtcgctcaccccggacgtgctccgggccactgagacacaagacctattgatgttctagcgcctgggagaaaggagatcggactggtgtgttcccaggtggggcgccaggatggctcctgggcgatgctcctgccgccttccttcactggcacttacaaccggtcgggagccccagggaactacccctcaggaccgctcaagcattcgccgagcttggtccattcatagacacccttacagtttggcccgaggtcaaattacggttgctggtaatggggtactcacatccccgcagagccgcagggtcagtccgccaaattgttggacaaggcactgtcagaacgaaccgtggtaatagcgtgcgtgtacacatcctctatgaaaagggacgcactgttagtatgcgtatgataggagtactagctatactagtgagagatcaacactatgagtcaggcaccccacccaagcagggcagaagaggcacaacacgaccggtgggtggagtccgcaaccaaaggaagatcaccgaacgtcaacgcaggaaaaaccgcgagggcgtattcctacaggaggagtgcgcacgcgacaatgagaggggacaagcacactcatgataatgtcgcccgaaaccttccgaaatgctgcaccgacaggacgcagaaaaaagacccaaagtaagagacaaggaacagagaggggcttcacccggaagagagacaagggcacacgagacacagcacaatccggggccggggcgcgcgtaacaaagatagccgtgcgg

SEQ ID NO: 563374 - DNA, 636 bp, Homo sapiens
ccattgttggccgcatgtgtcggtgatgtactagggaggcctcggtggacatcaggcgcaggaaggtcagctggatgtgccacatctggcagggtcggagccctggcctgccatactcgaactgggaatccatctggtcatgctctcgcccgaaccatgacatgcctacttgtccctatggggttctaagctagatgtaccacgttcttcttgggccacactgtggcttgagtgtgggtacacgcagggttctcaccgagtctccatgtttgcagaacgactttgagtggcatccagtgtttgcagcctttggttggggtcaatccaagtactctccacttcttccagtcaggagtggcacatcttagaggtcacggcaggtcgcgggcggggttcttgcggctgccctctgggccccggatgtactcgatctgctgactcaggcccttgagggtggtgtccacctcgaggtcacggtcacgaaccacattggcatcgtcagcccggtagtagcgggcaccatcgtgagccttctcttgaggtgcctggggcaggaagctgaagtcgaaaccagcgctggaggaccagggggacccggaggtcctggagggccggtggaccaacaggaccggatca

SEQ ID NO: 563375 - DNA, 413 bp, Homo sapiens
  misc_feature (27)..(27): n is a, c, g, or t
  misc_feature (352)..(352): n is a, c, g, or t
tcaagaggatccctcagcacattagtnggagtcggggggaggtcaggaatatgatcagataagggatttataccttagagcaaaatctataagtctctctcagttaatcaatttaaatgggcttaaggctaataggggggtgtaaactttaagaaatataattctcccattcaagtttacagcaaacatctagccaccttcaaaacaaagaagatacagaccatcatttagcaatactaatacatgattttcctgggggatggcaggttggagaatcctttagcaacaggacatacttcccctaaattacagtgaattatttataacgagataaagctttcaggtacaagcngaaggtggggtgtctaacaactaaaaactatcactaaaggtgctgaagggtaccgagctcg

SEQ ID NO: 563376 - DNA, 975 bp, Homo sapiens
  misc_feature (371)..(371): n is a, c, g, or t
  misc_feature (453)..(453): n is a, c, g, or t
  misc_feature (479)..(479): n is a, c, g, or t
  misc_feature (490)..(490): n is a, c, g, or t
  misc_feature (536)..(536): n is a, c, g, or t
gcgatcgagggtaccgagggaggaagtgtaactaggatatctagttccggtcggtaaacaggcaggaatatgatcagataagggatttataccttagagcaaaatctataagtctctctcagttaatcaatttaaatgggcttaaggctaataggggggtgtaaactttaagaaatataattctcccattcaagtttacagcaaacatctagccaccttcaaaacaaagaagatacagaccatcatttagcaatactaatacatgattttcctgggggatggcaggttggagaatcctttagcaacaggacatacttcccctaaattacagtgaattatttataacgagataaagctttcaggtacaagcngaaggtggggtgtctaacaactaaaaactatcactaaatctcaaagagaaagttcttgcaaaatatgtacagttcacaaggngcagacatttcccttctttaggcttntatctaaggangggctatgaaactgggcccatctgtatacaggctcaaatttacgtnttctaacacggaacgaatctatgcagctgaggcttattggcaggaaatacttcattcggtatgtacaatatcatggtcaccataacataggaggctgtatatcatcttgaagtggtatgatctgccatgacaataagaagtctctaggaatctggatataaacgaattaaatgttatcctagaacattagtcggtccacgcccgcgcaacttcgcacctcacacttatcacaattcctctaccccagggtaaacattagttcctcttcaatggtacaacttggcgaaccctggaacaaccctaacctttcaacattgtaagaagcacaacggagaatggtctcggagcaacatctacgtgccccctgggaattctcctaaatggcctggggcatttcaacggaattcccatttcaattataacacaggattgggttccc

SEQ ID NO: 563377 - DNA, 338 bp, Homo sapiens
  misc_feature (22)..(23): n is a, c, g, or t
  misc_feature (136)..(136): n is a, c, g, or t
aggtacaggtcttgctctaccnnacttctcaaatttgtgaacttcagttttctttttaacaccttaaaaacgtggtaggtgggcaaggggctcctgcctataatcccagtgctttgagaagccaaggcaggagaanttttccttgagcccaggagttgagatgcagtgagctctgattttgtgccactgttcaacctgggcaacagaatgagacccggtctcaaagagaaaaaaaaaaatgggatggtcacagggcttatgcttcatgtagtagttacttttttgttgggggagatgcgagtctcttggtggccgggttgattggcagggagccgata

SEQ ID NO: 563378 - DNA, 1377 bp, Homo sapiens
ggggcatacaaggtttagtcgagggctgaggaagaaatatggagagcaagaggatgattgagactcccatatcagagatggggcttagctggaatgggtgtaggtgcaggtatggctgggttagcgaggccattcgtgaatgtatgaccttcagctctgtccatagcgagccattagaccaggttaataagctcagcggccaagaccatagtaccatggtcgtaggtggccattcagaccgtgtgaccgtattagttctgcaggggggccctaagtggatgcctctagacatggtgtagtctgcctcagcgacatcgagcagtgcgttggcatgcactggtatgggcgatagcacccaggcgttcaagagcgtggtctagtcgccttggcaattctagcaggtatgctgaacaggcacatctacattcaaaatcgagccaattccgggcataactagatccagtgggtggtgcatcagcagaattgaatttgatggctatcgggggtatccgtatcttgaagttatcctaccgggaagcgtcgagtcgacaaggatctttcatggatatccttcattggggacaaagtccaaaagtgatgaaaggcgaaggaaagacgattatatactggtgggtaattcgcgcatctcaatgaccgtgatggggcctagtggcttcagaagactggcatgcagagcgtatcataaaagcacggaggttgaactgttgagggtggataacatcatgcggtacacatgaggacgagaatgggaccatgggcaaaacccatagaaggccagtggtcagtgaaagacaacatcaagcacaggaaccaggaggggaaacggagggactggacaacacaggaaggagacagaaaggaagctggaatgtcatgtagccacggactacaagcgaagggccaaggacgtcagaaaacgcgggaaagtggccaccagaacaggcaccggcgggtaacagacgaggcggaaagtgtccacaaaaggcacacaaaggcaacgacattgctacaaagggccaaaacttgatagcgcctaggtgcacaaaggaaccatcattattttgggcacaaacagagaagaaacactaataatagatatagatgggacacttgaaacacaaacgatgagaaagacatcatctgggacgcaaatagtagacaacagaccgtagaaaggtattgcggaaccaagtgagttaatatcgagcgaataactttatgaagagagatgtattgtaacgcgaaaccaataatggtgagattatacaagacatgcagcaatagaaataagagctgactgaagagggaggatggataacaatacatatccaacaagggagtggtctagaacaataa

SEQ ID NO: 563379 - DNA, 256 bp, Homo sapiens
  misc_feature (32)..(34): n is a, c, g, or t
  misc_feature (38)..(38): n is a, c, g, or t
  misc_feature (54)..(54): n is a, c, g, or t
  misc_feature (69)..(69): n is a, c, g, or t
  misc_feature (116)..(116): n is a, c, g, or t
  misc_feature (162)..(162): n is a, c, g, or t
  misc_feature (180)..(180): n is a, c, g, or t
tgttggtgctctactgtctgcaagcactagtnnnctancaagcactagtgtctnccaagcactagtgtnctgccaagcactagtgtcctgccaagcactagtgtcctgccaagcantagtgtcctgccaagcactagtgtcctgccaagcactagtgtcctnccaagcactagtgtcctnccaagcactagtgtcctaccaagcactagtgtcctaccaagcactagtgtcctaccaagcactagtgtcctgccaa

SEQ ID NO: 563380 - DNA, 1159 bp, Homo sapiens
cagggctctaccctcacttcctggaaagatctagatggttattgctgtttgagactgtctcagtgggataagttgaaattcaagtgtttgaactgctgataatttggatttgttttttttgttggtttaaccttgggacacatgtgatcatagtctaagacccgggtggggagaattatccccacgatgggtcatcagtggaaagacatcaactgtggcaactggtgccctccaaagcatatcctatactatcgtgtctccacatctgataccagaaggtgcagccagtgcagacggtatattccagcgtctggatcaccgcgatatcctttcaccaaagtggctccataacgtggaagatctcactttccccttggtggggtaggaaccgactgcccagatcggcgcagggagtgtgcccccgggagccattacacgacacgggtaaatattatatattattattataaaagaacagtggccgatacgagtgaggggcgcggggacaagtgccaccaaccacaggtcgcataaacagaacaaaagaagtgcccactctaacaccccgtggacaggtggccaaaagcgtgggcccacaaataaaagagagaccccaataatggctgtagcaacagagccgggagcaagacagagagacgaggcaccgactcaagcagacccaacacgccaacgggggagacacatagtgcgacaacagaacacagcgagcgacccccaaatctacacccgtcgtgacgcccaattactttgggcggccgagaaacgacaccacgggtacggagaaagcaagagaaaaaaagcacacagcgacagcaaaatcctcgcgggagcgccaccaacatagtaaggggcgagattacaacagcatgtatattcacaaacacagtggaaaccaccaatagcgagaaacaacacagaaacacgcaaaaatgagaaacacaccacacaagacagaacaacaagaacaataaccgagaaaccaaagaaacaagagcgaccgggcgcaggacccagcgcacgaagaagcagcccgtccctgcgcgagggcacgcccccgatgatccgacacacccaactaagcagcaacataaatcgtacaaccacacatccaaacagtatgaagaaagaatcatgacac

SEQ ID NO: 563381 - DNA, 196 bp, Homo sapiens
tagggaagaacatacaaaacagagtaggtaaaatgaggataggagaagatcatcctgaacaaaattagataaatggtttatataagattgtacatcatggaggaaatgcaaacaagctcaaagctactataatctatactaatctaggtcctgtgcctaatggcaaaagctagtaatatccaaaaggtgagagcaa

SEQ ID NO: 563382 - DNA, 390 bp, Homo sapiens
caccctcattgcccaataactttctaaaggccttatacttcttaatactgttgcataggggattaagtttcaacatgaattttggagaggctacacacactcaaaccatagcccatattgtgactagagtttagactacaactgcctttacatttacaataattgtcgactaaatgtagttaaagaactactcatgtctttcctagatcgtatatagagggttgttttgaaaaccctcggaacacaatctttattagctttctttgctacagtagtaccaaagcagttcatttaaattagacggcagtctaatatacatagagtattatatacgaattagatttcacttagagattttaaaacagtggataggaatctaagtggcttatc

SEQ ID NO: 563383 - DNA, 111 bp, Homo sapiens
ttcgattggcgggcaacttattctgtcctccaggctggagtgcaatgacatggtcattgcgtcactgcagcctccacctcccgggctccagcgattctcctgcctccctgc

SEQ ID NO: 563384 - DNA, 398 bp, Homo sapiens
ggcactaggcagatcctctcatattatagcaaggttttagaagaccctccaaaaagtaaggtatgtaactcagctgcatagtattagataaagctatactctgctactgtacttaatttgatacttttttgtttttggaaatggagtctcactctgtcgtccaaacgggagggcaggggcacgatctgggctcacggcaacctccgcctcccgtgttcaagcaattctcctgcatcagcctctcaagtagctgggactacaggcacgtgccatcccgccgggttaattttttttttaaatttttaagtaaagacagggtttctccatgtggaggcgggtctggaactcctgacctcaggtgatccgcccacctgggcctccaaaagggcgggaataat

SEQ ID NO: 563385 - DNA, 850 bp, Homo sapiens
gtgcttggctggcagattccactacggcactgcgtatggaggcagtaaatgtgaaggatgtgtgtgagtgacctcgtccaggccatggttataactacttggggaaatgactatgttacatcctggcatcacagtgtgagcccttagaagcatacatctattttgtgccccgtgtactatcagaagcttgaaacacatggtgctagataaaatgcatgccctgggccctggtggacccacagagcctgtaccttaccagtgcaaacacactgaagtgactggtctctgatgatggtggcatatgctgtctcgagggaaattggaactgtgacttgtataatctggtatatggatgccatgatatgcttatatgcataagaatgaagaaactaaattgaatatatcaaaggttgaaattgcctataagagaggttcgattgtaatatgagtgacaagatgttgagaactatcaatggaggttatatctgagacatgtattggccaataacttgacaatgtacatcattgacaaaaatagtcatacactaccagaatacctgtatgactgcaaaaatgaatcataacatggaaactacaagatctatgaacattcaatacaaccaagtgtgaaaactgtttccaagttaacaaagtgacatgaagggagatggaaaaaaaatgactcattaacgcaaaaacaaggtgagtacattacacaagcaaagggtaaaagcaaaaagggaatctaggaacacgaaccaaccaaggagaataatacccatgacgaatacaaccgcataaaaccacaacaaaatagaagggtaaaaatatcagaatttatacaaactga

SEQ ID NO: 563386 - DNA, 212 bp, Homo sapiens
tctaatgtagacattagaccagccaattcccagccccagcgtttgtgacactgctaatacgtgtccaatttacttctaagggcatcacagaattctccaataaagttaattcaatattcagatactcatttcataaataatcctcgtgtggcataagtgctcccccgagaaggggagtgttacaaacgtttgagcgggaaaagaccctggga

SEQ ID NO: 563387 - DNA, 306 bp, Homo sapiens
ctttctggaacaggggggctaggaccgtgtagtaacaccattgtcatttatcaatcacctcgaggcgggcgcaattaatcacctccttttatccagtctcaacctcacacccacttcatgcccacgaagttctcttatcatccccatgttacagattgggaaaacaaatcaaagagcttaagtaaaactggtctaaaagacttgagtcaggcctatggctccagacaaatggtgcagcttcagagagtggaagttccagtcccagtgcccagccaactgcctctctcgtggacaaatcggttcttt

SEQ ID NO: 563388 - DNA, 418 bp, Homo sapiens
  misc_feature (8)..(8): n is a, c, g, or t
  misc_feature (70)..(70): n is a, c, g, or t
  misc_feature (98)..(99): n is a, c, g, or t
  misc_feature (142)..(142): n is a, c, g, or t
  misc_feature (305)..(305): n is a, c, g, or t
  misc_feature (343)..(343): n is a, c, g, or t
acccacgnaggattcctctagattccattctttgggctggagttgaatcaggtcatcccgggggggactngggcgcaatggaagcactgaattgaccnnggacaactaaagatcgaggaggaaggaaagagagactcagggntctgggaagcctgtcaacagagcaccccatgcagaaagggctgcaggctgtctttgtgttggaaccagggaagaagggatttggggaaagaatcaccctctccttgcctcagtagactctgtgacttcctgaggacacagagcagagctgcgaggagggcggncaggtcttcaaacttgctggccgcactccactcttggngggtggtaccctgactctgacagccaaggatagacaggggagccggccttttccatgctccccttgggcccccca

SEQ ID NO: 563389 - DNA, 465 bp, Homo sapiens
  misc_feature (213)..(213): n is a, c, g, or t
ggaatagatgttaagaacttagggggtgatgtccaagggaggtcagtgataccaggacacgacaccatttgcagcacaggagttcagacagcaccggccctggattcacacagaggaactttctcccaaaagaaccaatcaacttctaactgttgtggttatttgcataactcaaatgagaagcgagggccttttggtttaacttctgtgtcntatgaggtctggaatgagtcatatgaacactggaattgtggaattggagaagagaatgaggacccacacactatgataaaagttaaaaagcaagtcaaagagttccttctcttgtactcatatctgcaccacgtctagaacaacttcccttcccaagagaattaaaatacattttttgtttttccctgcaatactctgtagtactactgttctggaatttcagttctcatgcaacataccggtcccgattga

SEQ ID NO: 563390 - DNA, 833 bp, Homo sapiens
gcctttaggtacactgcctaccttactggtcgcgtgcaagtccaccctggggagaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaacagatgtgggaaatccttcactgtttcttcaagcctgactgaggcacgcaagaattccataccggagagaaaaccctaacgaatgtaagcagtgtggcaagccttcacagggcgctcaggcctcactaaacacatgcgggaccctcaccggggagaagcctatgaatgtaaggcacgggggaagccctacataaggttacttactgaattgagcctgtgaaaatccccggaggggaacctacatgtcggagcagaaac

SEQ ID NO: 563391 - DNA, 125 bp, Homo sapiens
ggtcggtacctgggaggcaggacactggacagcagatcaggagacaaatgagactacaggctgacgttccgggcaaatgccaggcccgcaccgaccacggggccgacattgtctcccgcctccca

SEQ ID NO: 563392 - DNA, 374 bp, Homo sapiens
  misc_feature (188)..(188): n is a, c, g, or t
  misc_feature (338)..(338): n is a, c, g, or t
cacgaggcacgccctcggtctgtgcggtctgctgcatcttgaggccgtgctcgtcggtgcccgtcaggaatcgcacgtcgtagccgtcgaggcgcttgaagcgcgcgatggtgtcggtggcgatgtactcgtaggcgtgtccgatgtgcggagcgccgttggggtacgcgatcgccgtggtgacgtanaagggtggccgtgaggcatcagctggcgcagtcatggtgcgcctactctaactagcgtgagcagagaccgtcccgcaccaccgttgcccgagcccgtcggcactctcgtcgacgcgcacacccacctcgatgcgtgtggggcgaccgacncgggagtgtggccgcgatcgtggacaaggccgagtc

SEQ ID NO: 563393 - DNA, 199 bp, Homo sapiens
  misc_feature (29)..(29): n is a, c, g, or t
  misc_feature (69)..(69): n is a, c, g, or t
  misc_feature (101)..(101): n is a, c, g, or t
  misc_feature (125)..(125): n is a, c, g, or t
ttgtgaaattgatatatcaattgtttatntttttaccataggaaaattagagttttgtatacatatttnatgattacagtaaacaggttaaaatttagcanatagaattttgtaagcttttttanaatgtgtgaattctgttataagggggtggctttgctacaatttattacaaagcttagttatatttcattactta

SEQ ID NO: 563394 - DNA, 401 bp, Homo sapiens
tgagatccccctcgaattggaactgaatgggatgatttactttcgaagctgaggcatgctgctgaagaagtctggttgcagggaccacggattgaatcggaagagatgcaaccctcattggatctggttctgagaagtacacacctggcatcggatgacctttataaattatctatgaaaatgccaaaagctctcaagccaaagaagaagaaaaatatttcccatgatacttttggcacaacttatggaaggattcatatgcagaagcaagacctaagcaaactacaaaccaggaaaatgaaggtgccgaacaagcgacctgccgaaaggataacagaagaccacgagaaaaagtcaaaaagaattaaaaaaaattgatggaacttagccagccactactg

SEQ ID NO: 563395 - DNA, 260 bp, Homo sapiens
gctaactgagacgtgtgatgtatgttgactgtgtgtgagtgtgtgtatggacataagtgctgtatgtgactgggcaggctggctcgggcctgtaattccagcactttgggaggccgaggcaggcagatcatttgaggtcaggagctccagacatgcctggccagcatggtgaaaccccgtctctactaaaaatacaaaaaaaattagctgggcgtggtgccactcacctgtagtcccatctactggggaggctggggcag

SEQ ID NO: 563396 - DNA, 107 bp, Homo sapiens
ataaaatgggtgcatgatctatcacgtgtgacagcaggcctttgcctcgtggccagtaaagcccttcctggtcgctctccttcgattccattttacctcctcttctg

SEQ ID NO: 563397 - DNA, 105 bp, Homo sapiens
gtatgttcagccttatgtaattctagttattctgtgtatggagtggtgtctcactatggttttcatttacaactccctaatgactaatgatgtagagcatcttct

SEQ ID NO: 563398 - DNA, 125 bp, Homo sapiens
ccatagtgctgcatctgggtggagcgaccactcccctcacataccacaggcccatggactcactatagtaacaaactcctaccaacactgaccaataaaaaacgatgtgggcttttatttttttt

SEQ ID NO: 563399 - DNA, 183 bp, Homo sapiens
ttatactaagaaaatagaaatggagaaaataacttaagcttcaactttaagaagctagaaaagagtaaaccaagtgtgaattagaaggaaataatgaagacgaagaaatcaatgcaattgaaaatataaaggaaaaaaaaatcagtgtaacccaaagcacataatggggtatcctagggtacc

SEQ ID NO: 563400 - DNA, 651 bp, Homo sapiens
agacatcactttcagtctgttagaaataaagatagtttactttcttctctcaagtacagattgtagtatagttcagttcattaacaggtttgacgtgctatacattgaatagactgatttcatctgctgatttagcatatctattacatgcctactaagtgttaggcactactctagaagatgtgactatatcagagaatcagacagccacggagagactcaactctatagatgagccaggatcaatgatcacatggtgacaagtcctatgctgagaattgccctgtatgatgtcatcaacagtgactgggtatctagattgtacggtcagagatggcctatctagaatgatggcatctagcctcggttctgactagcaaggaggagccagccatgcccagagtggtagaagcacactccagtgtaccagtggggccacatatggatgtaagcattaatgcgaacttgatgtgttggagacccagaacacgtgtgaaactgcagcatagtagggtagcagatagacagtctcaagtggtcttagagaggcatcctcaactccgtcatgaagagctgggtgtgatggttcacgcctacaatcctagcactttcggaagccaaggtaggcggatagcgtcagtctgggagtac

SEQ ID NO: 563401 - DNA, 903 bp, Homo sapiens
aaagaggagctggagttacagaaatgattgtctctggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaaattttaaataaacttctggtaaattaccaaaaaaaaaaaaaaaaaaaaaggccaaagccatttaacgttgcactacccagatcacttgggagccaaaaggggtttacttctgaatggggtgtccgtattgttgcccacattaggattgagtgggttgggggccctccttttattagaaattgttgttggttctttccccctagctgtctcttgctggtctggtcttcctggttatcgcccctttcattttaaaatcatgaatcagtggtaagtgggtaaatgggtagtagttcatcttttccccatcacctttgatggtctcttatgtagggaataatagcttttcaaaatattccgtggggtaaagaactttactctgaaacttaagccttagaaattattcggcggtatgatagaatgaggctgggggtcatagctttctggccttgacatgggaattaactgaacaaaatccgagttgtaaagtcacttcctgattggctataaccgggcccagtcatctacattctcctcccgatgcaaaattgcttcaggcagcgaccaagtgactattttggcatcccctttttcactctcgtctcccacttattctcccgcaacagcgtccaccttttagccgtcacccaggaaccgtttccacaatactcccacgcactgtaccac

SEQ ID NO: 563402 - DNA, 340 bp, Homo sapiens
tgatttgcacactaccgcctctaactcctggcactcgaagattatcctcctgcctcttagcctcctgcgtcgcttggactgcagctgaataccacctctcccagctgcctagtgcgttttaatcactatttttgccctctgtgtctgaaggtccactgttttagaacgtatatataaagcactagttcatccttactcttcacttattcaaagcagctaaatcttatctttggcacctgcgcatatatcctgtgaaattacataatggctgtaatcagagaataaagatgacgctacattggatatgtcttcattaagatctattcaccgtgtccatgct

SEQ ID NO: 563403 - DNA, 398 bp, Homo sapiens
tggggaggatcatggcggagggtgaaaggcacttcttacatggcagcagcaagagagaaatgaggaggaagcaaaagtggaaatctgataaaacccatcagatctcatgagatttattcactaccacgagaataacatgggaaagaccagcccccatgattcaattacctccccctgggaccctcccacaacatgtgcaaattctaggagatacaattcaagttgagatttgaatgtggacacagccaaaccatatcaggctactcgggggtttaagaattcatattaacttgctctgccagagaaagcacaatttattaatttcagatctttccaggcagtttacaaactttttcctaccccagggcagatggcacatgtctttttattcagagggg

SEQ ID NO: 563404 - DNA, 123 bp, Homo sapiens
cgtgaatgcagcctgctgagaattcaccccgtacatcaccatgatcggatcccctatctattatacgttgtatgtttacataaatacggttcaatgatcattagtgttttaaaaaaaatactg

SEQ ID NO: 563405 - DNA, 117 bp, Homo sapiens
cctcatcgcttccagcctctagcagaatatagcccactaagtcctaactctaacactattcttaggcgctatcaccactctgttcgcagcagtttgcgccctttacacaatatgacc

SEQ ID NO: 563406 - DNA, 158 bp, Homo sapiens
ccaggcatattgttgaatagtaggctgatggtttcgataatacagtatgggataggggtgtcggtgtgccttgtggtacgaagtgtgccagggcatttttaatcttagagcgaaagtctataatcactgcgcccggtccattaggggacgcgccaatc

SEQ ID NO: 563407 - DNA, 772 bp, Homo sapiens
tcgagtttagtatatgatttattttttcttcatctatattaagcaatagtaaaactaagccttgatagggggacacttccaatgttttacattttagttgaattaaaagatatctccttttccaaaaataagacctataaatgatttgttttctaggtaactagtgtacaatgccccttccctctgtttggtagctaaaggtctacagttatgagaaaatggaataacataatggggtagaggccataaaatattttaaacacattaccaagttattttttctatcttctatttttaacgtatacaaaacatttattcattttgtgttaacaactttgttatttattcaggctgttgttaaatggtatgaatatttgaaaatttaatcctgattggtacaaggaggaacataaaaatattctttaacaaaaatggtgtcatgaccccattgttaaaagattaacctttttttaagggcttgttttggggacttttacttgagtgcttactataaagtgtgttatatggtatatgattcttatttttggaaggtataaattacattttcgtggagggggaatattgtttgttacggtccctgcagtttgaaaacctgtttatttgcaccacctctatcttaaataggaaggattcgcggggtaagaggttggactttacaggggctgacatgcattgttgcgtcacagatcatttggggggagggttttggtgcccaggcctttggttcctaaaaagtggagatatgcgggtt

SEQ ID NO: 563408 - DNA, 491 bp, Homo sapiens
ggctgacaacagaagcactgatgtctctcactttaaatcaaaagttagaaagtattaagcttagtgaagaaggcatgtacaaagtccagacaggctgaaaactaggtctctggcccaaatagttagccaagttgtgaatgcaaaggaaaagctcttgaaggaaatttaaagtgctactacagtgaacacatgaatgataagaaagcaagaaggccttatttctgacatagagaaaataaatatcaaaccagccacaacattcccttaagccaaagcctaatccagagcacggttctaattctcttcaattctgtgaaggctgagagaagcaaggaagctacaaaagacaagttgacgctagcagaagttggttaatgaggcataaggaaaaaagccatctctataacataaaagtgccagatgaagaagcatcaagtgctaacatggtgaaaccccatctctactaccaatatttacaaattagctggtgt

SEQ ID NO: 563409 - DNA, 570 bp, Homo sapiens
tgggagaggaactctcagaactacaggaccctaatatgctctcccaagtgctgggtgaaacgcagccctcaacttcagagcaacgttgacgtgggtgctttctgcagtaacaataggaagtttggccgggcatggtggctcacgcctgtaatcccagcactttgggaggccgaggcaggtggatcatgaggtcaagagatcaagaccgtcctggccaacgtggtgaaaccccgtctctactaaaaatacaaaaattagctgggcgtggtggcgcgtgccctgtattcccagctatttgggaggctgaggcaggagaattgcttgaacctgggaggcggaggttgcagtgagccgagatggcgccactgcactccagccctggtgacagagcaagactctgtccccaaaaaaaagaataggaagtttacgaagctccgagaaatttctgttttatctccaccctcctcatttccctgctttcagagcactggttctagccagacccagcatggcgtgacacggagacagtgcgctgcgaacagccccacaatctgtgctccttacccctgg

SEQ ID NO: 563410 - DNA, 354 bp, Homo sapiens
tttttttttttgaggaatttctttgaatggtagctctcagaatacgaagaatgttgaacaaccaggacacaagtaggacaggaaagaggatcattctgggaatccaggtagcaggaaccacccaacacactttacaggatgctgctatcacgagcatgcgctctaactctgttccatcactcgacccaagatggcagttctgggaactagagagcgctgccggccggcctgcgttgcatgcctgccccttggcaaggagggaagcatcttgacgacagttcctgcaaggctgcagccagtggggcaggcagagcgagatgctgctatcgaaaggtgaacagattgttatcaggg

SEQ ID NO: 563411 - DNA, 112 bp, Homo sapiens
ttagggctcattcaggggggccacatccacctccagtcccgggccaggtgtgagaggcagaccagcagagggacttgatcccttcggtgtctgtttggcttctgggctgggt

SEQ ID NO: 563412 - DNA, 488 bp, Homo sapiens
agagggcttgtgcgtgcgcacgtggggcgcttcacacattttacacattttcatttttacttagatacatacctttgaagttgttacccatcactacatagggggaatagcaaccctcgtgtccatcagcacatgagtgggtgaacaaaacgtgcccgtccagacagtggacactcgacagccgagaaaatgaaagagatgctggcacgggctacagcaccaaggagctgtgtggacgtcatgccgcggggccctgtctgatcctctcctgggaggtctctggagttcccagatctgtagagaccgaacgcagaatggcaggtgccaggctggggagaggccttcagtttgggaggactctggagaccggtggtgaaggtggacgcacagctgtgggaatgcggttcgtccgtcggacacttaaagatggtgaaaatggcaattttatgtattattttactacaattaaataaaatggatttttttag

SEQ ID NO: 563413 - DNA, 447 bp, Homo sapiens
agaatgagatcctgtcatttgcaagaacatgaacggaaccggaggtcattatgttaagtaaaataagccaggcacagaaagacaaacttcacatgttttcacttatttgtgggagctaaaaattacaataattgaactcatggagatagagtagaaggatagttatcagaggctgggaagggtagtaggaggctgttggggaagtggggatggttaatgggcacaaaagttagaaagaattaacaaggtctagtagttgatagcacaacagggtgactatagtaaaattagtttaattgtacttgttaaaaataactggcagactatatgtgggttgattgtaacacaaaggataaatgccttaggtgataagttttaaagaggcttcaccaccttccacgaaaaacagggaacacaagtatattgagtttgctcattgtgggcaaa

SEQ ID NO: 563414 - DNA, 1039 bp, Homo sapiens
tcaaggctgtactgagccttgactgggccactggactcgcagtactgggtgacagaatgagaccctgtctctaacagaaaggaaaatcatagaggactgttatccaaggatagaagatgaggccatgaatactgaggaagaggggcaatgatccagaaaacatagtatttgctcaaatgttatcgccaggtacgcaacagcatgcaagagtgacttggatgattcaaataatctttaaaagctggaagaaagcaagataatcaaggtttcatgtatgtattaagtaactatttttggggagagtgtacaacagtcgcttagtatttaagtgaaggagcctaattcaaagcaagtcatgaaaatcaggaagaaggtatggctgtagattaggcacgtaggcaatgagacagggatcgtgagaggtacagagatagcagggagagattaattgtgaagtccagagatagcagcgagtaatacatattcactgcgtcaaaggatgtccatatggaggaagttttaatgcataaagaagtaccaaattacggggggctgaaagaggatgccctgcacagaatttaatagagtaagttagaagggtgtctacctgcatgtgttcgtgagagcatatacaggaattgttaccgggaaatcgtggggcaaaaaaaaatattcgcaggtccccagtgagtttgagattaaataacactacttgtatataacacttaggtcagaagaagaagttacgaggagtgttaaaggtattggaggtgaacgaaattggcatgtgttcaacatgtgtggatgctccggacaagtaccctcagggagtgcgggaacgaccgagggagggggtggacggcagggaagcctgggccaggttgccatttgttaaaactgtcatcggcatgtacctgtaatgcataatgtgtaaaaacaaagggggattaaattgcaggaggaaagtgccgcgttgaaaagggcagaaataaaagagcgacaaatggtcaaaaagattcaacattggagtaaaacaaga

SEQ ID NO: 563415 - DNA, 862 bp, Homo sapiens
tgcggtggctcacgccaggtaatcccagcactttgggaggccgagatgggtggatcacctgagatcaggagttgagaacagcctgaccattatggtgaaaccccgtctctactcaaaatacaaaaaattagccggacgtggtggcaggcgcctgtaatcccagctactcgggaggctaaggcaggagaatcgctgtgaacccagaaggcagaggttgcagtgagccgagatggtgccatgtgcattccagcctggacaacaagagcaaaatcgatctcaaaaacaaacaatcaacatcagaaaaaaaaaaacccatagatctaagctggatttttgtaaatcccccagttgtaactatttcaaaactttggtggacataaagtgctcataattagtaccaaaggggtctctttcacaagatcggtagtgtacgaccggtgactaatgctgtgtgctatttcccgctgggggactacgtggtctagatgctcggacggaaagtacgagagataagctacataggactggttgctttctataaagtacagactaaataaagagccatcagagccccgggcgtggcttccaacacattacttggtttccatacaggtagaagtttcactattcaataccagattcttaaagcctcaagttaaataggttcctaacagccatgggctacataccgtccaccacctccgttttgcaacggtaaacctggtcgcttggggcctttcacgatatccataactcgcattatctctgactgtgacagcgctttttcaacatgtacaggactgcgcgttatcgggagaaaggacttcttacccaaaattcccggtgagtcttaaccatatat

SEQ ID NO: 563416 - DNA, 636 bp, Homo sapiens
gacggctcgcaccgcccaccctcccgggtaccccttccggagccccgcagaccggctaccgtcctagattctggctcccgttctacaaggggagctggtcaagagggaagaagcctggaccctagccattctggcaccttctggaagtcaactgcgcctcgtccgatccagacgggacgtcccctgatggtgggctagattctgagacgagatctgtccctgaaggaaggcccgacttaagcgagcgtggcttctgatgggtatcctctgtggcctagccactgaagcccacattttctagggggtgtctgtcactgctcgtccccggagggccgagatagctgaccccagctctcaaacgagttccatgccgtggcgtccgtggctttgagcctgggacctgtgggtccgaccagctaggcccggaggccctaaggagtctggtgctgccccctgcccgacagggcagtcggatgaggcagacggccccacacactgtgcctgaggcccggaaccgttcgcaccctggcctgccccagtcaggccgtagttagaagagcttttacttgggcagcccagccgtgtctggcgcgaacactggaatgcatatactactttatgtgatgtgtttttgat

SEQ ID NO: 563417 - DNA, 1386 bp, Homo sapiens
  misc_feature (1041)..(1041): n is a, c, g, or t
gccgcgtctctcactttctggctcggtgttggcgtggttgtctgttctctgcttttgggcgccgtttttcttcccttgtcttctttgtctggttttttctgtttctcgatgcttctttttgtggtgcgtgcgctgttctttttgtctcgctcgcgtcttgctccttcttcggtgcggttcttttttgtttcggctgttgttgctgtgtcttggtttttgctttttcttcgtgcgcttgggtgtggtcctgtgctgtctttttcttgtgttgttcctcttctctctcgtctgctcgtttttctttttgtgccttgtctgtgttgtgggtcttcctcgttgtttgtgcgttttttttctgttgtgtttggtttgttgtttgccctgtctcttttcgtctctgtcggcggtctctgtgcctgtgttgttttctttgttgctttttctttttgttgtgtgtctttgttttttttttttgctttttgttcttgtttttgttttgttgtttgttgctttctgttgtgtttttggtgtgtgtgctttcctttgttgttttgtcgtttttgcttttttgttttctgtggttttttggtttgttttgtttttttctgtggcgtttgtgttttgtctttgtcgttttttccgtctgtttgttttttcccccccggtggggaggtctaactatttaagcccggggctttcgtttttagtgggaccccgttcccggttcccccctggggggacgccccctttcccccccctgttttttgcccccccccccccggaggttctactaactcgagggcagcggacttccgtgttctcctcggaaccctttcacgcattcggccctccgggggagccccgcgattccaccgcctggtgctttcgcacggtcccccttggctagtagccccccgcgggggccgctttcctctgcctccgcgcacttttttggccttagggctcgccgggcggccggatgtcacccgattgtgtcacccccggcgcgagcacttttactcagccacattatggccgtanatcctatggcgaccccatattatgtagccatctcttgtaaccaactgagaccggactgtgctctccggttccggtattttcccgcgcgaggaattcgtcgagcccaccggattcaccagattctgtagttccttaaaatatctgacttttttcacctactaatacactaaaagggaaaagttttattcttttattgggacaccttcacgctgtaactcacatgtatttaaatatggagaatgtgaaatgctatataactctttttatatccaaagttctccagcacttatttttattttatgccttgtttgtcttttacataaataaaatgtttattagattgga

SEQ ID NO: 563418 - DNA, 582 bp, Homo sapiens
  misc_feature (525)..(525): n is a, c, g, or t
ccgagggtcagtggccactgaaggtatgaggcaaggcaccgggctgctggcaagggccccaaccgcctccaccaccgtgcgcctcctgtgcgggaaagaggaccactggtgaccagcagccaccagaggcccagtcgctgcgagtacctctatggagctgatgacagccagcgcgcctgcccggaggccaccgcgctgaagcaacacccaccgaagacggccatgagcgagcttctagctggatgggcgcatgagaacctcaagaaggcatgaagccagcgccctgctagtgccgtgccacccgcgcccttctgggcctgacctgtggctactgttgccctcctactgtggcggcaggacctttgtggggcttcgtgccctgctctggggcccaggcggggctggtccacaatcccaggccccaacagccttcaaagatgggtaaaaggagcttgccctccctgggccccccaacctatggtgaactcgccccagccacccccaggcctgtgcctgccaaccctncctaatggggaactagtgaatgaaccgtagagacgcgcgtgtgagacgctcgtcaca

SEQ ID NO: 563419 - DNA, 1023 bp, Homo sapiens
gttatacgtcctatgttacatttgctaggataccatggatgtgtacctccagtagagtcagtatttctctaataactgtgtcagggtcgctccacgaccaattttatatcaatttgaaattaggttagtttgagccgtcgttcacactgcaacacaagggttcccggtggggagcctttcgccgcacctggccgtcgccggttacaaccacagttttccctggaacgctgtcctggcggataagacataagaaggattcatctacttagcgggttctgctgtctctggctgggctggttgttgaaggatgggcttaggacggaactgtcatgctccctttccaatccctgggggtcacagttgggacttagatggcagataccagaggaaagacagccgggatgcaacgcatctggagaacacacagaattatgcaggaacaaagacatacactggctgcaaacatcattgctgtttattagtcaccttaattaataggcagatttgcatttctatgagtagctctcagccaagggagacaaggtactgtagacactccagtgacttctgttgagtttgagaaggcacaagggctcggggcagcgtgaggtagggcgtgggggacccctccatggctcttaagaatggggctgcgcgcatgccctccttcgctaaaaatccttcagctccaacaggtctaggacccaaagagatgaggagattgatgttttaggaaccggatggtgctttgttttattgcatgtacttaaatcgtgatgataatatcccaccttttcatggtcaggtgcggctggctcacacctagaaacctagcactttgggagggctagaggagggtggatcacaaggtcaggagttcaagaccagcgtggccaatatggtggaaaccccgtcatgtactaaaataccccatatctttagtatttcttatttagcctccatacttgggagactgaggcaggagaacttgcttgaacctgagttaagtcgaggttgcagtgt

SEQ ID NO: 563420 - DNA, 110 bp, Homo sapiens
ctcattatatctgagtaacattaagatggaaatcaaatttaaatgcaagatccacatctgatatataagaagaggacattatggttcagactcccaaatcatcgattgct

SEQ ID NO: 563421 - DNA, 81 bp, Homo sapiens
taaaatgttgaaccccccccccccccccttttttttttttaaaccagggatgtttgttgaaataaaacattcagtttgcca

SEQ ID NO: 563422 - DNA, 1120 bp, Homo sapiens
attagccccctaataaaattaatttaatccacttcattcatcgaccttccccaccccatccaacatctccgcatgatgaaacttcggctcactccttggcgcctgcctgatcctccaatatcagccacacggactattcctacgtccatgcactactcaccagactgcctcaaccgtccttttcatcaatcgcccacatcactcgagacgtacattatggctgaagtcatccagctacctttcacgtccaatgtgcggcctcagtattctttattctgtcctctttccatacacagtcgggacgtaggcgctattattatcggatctatttctactactcatgaaaccttgaatagcatcggcatttagtcctcctgcgttgcagagccattagcaagctatgccttcagtaggctattgtcctcccgtgagaccagaatatcgattctggaggggccatcagtaatttacaaacttacatatcgcgccatcccatacgattagggacagaccttagttcaatggaatctgaggaggctactcaagtagacagtcccaccctcgacacgattctttacctttcacattcagtcttgcccttcattattgcagcccgtagcagcactcctatctcctattcgttgcacgaaactgggatcaaactaacccctaggaatcacctcccattccgataaaatcaccttccatccttactacacgaatcaaaagatgccctcggattacttctcttccttctctccttgatgacattaagactattctcaccagaactcctagcgaaccagaaattataaccctaagcaaccttaaaaacccttgccaaatttagccccgaatgaagattccctatttgcatacacaaatttcgattccgtccctataaaatatgggggggggctgtggccacataatatgcacgcgccaccattagatattgcacacgctctttttataaaacacgactatatttttgccgcaagaacacctattgatctcaccgcgccacttttcaatatgagagaagaaccctttcatgagggagcgcatataaacaataacaacccttcgattagtgggaaaaaaaaactgttctagctga

SEQ ID NO: 563423 - DNA, 151 bp, Homo sapiens
ttcctcaataaataatagtgtactacacatgtaatcatagaccactttacttgctagtcagatggcttcgcaaaatgtttctgcagttgaacatctatcagctatgcctttctatttcccacaaagtaattccttagatattttactagta

SEQ ID NO: 563424 - DNA, 194 bp, Homo sapiens
tacggatgcattcactgtgtgcttggagcgcccattggtatacccgtaaggagcttggttctatgcattctaatttgaggtcccacacaggctgttaatcaatttttataagtctgaaagcctcagtttcctcctctgcaaaatggaacaaattactgtccgtctcaagagaaggacgtgaggagtcccatgtg

SEQ ID NO: 563425 - DNA, 323 bp, Homo sapiens
cgggtggatcgcttgaggccaggagttcaagactagtctggccaacatggcgaaatcccgtctctactaaaaatacaaaaaattagctgggataggtggtgcacgcttgtagtcacagctactcaggaggctgaggcaggagaatcgcttgaacccgggaggcggaggttgcagtgaactgagattgcaccacagcactccaacccggcgacacagcgagaccctgtctcaaaaatcacaaagaaaaaaaaacggagagagaggtggcaagtcccgttaaagccttacggtgtgaatgtgctggattgtgtgtgccaccctca

SEQ ID NO: 563426 - DNA, 238 bp, Homo sapiens
gtccaagagcccctggcaaaccactgatgtaagtccaacagtcctaaagctcagaatttggaatgtgatgttttcagggcaggagcatacagcataggagaaagatgagggctggagactgagcagtctgctaatgcaccttctttgcctgctttttctgctctctggcagccaagggatagtgctcaccagattaagggtggatctgctctctagtcactgattcaatgttatctct

SEQ ID NO: 563427 - DNA, 271 bp, Homo sapiens
  misc_feature (229)..(229): n is a, c, g, or t
  misc_feature (251)..(251): n is a, c, g, or t
  misc_feature (261)..(261): n is a, c, g, or t
atccaaccaccttggcctcccaaggtgctgggattacaggcatgagccacgcgcctggccttaattttgtatttttagtagagacagggtttctccatgtaggtcaggctggtctcaaacacccgacctcaagtgatctgtccacctcggcctcccaaagtgctgggattacaggcatgagccactgcacccggccaaaaaggtgtttctacatcaaactcttccattnactgaagaaaatagcttatatnaatccttcanaaagcatgct

SEQ ID NO: 563428 - DNA, 204 bp, Homo sapiens
  misc_feature (191)..(191): n is a, c, g, or t
tgaggattccggtccgctcggaccatctcggctcacttaacctctgcctctcgagttcgagcagttctcctgcctcagctttcgacgtagctgggattacaggcatctaccacaacacccggctaatttttgtatctttagtagagatggggttttgccatgttggtccgaggcggacccggggtccgagnctcgaaattcgta

SEQ ID NO: 563429 - DNA, 324 bp, Homo sapiens
tccataatgttgcccaggttggtctcgaactccttgggctcaaacagcaagcagtccatccaacttcagcctcctaaagtcatctgggattacaggtgtgatgtcactgtgcttgggcatgttattgtttctggtaaaaccccgagtagtacatatttgaggctgtggagctcatgtggttgtaactactcagctcggccatcggcaaacacagagcagccatagacccagacttaactgaatgtggacgtggtgagcctagagtaaaactcgattcagaaaatatgggacacacatatatggagggggacccgggactcacat

SEQ ID NO: 563430 - DNA, 284 bp, Homo sapiens
tgaggcagggggatcccttgagcctaggagttcaagaccagccggggcaatatagtaagaccccatctctgataatagtaatgataataggaatgaagtaaaaatttagaataataaaagtttataaaacaaatcttgagaaggggaaggagagggctgagccaggcacagtggtatatgctgtgtagccccagctactgggggggcagacgcaggaggactgcttgagcccaggagttaaataccactgagcctgggaacacaccaagacaccatctcttaaa

SEQ ID NO: 563431 - DNA, 279 bp, Homo sapiens
ggcgattgcggtaattcccgtggcactttcgagagcatagctcggaatgaaggagtagaggtgatcgcccgaaggacttagggcgccgagagcagagacgtgggggaacaccgccgttcccttcgggccggtgatgcggagagcgaggtagatcccggcggagttttcgtcgatgggaaaggagccgggctcgtaccggtcggggtcggaagagacgccgaagcggctacccgtgaacacgatctcgaggtgccagctttggcctgcacgatcccggaa

SEQ ID NO: 563432 - DNA, 250 bp, Homo sapiens
gctcgaccaagcatcagaaccaaattcaagatatggctagagatgttggtactgtctcttcaaactgtgtttttccttttagtatgcctcgtaattttttcttgataactggacataatgtactgggttaaagaaattgctgtgatgttcctttagtaatgtgatggtaaggtgtatgtataggtgggggagcattctatagtcctatgattaggtctcagtcttttagtgagcctgtgcctctggatgt

SEQ ID NO: 563433 - DNA, 150 bp, Homo sapiens
gaattcggtcacgagtgtcttgtttcttagattcatcttatggattcttgtaaaggttgtttgtgaaattaggtttccccttttaggatctcaggagtagttgggtaaagacaattcctcctgtcaatcgataagacagagcttgttaac

SEQ ID NO: 563434 - DNA, 112 bp, Homo sapiens
agtggagagtgacttagaggatttacccgacagccacgaagctgtacgaagcccaccacctgcaggcacgtgcaccatggtggccgccagtattcccgtgctcgcccctcac

SEQ ID NO: 563435 - DNA, 593 bp, Homo sapiens
gcgctagacatcactacggagaggctgacagcggcaggggcattggactcagatcgggtgcagaggcgttgtgagtccgtggatgcaagggcctgaggagccaggagagaagtttcggaggctggcaggcgaagggggtgatccggccttgccccgaccccggctgtatcctgcagcatcctgctatgcccagcccagatgtggtatacggggccttaccgccaccaggctgtgaccccagtgggcttggggaagcactgccgcccagagccgcccatctcccttccgaccagcagaccacaaagccgggaccccaggactggtgcaccactcgtcttctcaccaagcacaaactcaccagcaagacaacaacgcccacctgtacctgaccgacggaagggcggaggtcagacctgcctgagtggccatggctgggacccgaggggtgactagaacacctccaaaggctcatacagctggccatgcagaagaccactgctcccactgcaaactccacgagagcccacagctggggagctacacacatatgctgacaaagaggaaaaacagaagacaacaggaaggggagcaaa

SEQ ID NO: 563436 - DNA, 342 bp, Homo sapiens
agtggtgtgatcctggctcgctgtaacctctgcctcctgagttcaagcgatccttctgccttaatgtcccaagtggctgggattacaaacatacgcctgtaatctcagcacttgggaggccgaggcgggcagatcacctgaggtcaggagttcaagaccagcctggccagcaggtgaaaacccatctctactaaaaatagaaaagttagttgggcatggtggtggtggcaggcgcctgtagtgccagctcttcaggaagctaaggtaggagaatcacttgaacctggttggtggaggttgcagtcagcctgagatggtgccactgcactccagcctgggtgc

SEQ ID NO: 563437 - DNA, 421 bp, Homo sapiens
taccgtgccgtcgttcaacatcggtcgtaattggaaaacccctgtggtttagcagctgcttatatgctaacatacctcagaagaatgaaaaatacaggtaatcgttctgagcctcagacatgaaacatatagccaggtttgctttggccagttgggccacactgatccattgttgtgcacaagtctgtcaaagagaaagcatgagtttcatctgattaaatcatggcacagatttctaagtcttgaaatatcatgagcaataagcggtttataatcaacaaatcagaaaatgtaaacaatctgatgtgcaaatgctaaaagaatgctgagaattaagagagtctggggaactagagatatagtgtaagtgtatcattagtgtgcagcttgccatgtaaggaatacagattaggaatttgga

SEQ ID NO: 563438 - DNA, 498 bp, Homo sapiens
  misc_feature (76)..(76): n is a, c, g, or t
  misc_feature (99)..(99): n is a, c, g, or t
  misc_feature (115)..(115): n is a, c, g, or t
  misc_feature (132)..(132): n is a, c, g, or t
  misc_feature (170)..(170): n is a, c, g, or t
  misc_feature (178)..(178): n is a, c, g, or t
  misc_feature (197)..(197): n is a, c, g, or t
  misc_feature (216)..(216): n is a, c, g, or t
  misc_feature (224)..(224): n is a, c, g, or t
  misc_feature (229)..(229): n is a, c, g, or t
  misc_feature (246)..(246): n is a, c, g, or t
  misc_feature (267)..(267): n is a, c, g, or t
  misc_feature (271)..(271): n is a, c, g, or t
  misc_feature (283)..(283): n is a, c, g, or t
  misc_feature (295)..(295): n is a, c, g, or t
  misc_feature (298)..(298): n is a, c, g, or t
  misc_feature (307)..(307): n is a, c, g, or t
  misc_feature (309)..(309): n is a, c, g, or t
  misc_feature (335)..(335): n is a, c, g, or t
cctgtctgaggatacccagggagatgctgtccagaagacagagacattccaccatgagcaggatcacccaaccttnaacacgatcacccccaacctgtntgagttcgccttcagnctataccgccagctggnacaccagtccaacagcaccaatatcttcttctccccantgagcatngctacaggctttgcaatgntcttcctggggaccaaggntgacactnacgangaaatcctggagggccngaatttcaacctcacggagantccngaggctcagatncatgaaggcttncangaacttctncntacccttaaccaggcagacaggcagnttcagctgaccaccggcaatggcctgttcctcaacgagggcctgaagctagtggataaggttttggaggaaggtaggtggaccactcagaagccttcactgtgaacttcggggacaccgaagagggccagcagatcaacgattacgtggagaaggggctcggg

SEQ ID NO: 563439 - DNA, 1191 bp, Homo sapiens
gcccgggcactccccgccaggtcttgctgccggggtcttgctgccggggaggcccagtcctggtgggggaggctcattgggctgggacctctcccctcagcaatgaccccaggcaacatcccctgccatggaccaagggatggcggtggattggagcccaaaggaccagacgccacagcatcctttccacagtacacattgtacacctaccatagtcccctatttcggctattgttggggtaatatcaggtcattcccagacttgcaagtggaacacagcaccccgagatctcgaagaccccggagcacccgagcatatcgtgatcatggaacatttgcactcagcccgtagatataccgtcatcgttgacaggagaaaaagaagaaaacaaaaactagaagcaaagtaggctccgaacgtgcattcctaggaggagacccaccagcgcacacgagccgggacgcagacgcagaatgcacaagaggcgactgtagtagagccagcagaacacagaggagggcgacaagaatacagaaacagacgcacaagaaaggtgacaagccgacagaagccttgggaagacaagagcagggcacacgagaagattaccccgcatgaggggacagacaacccgcaacggacaacaaaccacaaagacgaaggaaacgagcacccaaaactccagaaagcacagacgggcggagaaaaagagcaagagacatcgagaaagagaggggcgaccagcaagagcagaaacaaaaccccgagacaaggcgaggcacagcaacgcagcaaccacgacacgagacggagcaagcggggcggggataacaacagcgagcgataacaaagagcggcacacatagcgaacgagagaacacaacgagagctcagcgcagcgcagagggaggcaaaaaccccagaaagcgggacgcagagaaggcgaacatgacgaacacacatacacaacagaaaccacacgcaacacccggagacaaacagaacaaaacgagtgacgaaccggacaagaaaacacaacaagacggcgctcagctaagcagcaccagaacaaaagacggcagccaacgacaaaccacccccccgcgcagcaggacagcgggcgacgcatacccgaagtagcaacagacaaccaccatacgaggatgatagatgaaaataacgagccgcag

SEQ ID NO: 563440 - DNA, 401 bp, Homo sapiens
  misc_feature (288)..(288): n is a, c, g, or t
gtgtgtgtcctgtgtgtctgttgtgtgttcgcgtgtgtgtgctgtgtggggttataagcccagcacctccaggtaacaaccacagcgtcagactcagtttgctgagtggtactcagcacaggcactgtgctcagcatcccacggcctccacgagcctccggtttaagctcacacagagaactgctgccagaacacattttacagacggggaaactgaggtacaagacacacgcaatgggtctcatctgacgttcaccagcaatatactttagccgagtcaggatcagnaagcccactgtagccagtgcaagcagcgtgttgtgcgctgtgctggcttgagaagccaagtctcaggcaggtgttacttaccacggcggagtgtgcaaagggcaccgagaggt

SEQ ID NO: 563441 - DNA, 959 bp, Homo sapiens
ccggatcacagtgctgagaagtcgaatacgcttcatccattaggtcacaggatgtgtcctgggctcctcgggaaaggttctgcccaagatggggctgggagcagttggaagttacttgcaccccatacctgaacagaaaccctcaactccatctggaatgtggaggcacatatcaatcccaagttgccaaacatcagcctggatgtgctacagacccagattacctgagatcttgcatggaatcccacatggtcatgatccgggggaacagtggacatcaaacccaaggacaatgcgttcaagtccaaaccctggcactggccatatcaaactatcagggaactatgacttatcaggggtcaaatgacaaagatttacacgagatctatatgaattggaaaaccggtggatatggtggatgaatcatgttgagcatcagaccatctaccatccatctccagggtagaaatccattgcatgatagccaatgccagcagagggagcaaggaatggacagaagcgcagagtaggcaaggtcagagatccatctgaggcatctcaactccaacatgaccatggacaggacagaaagaggacacactgacaacccccatggacgaagggacaggctgacatgactgaatgaggcacaatcaattagcattaacaaaccaaacaaccattacacataaatacctacgacacaagaacagcgaaaccaagggaaccatgacaaatcacgcaacaaaacaaaacaccaaggaaacaaacagaagaataagggaatgaacccgagagaccccatgaaatgacaaatgaagagatggcacaagagcctcgaatcaggacatggacaaaaaccaaaaccaaaacacggtataacctgtatttcgcgacgagaaccacaacagaacaacaccaaagatgacaagagcaatgcacaacacaacagccaggtg

SEQ ID NO: 563442 - DNA, 150 bp, Homo sapiens
caaaggtacagtgtgatgcagcggtacacagacgtcattaccacacaagtatacatccattcatcgtgcaataatatgcatctcttctccaaaggtagtcaaaagtattaagtcatcaaataaatcctcacaattaccaagcaacactta

SEQ ID NO: 563443 - DNA, 983 bp, Homo sapiens
ggtagcgatggcggctgggccgagtgggtgtctggtgccgcgctgtgggctacggttgcctgtgtggcgactgtgcttcaagcggtgtctgcttatggggcacagttgacatcgggaggcgatgcagagcagtttagcgctttgtctaccaactttgctttgcgaggctcttgttgatcttgctcggtattagttgaacgctgtcttcagctgtgtttcctgtattgccgaggcatgctgtccagggaggaagcacaatttgagagaccaaaaccgtctgtatgcaggagctattcttgaaacgttagtggcatcgaaaattggcaaggttcccgtcattcgtccagggctctttgcttagggatgtgattaaaccgcagactgttcagaggactcgtcacattcttcgtcctgtccgtggttcaggacccctgttgcttaccgtgcttggtgacgaatagatggggaacatgggtctgtgagaactgacgtgctttctctaagtggaaccgcatgacggtgtatgaagacattcctgttgtgatcggttggaacgcatatgaatctttggttagattgagtctatgctttgggttccttatctattgaagtagttactggcctctacaaaaataagttaggttctggtgagtccaatggagtcacgccgtttacgtgaggcattaaatctctgaagcgtgaatggggatacgccagccaactaagagaggtggcacgtacgaaaccattttggtaccgtcgccctcctggctggggtaccgtacaaccaggtttcccaccgcgcgaaatgacacgaactggggagtggcccaggtcaaaaacgagtccctcacggggagaggcagcaattatccactcctcggtgccgacagagagccaacacacataaatagacgaggcggcggccacagtacgcggaaaaatatcaggacaggcacacccacaagagcaacaagacctaa

SEQ ID NO: 563444 - DNA, 951 bp, Homo sapiens
ggcgggtttttcggagcttgggggtcgtgcagatctgcgtggatctaggtgcaggagtctcattgatggtctgagcctggcgtggccaggctggtggtgtcccagaagagccagtgagtcgaagatgcttgcatggaacaaccaccctgggcttcaagttccgacatggagtcatatttgccgttgactccagggctaccgcggggtgcttacattgactcctctacagtgctgaactagaggtgatgaggagatcaacccatgacctgctaggcatgcatggtcgtggtggcgcagctggattgcagcttctgggaacggctgtcgggtcggcaatgtcgaatctatgagcttcgaaatcaggaacgcgtctctgtagcaggtgcctccaaactgcttgccaacgtggtgtatcagtacaaaggcatggggctgtccatgggcaccatgatctgtggctgggataagagaggccctggctctactacgtggacagtgaagggaaccggatttcagggggccaccttctctgtaggttctgagctctgtgtatgcatatggggtcatggatcgggggtattcctatgacctggaagtggagcaaggctatgatctggccgtcgagccattttacaagccactacagagatgcctactcgggaggggtgcagccacctctaacacgtggggagatgggttggatccgagtctcagtgacatgtgcgtgatctacctgagaagtatagtggctctaccccttgaagaggggggatgcgtgtgggttttgggggaggcatggcaaacggaccgggcctcccctccatttagggaggcgcatggtcggattttaagctgggctgacctagttccgctaagaggcgagggatgtcttggggatcccctcaaaaaacaaacaaaaaaacctctgggaaaagatcctagattgaacga

SEQ ID NO: 563445 - DNA, 925 bp, Homo sapiens
agcaggttcgaaagttcctgtgtgcagaacagaaggctggtgtgtgagtggtgggagtcgggtgctaaatatttctactagtgctcctgcaaggctagtgatgcagctggtgccccccgacctggctgctctgccctggtgttcttgctgcctacagagtttggcctgtgagcatgatcctgctgcctggctgggaggcctggtgtctagtgctctccacgacaatggattccaatggcgagaacacttggtgcctcttgccatgggccagtggacgggacttgaaatcagagccagggtgagtgcgtattccccacaatggggcttgtcagcgcttaatgtggtgcctgtgtgaagccagaggttgggcgaaagctcgaggacgcaagaagttggagagagtgttgtgcttgcatgttggaagtatgcagatcagagtgacgatatgaagagtagtctggattgtcgtgggacaggagttaagtctaactcgaggaacggacacgaagggcggattgtattggccaagcagggtgataccgtgggtcactcagcgcacatggcccacagggcgctaatgccggaagcaaccggccgggcccgagtgaacaagggctgggccatgcacctcggtggcctgctgatgctgagcgggaacctatcttacctccgagaggagcacaagacgcaccccgtggagggagattggcccttgtgagcagacacagagtggtgcacaacacatggatacgcgaaagacgcacggtcacagcggacccggagagaaacggcgaagggacaggcaagaacgcaaaagggatacacgcatatggggacagccggacaaaggggagtacagaccactacgcggggggacaagtggacataccggagaggtacggaggggaacaaacacgacacaggg

SEQ ID NO: 563446 - DNA, 404 bp, Homo sapiens
  misc_feature (9)..(9): n is a, c, g, or t
ctgagctcnctagatgtgaggagttaaaacagagtgctaaaagagtggtgtttcacacgttcactgtggtgtatcatcaggacgcgttcatgcagctgtgacatgacctactgagagatattctcagaagtgacaatttaaatgtagggaagaaaccggtcgagaagctgctatgctgtggctagaggatatacacagaatcacgaacccaggatttggcttctgtgtcttagccaaatcagaattgatgcactttcagaagtaacacagagagcttggtttcaagggctggcacccaatgagaagtcagaggtggttcaagggctgtgtaagtgcatgcgccaagtttttcaaaccaagacttgggatgactcaagaggtgatgtttcattggagcatcttcg

SEQ ID NO: 563447 - DNA, 165 bp, Homo sapiens
cttctctccaactctgtgcgcatagcaactggcattgtgttgcttgtaatgtttctgcatgtggcgagcattatagaatgctccaggccagagaatggattgctgcatgatgccagggactgtcaggagtgctgggacttgtctttgagcagagctccagagaag

SEQ ID NO: 563448 - DNA, 412 bp, Homo sapiens
agtcgtggtcccatcagacagaagagataagaacgcaattctgtgatgttgtattataagcaaagagagagtggaggacaaaaatcaggggggagacaaaaaactggcttctgcttgctttgatggttatcaggcattcacccaacaatgcaacagagatggcactctcagacaatgcttttgtaacaaaaggttaatagtctacccagggagcccaaagtgactttacacccaagagaactgtcaggtatgtgctatgtagaccactgctacccaggaacatggcttgcataggcaataaataagcaaagctcactgttcactcaagcaggctgagccctgtgaaaggcaggcgtctgctgctcgagtcttggctaactgcgaagatggcaaatcttcatcctctgatgca

SEQ ID NO: 563449 - DNA, 387 bp, Homo sapiens
ctctgacgagctttgacaatggtttatcatcagcgcacattattgagcactagctgtgtcaggcctgagtgaggtgatgtgattgtgtgccgtacagacaatgcgaccctagcaaactggtgtgctgaagaccatgcgtgctgcttgctgtggggagaggcttgacaggtgcatctgagcagggagagcagggccccatggaggagaacacagggaagagggttggcaggcacagctgcatgcctctggggttgctatcctggttgggaccctgtcttccagccaggtgtatccccccaggagccctgtgccagggagctctcagcagccttgcatgctgagccagggctactgcgcaaacctgctgtcctcctggagatggaaagg

SEQ ID NO: 563450 - DNA, 777 bp, Homo sapiens
tccttttggaggcagtctgcacctccagccttgggcgacagagcaaagactctccattcttcacaaaaaaaaacaaaacaaacaaactcttccgcaatatataacaggggagagcattgcgggcgcgcctcatatagcgctcctttttgagcgaccgcgggatctatagggcgctacattccaaatttgaggagaattcgggctatcccctatgttgaaattgcgccctatcaacattattcaaacaaaaggcttattattccattagaaaatctcatatctggtatcaccaccaatggggacatggcgcattacacttacatatttagcccccaccaaacctccttgtggggcctacaccaggggccccagggtgacatctctttagctaggagcatattattaacattttcaacccctcttgcgggggggctaccaccagctggtttcacaaagggatattactctccccgggaaaaaaccacgggggtagtaccctccatatgaggaaccacttctatctaaagacagaaagttacttgggcgccaactgagagtactctcgaaaatcgaggagtgatgacccacacacaagaggttgcccacccccttgtgtagcccccccgggagggggacacgccacgcgagagaaacaacacgcggaacaacgtaggaacatattgaacccccgcgggggaacaacaggaggacccccgcgagggccaacaggcccaccacgagatgagcacggaacccacaaacacgtgattgataccc

SEQ ID NO: 563451 - DNA, 381 bp, Homo sapiens
  misc_feature (16)..(16): n is a, c, g, or t
  misc_feature (33)..(33): n is a, c, g, or t
  misc_feature (56)..(56): n is a, c, g, or t
  misc_feature (69)..(69): n is a, c, g, or t
  misc_feature (291)..(291): n is a, c, g, or t
  misc_feature (305)..(305): n is a, c, g, or t
  misc_feature (362)..(362): n is a, c, g, or t
  misc_feature (368)..(368): n is a, c, g, or t
caccccaaaaaaaaanctgtaacgtgccccaanaaatcccctaaggcgctcttganaagtgcaatgccnatgaagactggtttagaacaccccgtgaaccctagttgcctgttgtcacggcatcttgcactttaggagactaagaccgtccctggttcgtctgtgtgtggtgtgacccaatggtgtgcccagagcactactctcaaaatcactagtgttagcaagtcgtcccgggctggggagcgttcgccgtagtctttggaagctttggctttagatttaccaagcccngcctccccgctgcnagtgccctgctctcccgttcgcctctttctgtttctgtgtgaactttcccggtaatnataaanagttaaataggtt

SEQ ID NO: 563452 - DNA, 160 bp, Homo sapiens
  misc_feature (11)..(11): n is a, c, g, or t
  misc_feature (48)..(48): n is a, c, g, or t
  misc_feature (126)..(126): n is a, c, g, or t
tattatctagncattgcatgtttatgttcaaattaaaacagggagtgngcaataggcaagttatagaagtggaagcctaaaaaaaactccatatcatttgaagggaaaaagttgtgttacagatgncagctaacgtcagcctttgggtggtttaaaggtt

SEQ ID NO: 563453 - DNA, 927 bp, Homo sapiens
  misc_feature (206)..(206): n is a, c, g, or t
  misc_feature (290)..(290): n is a, c, g, or t
  misc_feature (300)..(300): n is a, c, g, or t
  misc_feature (362)..(362): n is a, c, g, or t
cagctgcagcattatagagcaattccaggagtagtacagaaggtaaaccaagttcagcaagatagcacgctagtaatcaaacatagctaatcccaatgaacaaagtgcgcttatctattgataacgcattagacacgcagcgttgccacaattgcgtgcatgaaaatcgaatgtagatagtagtctacgaaactcaaacaactacntgcttctactcttctatcttaccacaacgaggtctcgttggcggtaacagtggtcaacagtacatgagggagtcatggacattntgacctgagnaatgctaatggatgaactttcatcgatccatagctcgaaatggtccaagccttaacctactnggtggaaactgggatcccttcagtaatgtgtactgtacgaaaagttacttctagcagctgtgttaaggcataaagacgaagctttgataaaatactagctaattagaaaggacttgcagaaaacagcaagacttatcactctcgaagtagatgcaaaaggtgatgaggattgcccgtgtattgttcccaaatttttgaatgcagtctcctggtcatgcgtaatcgagacaggtgcttagtgtcttataccattgcccgtacagtacgcttcgtgtcgcggtagtcacatcatagtacatgaaggtgcctttgaaggaacttcggacttaccaagtgaatagatccccacgagaaagcaagatatgctcccttgacctgagactgtcccccccttttagttatatacccccttaatacaagatatggacctatttcggagctactttccaaaagaaattctacaaggggactcgatcaaagattgggtcactttcaaagacatggtttacgtaaacgccaattttgggaagtgcgagtcgtaaatatgtattttcgtccatgccaa

SEQ ID NO: 563454 - DNA, 269 bp, Homo sapiens
tatggaggaaactaggtaaagagcacacagaatctccctgtatctctttcttttttttttgtttttatttgagacagagtctcgctctgtcgcccaggctggactgcagcggcgcgatcccggcccactgcaaggctccgcctcccgggttcacaacattctcccgcctcagcctcccaagcagctgggaccacaggcgcccgccaccacgcctaactaatgtttggtgtttttagtagagacagggtttcaccgtgttagccagtacg

SEQ ID NO: 563455 - DNA, 156 bp, Homo sapiens
ggagctggtaccgaattcgcggtcacgttggggacaggggatgccccggtccacaatctcaaagcccaaaaagctgaaggttcggagcaaggctggctctgtcctcgcggttcttgtggaagcaaatgaagacatcccaacggtgaccggcgactt

SEQ ID NO: 563456 - DNA, 145 bp, Homo sapiens
cttctctcttcatcccatgtggctagaacatggctggagttcagcacccatagactgtgccattgccttccttgtcaaagacactgcagaccctcaacaaagtcttcacagtgtggcctggtccttgtatgtttggaaatggctt

SEQ ID NO: 563457 - DNA, 729 bp, Homo sapiens
tgggatgtttttatttttcctcatggcaaaataaggcccaagacttaaaaatcttcatagctgcttttttctttcttttaaatttttagttgtggtaaaatacatctaacgtaaaattttccatcttaatcatttctaaatgtacaatgccatagtgttaactatgttcatattgtggcgcaaccaatctccagagctctgtcatcatttccaaactgaaactctggactcatttcaacagcttcccattttcccttcccccatcccctggcaaccgccattccagcagacaccttgtatctctatgaatttgactactctgggtaccttatgtaaatggaatcatacaatatttgtctttttgcttctgactcatttcacttatcatactgtcctcaaggttcactcatgttatagtacatgtcagactttcagtttttttcaaggctgaataattttccattgttatgtatataccgtattttgtttatctgtgcatctgtcaatggacattggattgttcccaacttctggctactgtgaataatgctattacgaacaccggtgttcaaaggtctctttgagatactaatttgacttcctttggatatatatgcccagaaatgggactgctgggttacatgagaattctatttttaatttttggagaaacctttataccattttcccatattggctgtaccattttacctttttgccaaccattgc

SEQ ID NO: 563458 - DNA, 149 bp, Homo sapiens
tgatgtctgctactgacaggctatgtaggacatacttctggtgggcactgtgcggaaacttgaggataaatcagtgagctgcatgcatcttaaaggcatggctgtctcctcacttgagtgcaaggtccatcgaccaaagccctgttctg

SEQ ID NO: 563459 - DNA, 965 bp, Homo sapiens
ggggagccgggctggcaggagcaggaatggcggggtggggtctgcaggcgaggagcgccggtgtgctggtgtacagcggctaggggcgctcggggttctcgatgcgtgacaggctttgcgggcccgcgaagcgggatggggttgccaggcgttgagtgtggtaggatgaatgaataatggccctaggactaacctagtcaatcagttacaagatgaacgaagacatcaggtctgcaatcctggagacacgcgtctgagcaccaaggtgcatcatgacttgggccgagtttggggtacaagaacttcttgtgcgtgtgcaaggaggatggagtgagcatttgcgcagtccctctagtcggatcggcgtgggcatagtagtgggggctcgtagggccgaggtcggccaaaatatcacgaaaggacataccttgtttgaagaaagctagttggatgcatggccctggatgacaggaatctgtatgggaacattcgtaatgaatcgtccacaccatctggcgaatgcgaagccccatcatcatgggatgtgtgagactcacatgatccattgagagggatcgcaagatgatggagcctggtcatggagacatcaatctggttatgcacttcgcgtgttagagagatgtgccagaggattgtattgtgccaacagctctggcccatacttgctgaatgtgagaaagtaaactagccggccaattaccggcgcaggggcaagacgtgctacttggatgtggctcccgagtttacactggatacgccggatgtagcagagaaaatcaagtgagcgtgtagtgttgacattgaggctactggtagagctttagaagtccgtagggatacttaccagtgaactgaatcgcagggaaacatcgagcgagttaaggaagcgcaatcagtgggaacacaggagcgaggcggaactcacccaggatattgaggctcat

SEQ ID NO: 563460 - DNA, 297 bp, Homo sapiens
  misc_feature (3)..(3): n is a, c, g, or t
  misc_feature (35)..(35): n is a, c, g, or t
  misc_feature (37)..(37): n is a, c, g, or t
  misc_feature (40)..(40): n is a, c, g, or t
  misc_feature (81)..(81): n is a, c, g, or t
  misc_feature (88)..(88): n is a, c, g, or t
  misc_feature (102)..(102): n is a, c, g, or t
  misc_feature (117)..(117): n is a, c, g, or t
  misc_feature (123)..(123): n is a, c, g, or t
  misc_feature (136)..(136): n is a, c, g, or t
  misc_feature (190)..(190): n is a, c, g, or t
  misc_feature (193)..(193): n is a, c, g, or t
  misc_feature (211)..(211): n is a, c, g, or t
  misc_feature (229)..(230): n is a, c, g, or t
  misc_feature (241)..(242): n is a, c, g, or t
  misc_feature (261)..(263): n is a, c, g, or t
  misc_feature (266)..(266): n is a, c, g, or t
ganggagggggtaaaagtcgtgttctgccctgtcngnggnattggagtgccccgctaggtaagaagcaatgcttagatctngcttccnggcagcagcttganttcccgaatcttccngcacgngcatacaaatgcngcgttagaatccatacacgtaatccatattcaccttcccatccatcccgcagangcngcatggtgacacccaggntactgtccatgcttgagnngacgtatttgnnggttctgttactacaacgnnnggnatattcacggacatgcctgtaataccccggc

SEQ ID NO: 563461 - DNA, 1272 bp, Homo sapiens
ggcatgtctgtctatggagcagcgattcttaatgtttcttgactatcactcgatgaactggcctgtcagcttgaacacatgtggactcatcctggatacctgatcttgcacaaggtccaagaacccgctacttgagtggatctgcatccggggacccgtttctggggaaatccctatattgaggctgtaggtagagtaaaagtcatctatatatttactttccataataagaatcctttcccaacactatctgatccttctgattgcacttccgaaaaagccgtaaagtactgtagggagttcaatgtcttcaggacataaataaccaacctaagatctctctatcgtcaattagctagctcgagtctctatacaggcaattctccttgtcctgttccatctcattcaatttccttttgcactggagcattgtattcagtcgtagcgttaactgtgctgaagctagcaaatttgcgcatcccagtatgagtatccttaccaaaatcccgtagttccggttcctcgagcctgctcccattgctcaggagtaaaacgcaaacccatattgaactcgccgtgggggtcctccttccaacatctctcgtgtgaaaacctttgctaccttaaccgttttggcagaccatgattccttatcgaggcattcacaacggtaggggagaccctcgagctccatcctgtgggcccaatttccgttttaactaacggctcagcataaccctagttacgaaccactgacattgtaaaccacggtcccaaatttaaccccaaaggtaaggccccgtatctcaaacactataagttactacctttggcactcaggtttctaataacgatcatgaattactgcttaggcttgtgatgcctgtggaatctccatcaccactattgcggcaagagcaaggtacttccttagatgactttcaaccttcgctctaatcccataggatttccccacccttatggaggaaagaccgagcttttaccttggtgggaaacccccctaactgaagtggcgaaaacgactatctaaaatgtcttcatctctgcattttcccgtggccctggacaaatgtgtcaaatatatggtctataaactatcatatcagccccataaaaaccctgtctgccacctacttcggtcaccacatcgctcaatacctttaccatagtgctatacaacgggccatcaagagctataccaacatgggcatacatggacgaaccatatgtaggagcccaacgacatatacc

SEQ ID NO: 563462 - DNA, 278 bp, Homo sapiens
accataatttctaatcttatggctaatttgttagtcctgaaaaggcagtcttgtccccaggtaggaagggagtttgttttgcaaagggctgttatcatctttgtttcaaagctaaactataaactaagcgactcccgaagttatttcagcctacacccaggaatgaacaaggacagcttggaggttagaagcaagatgggttcagttaagtccgatctctttaactgtaataattatctcagttataagaaaatataacataacaaaatctctcaaaa

SEQ ID NO: 563463 - DNA, 977 bp, Homo sapiens
  misc_feature (723)..(723): n is a, c, g, or t
tcaacagacaataagtgacgatgacggccgagccgattgtgctgtcgtggatgccgttagtttgggctatcgagacttgtcaggttgtcgacgcatagattacaatcgaaggaggggtgtcaggctctcgatgggcgctcaagtaattcaatgctggtcgtcaatggctagaagcatcttcaagcactaattactcatccgatcttagcgcttaggctcaacatctagcttgatccttagatcagggacatgtgcaaatcttcgcttaactctcgttgtgcatactcatgaagtcggacatgtaaggaatcgaagtgctgcttaggtaagggtatagtgcacgaattatctggaatagaccccagtcatagtgccttgattgtgacattcgtacattcttattttctatgtgaaccattctgttgggggaagtaacacttgagggctacggagtgtacccgtccatgatattcgataggccgattgggttcccatgtggattgactaaaatcacataataaccctgatactcactgtacagtgaacgtagtctggacatcacatgctatgtaggtacctgtctgtacgattcactacatggctcttgctatctcacaacagacctatttgtgaccacacggaattgtgagactagcatattgcactgcctgaaataggttgatttacgcttcctaaccttggtaatcattaagagcaagttgntagaaagagtagatgttgcatgaagtttggagcaaggttgggtataactgctattctacaaagttcttgactgttagggttttaggatctccgtccttccatttgggttatgccgtttgaagtctaaatgggaaaatgaatgtacaaggcagccattcacaaaaatactagatttaaagatatccggctgtgtgttccccaatgggatttcaatacattattagagattgaaccggccatttaaccatttactg

SEQ ID NO: 563464 - DNA, 884 bp, Homo sapiens
  misc_feature (174)..(174): n is a, c, g, or t
  misc_feature (221)..(221): n is a, c, g, or t
  misc_feature (223)..(223): n is a, c, g, or t
  misc_feature (233)..(234): n is a, c, g, or t
  misc_feature (236)..(236): n is a, c, g, or t
  misc_feature (239)..(240): n is a, c, g, or t
  misc_feature (243)..(243): n is a, c, g, or t
  misc_feature (245)..(245): n is a, c, g, or t
  misc_feature (247)..(248): n is a, c, g, or t
  misc_feature (252)..(252): n is a, c, g, or t
  misc_feature (266)..(266): n is a, c, g, or t
  misc_feature (273)..(273): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (294)..(294): n is a, c, g, or t
  misc_feature (308)..(308): n is a, c, g, or t
  misc_feature (323)..(323): n is a, c, g, or t
  misc_feature (346)..(346): n is a, c, g, or t
  misc_feature (368)..(368): n is a, c, g, or t
  misc_feature (371)..(371): n is a, c, g, or t
  misc_feature (377)..(377): n is a, c, g, or t
  misc_feature (385)..(385): n is a, c, g, or t
  misc_feature (389)..(389): n is a, c, g, or t
  misc_feature (393)..(395): n is a, c, g, or t
  misc_feature (418)..(418): n is a, c, g, or t
  misc_feature (445)..(445): n is a, c, g, or t
  misc_feature (459)..(459): n is a, c, g, or t
  misc_feature (463)..(463): n is a, c, g, or t
  misc_feature (490)..(490): n is a, c, g, or t
  misc_feature (511)..(511): n is a, c, g, or t
  misc_feature (525)..(525): n is a, c, g, or t
  misc_feature (535)..(535): n is a, c, g, or t
  misc_feature (546)..(546): n is a, c, g, or t
  misc_feature (561)..(561): n is a, c, g, or t
  misc_feature (563)..(563): n is a, c, g, or t
  misc_feature (565)..(565): n is a, c, g, or t
  misc_feature (569)..(569): n is a, c, g, or t
  misc_feature (597)..(597): n is a, c, g, or t
  misc_feature (610)..(610): n is a, c, g, or t
  misc_feature (845)..(845): n is a, c, g, or t
aggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtntccaggaaaccaaagtgaccagggatgcactgacagagcccctggcnancggggagggnnanaannccnangnnagcntcagccgcaaccgnagcggcnatgcnggngnagccaccttcngtaaggacaatgcnaccccagtggctgcngaagaaggcctgagtggcctgtntgccacccagaatggggatgtnggntgcganggaaacanggangagnnnacccaagaggaactccgggctcnggatagtgagggcagggccctcctcanacagcagaagagcngcanaggggaagggaaggagaagaccggganccgaagcaacggggagcggcncccaggcggacccngggaggcgcngagcggcgagncgggaagaggcgcgncnancggnggcggcaaatccgagcagaagccctccnggcggcagcatgntgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtgactggcgccgccatctnaactatggctcccggcttgactatgtgctgggggacagg

SEQ ID NO: 563465 - DNA, 124 bp, Homo sapiens
aaggatagtgctggtgctgcgtgagtcttttctgcatggggtacacacggccacacacagggcaggggaaagagctcagcttgggagtcggatctggcctcttcttccggtcccggctgtgcac

SEQ ID NO: 563466 - DNA, 166 bp, Homo sapiens
  misc_feature (73)..(73): n is a, c, g, or t
  misc_feature (105)..(105): n is a, c, g, or t
ggagctaacgactgtaatggaaatggcacggtatcagtacaacaagcaacagcactgccaccagcccaggatncaccagttctgcccacccagaaccacctccancctactccgagtcgtgggcaagaaacgagtcggggcaagaaaacgagtcgtgggcaagaaa

SEQ ID NO: 563467 - DNA, 198 bp, Homo sapiens
acgtgcgatcaaatgattctcctatcctcagcctcccgagtagctgggactacaggcgcccgcagggacgcccagctaatttttggtatttttagtagagacggggtttcacttgtgccagccaaagatggtctcgatctcgcgtgaccttgtgtatccaccgcgtctggggcctccccaagagtccgtgggcattac

SEQ ID NO: 563468 - DNA, 368 bp, Homo sapiens
gctctcatatgagttaaagctctacgactcctgagcaacttttatgtacctggcttacctagtgctggggcttgcaactaatgtacagaagccaaggagtccagatctagatagcagagaagtccgtctcattctaaaacattgcaactcctgttagagtccaccccatgaagctgtttcagatggtgtatctttggactggaattctataagtatatatagtccaggctaaaacaaatgtggctagctaggttggccgtgctgtctcagtaggacatggacagactccagcttacaccctctggcgaccttggacctacgctgccacagtgcattatgagccccgcaaggggttaccgagcatcgaa

SEQ ID NO: 563469 - DNA, 151 bp, Homo sapiens
agataaggaaggagctagagagtgtgagaagacagctccagtgctgcggtggcaaacaatcagatgttgagtctcctgaacaggacgaccggcggagaggctccgtgacacagcgaccacaggctaccgtgaacacggacgcgacgaggct

SEQ ID NO: 563470 - DNA, 202 bp, Homo sapiens
agtaggaaaaaaaatgggattttaaaactgtgtttgggccaggcgtggtggctcacacctgtaatcccagcactttaggaggccaaggcggatggattgcttgagctcaggagtttgagactaacctgggcaacatggtgaaaccccatttctacaaaaaaacaaaaacaaaaacattagccaggcatcgtggtacatgcct

SEQ ID NO: 563471 - DNA, 1080 bp, Homo sapiens
agcaacataaagacgaacgtgatcgtcaaatatgaacatcattgttgcattgtaatcggctaaaacataagctatctcggactacttgatctcaacatcaatcctaacacacgatggcagcactattgatcgttgatagaacctactggtaggtcatctcctaatgaatcgatctcatcgctaataggctaacggcagctaatgagtgatgagtgtgctaagcaccaattccattgatcctcaaagggtcgctcgtacggtcgccttgtgatatcgcacatactaagatatatcattacccatacgccatgcaagtctggtgcattcgaaagcaaatatgccctggactgacacgctcaaaccgtataacatgactggcctgcgatagttaatatattgcttctatctccgggagcccctggcctaacggtatgaacagttccaccttgccctcctacactgaatgcagtccttgtaccaatttcttaagtatactacctggtctgatgcctcaagaatatgcggtatcggactaagaccaggtcctagagctggaccccactttgttagtgtggctcaaactgacagattgacaccatcttgcaagagagagagaaacacatggatacagatcgattgaccaggcaacaccgggatcgcttgaagatctttcgccgaaaggaggagcgccatctccgaacactcgccaacttcaacagaagattgcgggccatcacctgggggcaacgtgacacccgaatgatggaacgaggcgccgtcgaaataacgacgggcctgagagggccacgaagaccctccacaatctaccctaggaagacacggcgaacacggggcttcactgcagacgacacgcacaagtcaggactcgttcccgtccggggccaacacgtcgccaggtcccgggcgcccaccaacctgcgccgccacagcgaccagcaaccgaacaatagggcggcgaagcaacccaaccacgccggacaagagacacagagaaaaccaacagacaccgaaacacacaaaaccaccacaccacccaccgcacgaaataacccaaggcac

SEQ ID NO: 563472 - DNA, 129 bp, Homo sapiens
cctccttaatagcgaaccacaggcatgtgccaccatgcctacctcagttgtttttgtatttgtggtagagcacgggatcaccatgtgcccaggctggtcttgaactcctgagtatgagtgatccacctg

SEQ ID NO: 563473 - DNA, 668 bp, Homo sapiens
gcggccctccttcggctccatgattgttcgccgatcttgttacctgttggggcccccctgtccggttcgctttatctcctgacgctctcgttccttctgccatcgcgctctgtctgcggggtgcgttccgctcctgcgcctccgcgccctccgagttttgtgtgtgcgtttgtgccccgcgccgcagtcattctccccggccgggggggcttccccggcgcctactgcattcagagcgtgggcgcccaactgtgggtttgacccgcgggtccccccacagagcaggttcggtgggctagtccactcggtggcgttttctctgcgcgcgcgctctcattggccggcgagcgtccgtcgggctcaagtgcgctgcgcttctctttgcgatttgtatttgcaactttgtgtgcgacgcgcgctccgcgcgtctgtgtgaagcagtcaatagatgggtgttcctcgtactgtggtggcactcctctcacgacaagattttccccggtcacccaccccgttcgtcccaagtatcccctagaggtgtccctctctttttctctcctccgacggccattacttgtgtaagcggtttgtctaggcggtcttctcccacagactgagccaaaccaaaacacaagaatttgcttccccgccacaacaatagtcaacaa

SEQ ID NO: 563474 - DNA, 358 bp, Homo sapiens
  misc_feature (25)..(25): n is a, c, g, or t
  misc_feature (64)..(64): n is a, c, g, or t
gagattcaaattagccccgaagttntgggttattggggcccaaaaaaaatggatttttgtaaanaagggtcagcccgagatttccgccgtttttagggcaatgggcccaaaaaggcccaacttattgttgggtggcgggaacttcccggcccctttaaccaagtggaagaccttgaaacgcgtggagggcataaccgggaaacaaattgagtccttccttaaggccaacattctgggttttgccgccggccagcggtgtggggcctcctgaccgttgtttcctcactccgccttttcaaatttttgtataaccccgtgttgtgtaaatacagtttttgctccggtgaaaaaaaaaaaa

SEQ ID NO: 563475 - DNA, 390 bp, Homo sapiens
agtgtaatgttactcttggaatagcatgctccaggattgccaagcggtgtctcagtttactctgtggccaggtccctactggtatatcgcttactatagttttcaagtagttgcagcttgaataacataaaataacataatataatgtcatttatgtgaatttcccacgtgaagaacgcctgtaaaccttgcagtattgaaactcagtgaacaaggcatcttagacaagctgaaaaacaaatggtggtacgataagggggaatgtggagccaaggactccgggagataaggtcagtcgctgaaggtacttttggtactgattagcaatcacattttgacccactgtatattttctaccctaaaacggctttccttccctacatcatcact

SEQ ID NO: 563476 - DNA, 159 bp, Homo sapiens
gcctgtggttaatggcagtgtgcctgcagttccagctactcgctgaactgagacagaagaatctgcttgaacccgagagtgaggttgcatgtgagccgatgatcacgccactgactccagcctgtgcgacagagccatgactccatctcaaaaaaaaaa

SEQ ID NO: 563477 - DNA, 1189 bp, Homo sapiens
tgggcccagcgccagctccgagtcccgacctggcccgcggcagcctgcgcctgcgccatggccacctccccgcagaagtcgccttctgtccccaagtctacacacttcccaagtcgccccggtcaccgcaggaagagatagattccattcttggcgaaactcggagggaccctggacccggaggaagaaagccaaggaggtgtccgagctgcaggaggacggacatgaacgaccatcaacctgccccctcagaccaatatccctaatgagctggaccccgagggacacgaatgctggaaggacaatgagcgtgcgaaacaaaggacgcgatcccagacatccaacgcagctgaaccccacaagactatcaaacgacacttgcactgacaggctatttcaaatcagaccctgggacttcaactgactgtagtacgcgattagcgacgacaacagacatgcacaagtagacacacgacacctagacttgagagcattctagggtacattgacctggggaacccaacagatcacatagcacaagacaccgcataatgtccacgacgaaacaacttagcggacgacagatcgacgaaacggccatacaacacatgatcgcgcatagcaagcgaataaccaccacaatgacacacacgaacgaacatcatggcatccaagacaacaggccacaacacgcaccgtgtgcacgacacacttggtacaccatagcgaaccacaacatgaaaataccacaacgcggaaacaaagcccaccctagagaacacatcgattcccacagtcccccaatccggaaggcccacatttccaaacaccggcatgggagaacaagtacgacatagcagaaatcataccacttcggataacacacactacgaccccaaacaataaacacgcatcactattacgcgatatgagcgcaacaacaactacctacttactatccaacacccccaattcagcaattaccacaacctactgcgcacacccatatagataccatcccaacgcgccacttattcatccatgcctaccaaaaccccaaaaacatatacacacgaccattcaccaacatcgatcccccaaatttattataaccacaatattcacaacgcaacaacgagatccacactaagaacaataccacaaacacacaataccctatcacaaatag

SEQ ID NO: 563478 - DNA, 1060 bp, Homo sapiens
  misc_feature (323)..(323): n is a, c, g, or t
  misc_feature (707)..(707): n is a, c, g, or t
gctgcgcaggagcagcagggccgtatgcatgacatggcgcccagaccggaatggcatggtcttgtaagccccacttcgcactaaggactggcaagcgggcagcgtggccaacaggtggtttcacatcgcaggccggctcctgtatggactcgctgcagacctgtaacggcccgcgcctggccaatggcgcgccgcattcagccccgctgcccctgggtcgggtcctcagtccggtcccagtcggtggcggctgcgcctcgacgagttcgtgttaccacaccggaatggttgctgcgtcgcgtggcctgccagggcttcaggcncgtgtaagtgacgcctcaggggtggccctggacatgttcagctaacgaataggctggcctcggatctcacctcgagcactttcatagtggatctccgagagggatggcggagagtcacagtccacgggaggtcccttgtcatgatcccagagcgatgtcatgctgtgcctgaatggacgtacacggatcctagaattcagtccatctttactccacacgggaaaggccctcggagccccctcaaagaaaggagatgagccagttcgttagctcgaagtgaaactaagatagagcgtggggtcatcgcctagggtttgacgcgggacccgggttcgatgccccggtccgggaacccgtctactcacgaacggacgaaaggctcgnagtcatcactgacgtgaacgagaacgaagtttcgaaacgccttcgcatagtctccgtatggcccgtgccaacgcccgggctcgttcggcgatacggggcaagaaatagagccaaggaagccgcagaacaggatgttgacagacgaaccacaataaagcccatcctgggggcacttggaagtcaagaaccaagataacacaaaaaaacgtcgggggcactctattaccgagggggcggaaaacgcgcgtcatgcaaatggtggcctggccacagggttccctggcccctttctttgtcaccggggcaatttgcgggctccctaaagtgagcgataaatcgataccggtactgag

SEQ ID NO: 563479 - DNA, 463 bp, Homo sapiens
ccccctttccgcccccccgggggggcttttttttttcccccaccgggggggttttttttgccccccccaggtgggcccccccccctttttggttcccctttccccggtttttgccccccccgggtttccggggggccctttttgtgggcccaattttttttggggggggcccccgatttcccacccttgttggttgaaaattgggttccccttgggccccccttttttttttgggaattttttcccccacccccccctttggggttttttgggggcccaaaggggaaatgggttgggtttaatttttggacccccatttttgttttccccccttttggttttgagcttttcccttgggttcccccctttttgggttttaaatttggggggaaaaattttttttggttttttttccacccccccttttttttttgcccccttttttaaaaggggtttaaattta

SEQ ID NO: 563480 - DNA, 347 bp, Homo sapiens
gagacagagtctcactctgttgcccaggctggagtgcagtgtcacaatctcagctcactgcaacctccgcctcctgggttcaagtgattctctgcttcagcctcccaagtagctgggattacaggcaaccgccaccacacccagctaatttttgtattttcagtagagacggggtttccccatgttggccaggctgttctcgaactcctgacctcaagtgatccacctgccttggcctcccaaagtgctgggattacaggcaggaactaccatgcctaaccctttcccctacctttcttttttggaacagcctgggtgacagagtgagactccattcccccgcaacc

SEQ ID NO: 563481 - DNA, 168 bp, Homo sapiens
ctctctcctagccgactggttctgcgcgaattgggcttgacgtggatgacgtgcacgcagctccagccagtcttctaaggaagccgtgaactctgaagaatatggctctgaccgtgcgcctggccgcagtggttcttctgatgagcaagggaactccactgagaatga

SEQ ID NO: 563482 - DNA, 334 bp, Homo sapiens
caggagtcttattggatagcggtggggtgcaggtactttgacccagccaaggaagtcagcaagaagccaccagcccgaatggtgacgctgccacgaccattctgccagctgatcctggaccccatcttcagggtgttggacgcgatcatgattttcaggaaagaggagacagcaaaactgatagagaatctggacattcaaatctggacagcgaggacagggacaaagaaggcaaccccctgctgaaggttgtgatgcgccgttgtgtgcctgccggaagaaccccttgtggcagatgatcaccatccacccgccctcatccgtttatccagtg

SEQ ID NO: 563483 - DNA, 343 bp, Homo sapiens
ggatccagcaaccgataccttgaccattaaaggcacgccgccgaatttgcgcgaccaattgcagcgccggacgtctggcggcaattaatcggttttgtgttcagaatgccagatgcggcgtgaacgcttatctggcctgcaaaaaatagcaataccgtaatcaggcataatctgcagatacaaaaaaccccgccggaggcttttttacaacttattcagcaattaagcgcgaacgaagtcgatgtgctgcagcttcggtttgtacgggcgacgctgtacgtcctgagctttaactttgatttctttaccgtacacgcatggtcagaacttcgctgtagaattc

SEQ ID NO: 563484 - DNA, 150 bp, Homo sapiens
ggcggatgcatggtgtggggagcggtgaaggggaagggacagacgaggtcagtactgtgaagccgaaggtgggaggcatttcataacatttcttgttgatcaaaccaccgtggacacccttctttggccaatcaagcagggactaggcgt

SEQ ID NO: 563485 - DNA, 1055 bp, Homo sapiens
tggagagtggaatgagagaagtgacccagatcagacctctacaagaagactcaggaaactctttacacaggcaggacagaagacttcagcatgcccatgtccacagtgggcatctgccatcagcaggaagcttggagacatgaggaactctgcgacccttcaagtcgtttgaggaccgagttgggaccataaagtctaaggttgtgggtgacagagagaacggcagtgacaaactcccttcctcagaggggagtggtgacaagcccctgtcggatcccgcaccatttctaagccatgatggttgcattcacccgactgacagagcacacgcaaaccagacctcagcatcacagaacgaagcatctgttcagcaggagacaagccagaccagggcaggatgagcagagccggaccatgaggacagtcctgacccatccacagcggagatgtggcatgccgcgtttgcatgaatttagaagaacacaggcttgtacacagatgttttacactcacgataagtagatgaaaacaggatcactgtgctgatcattccataagagaggtgcagcgaagtggacagggcaggaaggttaagcacaaaatatagagccaaagaccagagatcccttagcagactcaatgttagcccatcagactgttgaaggattgcacgaagtcataagaataaaatcagtggcatcaactgactactgaactcatcatccattccatgaatcaaagaaaggaatgcaataaaccagacaagtcatacaggtaacgaaagattaaaacacaaaatggcgacggagaagcggagcaaataagaaaaccagaaaagataattacctgtaaggatgacaaagatagaaaacaacttaagaaaaacaattaaatataacagactgcacattaaccgcatcacagcaacagattataaacagaaatatagcacaccgatatcacatcacccctatacaacaacagataaacaaaaagcacaaaaatacactcataactcacctagcctaagatattaacagacaaacacacaaatc

SEQ ID NO: 563486 - DNA, 370 bp, Homo sapiens
tgatcaggcactgcatagttatgtggggtatgttgtttcaatttgcaatcccctaatgtcatatgatgctgagcatgttatcatatgcttggcactcagttatgtttccctttccttcatgggcctgatggagctgtttctgattcaaagcaacaaagaactggcctacattgttatgcggagacaatcatgtttctacgactgacttgcgccgaacattcccttccatatcatctttcaagcagtgcatggagaatgatactacatgcccaagtatcatttccttatttgggatcctttcggcattagcaccagaacaatcggtgctaaaaacaataggaactaattgatgccctcccccctatcaaaa

SEQ ID NO: 563487 - DNA, 254 bp, Homo sapiens
cgctctaagattaaaaatgccctagcccacttcttaccgcaaggcacacctacaccccttatccccatactagttattatcgaaaccatcagcctactcattcaaccaatagccctggccgagcgcggagccgctagcatggcggcaggccgcgtactcatgcacctaattggaggcgccaccctagcaatatcaaccatgacccttccctctacacgtatcatcttcacaattctaattctactgactatcct

SEQ ID NO: 563488 - DNA, 553 bp, Homo sapiens
tgccacgatgctgccgcttaggactctttcactgctgctgggagcagtagcaggaaaagaagttggctacgagagactcggcctgcctacaggtgatgactcgcccagtggtcaggaatgtactggaaagaccaccatccatatattggcgtatgcgtctccaaatagatgtctaacacccgcttcctcctatatactaatgacgagacccaaacagactttcaatgaagttgccgcagatacatcgaaggacatcagtggctccaatttcgaaaacacaagtagaagaaggcgtcgctttatctcaattcgtggactcaaaacaagatcgccgaatctgaggaatccgagccctcatctctcgacaggtcatcggacaccagatcttgagggacgcgcatatttagcctcctgtaaggtcggtccactgcgtggtacagaagtaagcctggcataatcagggactgaggtatccatgccagagagtggatgtctcctggcatactgccaagaggttagtaagagaggctgtacgaaccaatggaaggtgaga

SEQ ID NO: 563489 - DNA, 101 bp, Homo sapiens
caggtagacctaacaacaacaaccgtattgctgttccccaaccttttcctccgaccccctaacaacccccctccgtaatactaactacctgtggttagagt

SEQ ID NO: 563490 - DNA, 914 bp, Homo sapiens
cccgcaacgactgcgttgttgctgccgacgatggagggggcggcagagaactgtcgccgcgaagggtggaggcccgcggtgggtagtaaataggtggggtgccgccgcacattgcgccccctgggcgaggcaaaggtgtggcgcgtgtccccgacgtagcaagcgggtgcgcacaagagtggggagttgctggtcccacagtgcagagagagagatgggtacacacgctggcggccgcagcatgagggagcgtagatatccggtcatgagagcagagggggcggcaaaaagcagcacgcacgctggttgtgtggggctgttaggaggcggcacagggcgcgcacgttgtgtggatagaacccttggagaagagggccccgcctgtgttggagaatgtaaaggggcacccgccagaaggcgcggcggtaggcgtattgagagggtgatggaagtacacaggaaccgctggttaaggcccccggggataaaatacaggccgcggtggccgcaccacgcgggggatgccccctctggatgaggggggccaccgcccgccgagaggtccatagtgcgtgcgaggaaggatgcacgcgcgaatataagatagtgtgtgggccggggcgacaataagggggcaccccctcgtggtgaccccctgctggagggaattggagcccccggtataatcgctcactgcggcgctgacgtgttgcctggtacaccccaggcggtgcacaacttaaccgggtgcggggacagtcagtatctgctgccccattgtttctcccctaaagcatgccagaaagtctgttgttcttctagaaaacatataaaaaactgatgttttgtgggcgagattggcgcaatgataatgcgaacttctccgctgtgtggaaaaaacccccaacataaca

SEQ ID NO: 563491 - DNA, 93 bp, Homo sapiens
tgagcccggaccagcggcgccttttttgtctttttctgcccatctgtctactaataaaatgtgaaataaaatacctgtattgctcttcccatg

SEQ ID NO: 563492 - DNA, 827 bp, Homo sapiens
  misc_feature (1)..(1): n is a, c, g, or t
  misc_feature (286)..(286): n is a, c, g, or t
  misc_feature (380)..(380): n is a, c, g, or t
  misc_feature (505)..(505): n is a, c, g, or t
  misc_feature (511)..(512): n is a, c, g, or t
  misc_feature (514)..(515): n is a, c, g, or t
  misc_feature (517)..(518): n is a, c, g, or t
  misc_feature (520)..(521): n is a, c, g, or t
  misc_feature (560)..(560): n is a, c, g, or t
  misc_feature (565)..(566): n is a, c, g, or t
  misc_feature (569)..(569): n is a, c, g, or t
  misc_feature (573)..(573): n is a, c, g, or t
  misc_feature (575)..(575): n is a, c, g, or t
  misc_feature (579)..(580): n is a, c, g, or t
  misc_feature (582)..(585): n is a, c, g, or t
  misc_feature (587)..(588): n is a, c, g, or t
  misc_feature (592)..(592): n is a, c, g, or t
  misc_feature (601)..(601): n is a, c, g, or t
  misc_feature (619)..(619): n is a, c, g, or t
  misc_feature (628)..(628): n is a, c, g, or t
  misc_feature (630)..(631): n is a, c, g, or t
  misc_feature (639)..(640): n is a, c, g, or t
  misc_feature (644)..(644): n is a, c, g, or t
  misc_feature (649)..(649): n is a, c, g, or t
  misc_feature (651)..(651): n is a, c, g, or t
  misc_feature (657)..(658): n is a, c, g, or t
  misc_feature (662)..(663): n is a, c, g, or t
  misc_feature (665)..(666): n is a, c, g, or t
  misc_feature (673)..(674): n is a, c, g, or t
  misc_feature (676)..(677): n is a, c, g, or t
  misc_feature (686)..(687): n is a, c, g, or t
  misc_feature (690)..(691): n is a, c, g, or t
  misc_feature (694)..(695): n is a, c, g, or t
  misc_feature (703)..(703): n is a, c, g, or t
  misc_feature (708)..(709): n is a, c, g, or t
  misc_feature (715)..(715): n is a, c, g, or t
  misc_feature (717)..(721): n is a, c, g, or t
  misc_feature (723)..(723): n is a, c, g, or t
  misc_feature (725)..(727): n is a, c, g, or t
  misc_feature (730)..(733): n is a, c, g, or t
  misc_feature (737)..(737): n is a, c, g, or t
  misc_feature (740)..(740): n is a, c, g, or t
  misc_feature (759)..(759): n is a, c, g, or t
ntaactaataagcaggagaaaatgggaaaatacatggagcagttctcaaagtatacaatggccagtaatatttttcatggtcagccctgacagtaatacaaataaaatccaaagaaaaatgacatggcattttttgttactgtattttgggcagtattaaaaacaccagcaatgccaaaggtatatgggaaatgggttcttttatttcttggaatgtaaactggaactatttctggaggaatagagtagcacaaacaattcagttgtctctacaaaagatgctatntacatttccccctagcttttctattatgacatgtaccaaattgtcacaccattcaagcacctgtaggaaataagagtttaaagaaacaaatgtnacagatgagttctagagtgctctaagaagctgatttaaagaaaagattaagcctccacctagagttttatttttattttttgggatggagtcttgctctgtcacccagactggagtgcagtggcntgcaanntnnanntnnatgggttcaagagattatcatgcctcagaatagagtagntgggnntanaagncnctgnnannnngnntggntaatttttntattatttttaatagagntggggtttnannatgttggnnagantgggntngagttnntgcnntnnggtaatnnanntgcctccgnntcnnccnntgtgggtnttccnngtgtgngnnnnncngnnncgnnnncgcnctncgcgtctcgaaagtatganagaaataaattaatgtagaaataaattttgaaagagattgattaaatttttttttttttttttaaatt

SEQ ID NO: 563493 - DNA, 620 bp, Homo sapiens
  misc_feature (620)..(620): n is a, c, g, or t
caactattatatatatgagtagtttatgtcttcataaagtcagcagaaactcgtattgaaaaaaatatatatccccaagtgaattactttataaatgccacatgacaagggagctaacctatgacctacattgtccagcataccggacaaatgatacatggagaggctcttatctatttatatacctataccaacatattgcacttggtccatcaagtgcttgcataatcattaacggtacaagttaatatggtaaaccccatgggaaaataggacagtccaaccgatctcctctggattggaaacgaatctactgaaggttggaaagggtcctcgcactgtgggacaaatagaggcccattccgagggggaagcatacacacactacttctgtggcagaagttgacttcgtggggcccgctccccccgggagggaacctttcccagactaggaccttccaagtatagacaaagcggttgcacatacccagttcgcgaccaccacttttttccagtcactctggaatttcctttctagcatactggaccacccaatggtgacccgccgaatgttcccgttttcgtatgcctaatgcctgaatcccgcaggacccacgatn

SEQ ID NO: 563494 - DNA, 227 bp, Homo sapiens
gaaatcatctaatgataaaatggtgacgattcagagctctgttaccgtggtaaagatggactcggaggggaaggggaactccgtgtcccctgcaaggttttcgctggtacgattttccccttgagatccctgggcttgctgagttcttcttggtgttagaaacgttgttctctcttcagttgttgcttgccccctccgcattctcctttcgctcttggcgacacact

SEQ ID NO: 563495 - DNA, 138 bp, Homo sapiens
ctcttttcacaggggaaggggctggatctgaccatagaattggcctggaatggcatggtgggagagctggtctatggaagagcagatgtggctgtggctcccttaactatcactttggtccgggaagaagttatagat

SEQ ID NO: 563496 - DNA, 174 bp, Homo sapiens
ccgaaactgtcaagattggcaaggttgattgtacacagcactatgacctctgtctccggaaaccaggttcgtggctatcccactctaataacaagaatcgagatgggaaaaaggtggatcagtccaagggaaagcgggatttaaagtaacttaagggagtaccgtggagtctca

SEQ ID NO: 563497 - DNA, 125 bp, Homo sapiens
ttgctaacattactttatattatattacaaaactattgtagcctcaaacagttagcaagatggtatagttaccaagtgccattttggaggttattgtgtaccgatcaatctctatataaatttgg

SEQ ID NO: 563498 - DNA, 276 bp, Homo sapiens
atagaaaaagaaggggacagacagagactaactcatgtcacacggtgatgtgtgtgcacttacccacggaggacactatagtgccacgttctccagcgtcacatcacggtacaggcatctctgaaccttcactaaggagattccattcctcctgggtaaatttcacagccacgtcttcaaaagtcactgtgccctgttatgatgttgacagatgaaaccacaaaccaaccctatgctgaggtatcacaatccatctctcccacagatcacctcgtg

SEQ ID NO: 563499 - DNA, 601 bp, Homo sapiens
atcccatatagatcactgaagctggcataccgtcaaataagtaaaatctgacaaaaaaatcaggccgggcacagtggctcacacctgtaatcccaacactttgggaggccgaggtgagtggatcacctgaggtcaggagttcgagaccagcctggccaacatggtgaaacccatctctaccaaaaataccaaaattagggctgcgcagtggctcacgcctataatcccagcactctgggaggccaaggcaggcaaatcacctgaggttgggagttcacggccagcctgaccaacatggagaaaccctatccctactaaaaatacaaaattagctgggtgtggtggcccatgcctgtaatcccggctactcgggaggctgaggcaggagaattgcttgaacctgagaggtggaggttgaggtgagccgagatcgagatcatgccattgcaccccagcctgggcgacagagtgagactctgtcttaaaaaaaaaaaaaaacacacacacacaccaaaaaaacaaacttctttgggttattctgattctgtatattctttcttttctcctattcttttaccatttcattcaggcttttgccccc

SEQ ID NO: 563500 - DNA, 120 bp, Homo sapiens
tatgtcaaaccaagtcacttttaactgtgcttattatggcttgctgtttgattggtgcttttcctttaatcattttggtgccaggtttcctatcagtcctttcatgtcctaatatggttg

SEQ ID NO: 563501 - DNA, 222 bp, Homo sapiens
attcgcggccgcgtcgacaacgattttaaaaaataagtagtgctatggatggggctataatgctaacctttgatagtaatgagaatgtattacatcttactttctgaatagcgggatgaatttatgaagggattattagcaatggaaagattggtaatggtattaagttatatgtgtctaaatattatattagctcatttctcttgcattaatagtactgct

SEQ ID NO: 563502 - DNA, 217 bp, Homo sapiens
  misc_feature (79)..(79): n is a, c, g, or t
gagagagagagagagagagagagagagagagagagagagagagagagagagagattggtctgttcatgttcgtttgttntctctctcaagacatagggtcttgctagtattgcccaggctggtcttgggactcgggcctcaggtgattctcccacctcggcctcccagggtgctggaaaggcatgagccactctgctggcccgagaccctgtctctt

SEQ ID NO: 563503 - DNA, 138 bp, Homo sapiens
accatcacagaatgaagagaagccctttagatgagcgtatacacccgcttactatccacttcatgatgacactgttctactaactggaagtgagaatttttggcttgcttatttgaccaacgcagaggaaataattgc

SEQ ID NO: 563504 - DNA, 267 bp, Homo sapiens
cctcgttctgcttcttgcaaaggacgtatagctgttctctatcagcctctattttataagcgatttgaaattattatttgcaatttatgaacctacggaagaaagactgtgaatagaaaccagattaagaagataagatttcggatgaattgaaagaaaaggcctagattgaagatgataacaaggatgatcgaataatgaagacccccaaggaatacctgaatttgggttcactgttgttcacgaatgttgacttgctaccgtgac

SEQ ID NO: 563505 - DNA, 81 bp, Homo sapiens
ccgggctgccctgtcactcctctaacacttccctcccctatccccaacatgccctgtaataaaattagagaagactaacaa

SEQ ID NO: 563506 - DNA, 110 bp, Homo sapiens
tgatattgtgcaggcaggtagggaaatttctttgtacaaattcatgtccctggccatgcatggcccaggagttcaataccagcctgggaaacagagtgaaactttatctc

SEQ ID NO: 563507 - DNA, 141 bp, Homo sapiens
tcacgagtatcacagctacggctcccgaggtgccgggacttgcagacgatctcgttcatcagtgctcaatggtgcccaggctggagtgcagtggcgtgagtctgcaatcgcaggcatctcggacacgctgtggtggatcct

SEQ ID NO: 563508 - DNA, 141 bp, Homo sapiens
attccagtagcctgcagagagagacgccgggtccagcagacagcgtgagggctgccccggggtgagctggctatggtgacgcacggcttcattccactccaccatcctggcgtttctcggtagagcagactcgctcgtgga

SEQ ID NO: 563509 - DNA, 816 bp, Homo sapiens
  misc_feature (249)..(249): n is a, c, g, or t
cgaggtcagattagtccctcccggagggggcggactcccttatgtggggggcccccgaacggccccgctccgggtatgtggccccacccgccggcacaattcaggattttctctcttgatattgtattctctcgcccctcgggggttaattcacgcttcacgcccggggtatcggagtagcgctcgcactcgactgtcacggcatcgtctcgcgattatggctcgcgtcggtgctcgcaattgcgcgcnacgttcagcgcatgctctatatatactctgcgcgctctctcttccaaaagaggcgcatctctcataacgctctattattccacacacccataagagagcctatttttaggaagcactaagttcatttccggcaccatcacggtcttcttaagaattcttactggctcactcatcaccctccctcacgctctcctatttaatcctccctctcggggggaacacctcatcctcatcttatgtttgctaagcccccctcttgtcctcgcggttcccaagaactatcacctcttgacctatctccacgactccgcacaaattatttggcctcacccccaaaatcccctttcacaatagcatttttccccgcccctcacgcctattggggggtccaaccccactcacctccctccactcttgtcaacacgacataacctcccgctcttatgtaaccacggaggtctaccacccctcactcattctttagtacccccttatgccccccagtattgttccccattgttcacctcatcaaccccaatcattccggggtttcccctctacataaca

SEQ ID NO: 563510 - DNA, 137 bp, Homo sapiens
cacccgacgtgcgtatgacctgtacgcggcacgcaaagccggtctgagatgcgaggctgcggactttctatctgaatacgccaccgaagatatggaccttgccggaatcgcttcgatggtggcgtgcacgccggatg

SEQ ID NO: 563511 - DNA, 501 bp, Homo sapiens
agcaagaagagcgcgggagacagtgataatgaaaacgtaagcctcaggctaatttccccatagccatggggcgaattcccgggtcactaaggcaggcatgcatgtggggatttcctttaccttttctataagtggtgccaaaacatccacttaagttcttcgattggtaccattccttcaaataaagaaatttggtaccaaaaaaaaaaagaaagaaagtggtcggtagcaaagctattacaggacagaaagggggtaggtgggtcgaggcggtcactggcactactcatcactcacacggaggtgactggggaggagccggggaaggacagaagggagtcacagggagctcatttccagcccggctaaaggggagggagaaggtggccatctctggggacagctcggggcttctcaggtcctccctttggacctctgtagtcctgccaggcccagattatttggctcacttgttgcttgctctccagaaatatcaggggg

SEQ ID NO: 563512 - DNA, 130 bp, Homo sapiens
tggggaactttggtaattttgggttttggaaatactttaaatattaagttggttttaaaattttggcccttttttggctcttttaaaattttgtacaaatattatcaacaaaaaacaaaaaaagcaagag

SEQ ID NO: 563513 - DNA, 493 bp, Homo sapiens
  misc_feature (256)..(256): n is a, c, g, or t
  misc_feature (266)..(266): n is a, c, g, or t
  misc_feature (269)..(269): n is a, c, g, or t
  misc_feature (276)..(276): n is a, c, g, or t
  misc_feature (333)..(333): n is a, c, g, or t
  misc_feature (453)..(453): n is a, c, g, or t
ccaagttgagagataagtgctctctcatctatgcacccattactccatcatattatcccatgtaccatgctgggattgtctatctccacctctgattttccccaggaagggctctccaagataaaaacctccccttcagattgtcttcaaccagccagtgctcccccataacaaacaaggctctcccacttttcctctttctctcaaaggccaccattagagcagtgcaactcactgagaaatatcctgcaaagantaaaggcccntcnccccttntagagaaagcaaaacatggaacaaagaaggaaaggcttctttttttttcttctattntattagccccctcattttcaaaggcaccattgtttcaggagaactgagtattttttaaaataaataaagaagtgaatacaatcttaagattccaacttattaacagaaaacatgtgtagncctaagaattaaaaataaatatgtctttaaagatgaaaaa

SEQ ID NO: 563514 - DNA, 1098 bp, Homo sapiens
ggtcgggcgagcgggattgctgcggactgcgctgcgcggcggcgccgaggttgctgagtcgcgtgctaagccccggactgccctgccttgaggctgtgctgtggggcctgcggtggccctgtaccacgacggtcgcgtgcggcctgtgctgcgctgggccttgcgtgcctggtgagtttgggctggcagcatcaagctctcgatgctacgcggtgcctgcggagcccgtggtcggcttctggtgtgcgcgttggatggctggtgctctgatcagcgtcgtctactagcctagccagaggtcttgtcgggactattgtccctccaacgcagctatctccagagcatggcgctatcacctaaatgcgtgtgtccacttgtggactctgctccccggctgccagacagcacacattaatcattcgctgacttaaccgtgggctggctattctcggacctgagatgggcaatagaaatatcggaagagagtcctgactggcagaggccgagctagtgtgctacctgtgtgtgcgggactgagtggggcactctgggaaacttgggttctggagcgcttgcagtgggccctccacgaggtcctgcttgtcagtcctccgttaagccgggatgatggcatgagggtccgccatcaagtccctggactgatgagggaaggcggatgcttgacttcactagcgccttgccccaggcagttgtagtgggaacttgcgccactatccaggagaggggatcggttccccggaacgcgtgcgagcccttctcttggagcggttgtggcttgttgttctaatcaaagtaaaaccaggaccatttacttcgccgaattgaggggttgaaacccaacgaaacgattccatgaaggggaaccccccagtgacgggacttctttgctcggagcaaagggcacagaagttggactcccttgaaagggcggatcccggcggaggatactaccgttcaacggttggccaccggcatatgttggtttgcacaacctgtgtgaaacttatgggggactttcccctttaagagacgccgtgtccctattcaactctgggaaacaccgttgatcacgcgcta

SEQ ID NO: 563515 - DNA, 429 bp, Homo sapiens
atcccccagtacgtcaggctcgctgtggtacacagctgagacggtacagagagggaggttgaggacggagaactccatcttcaatttcgggctcatgacgttcccatattgagaaaggcgcgccgtttcgcagcctcgtctgtggaacgcccctggggtatgcgttaggaaggtctcgtcccagccccgagtgacaggcaatgggctttaaaagctaggacatggtgatggcgtggagggggtgagggtgagtcccacaggcaggcttcactcactgagcacctttgtggcacttcgaggacttctaagtcctgggcattacaacaaccttgcccttgccggctttcaggggaatggggcctaatgaaggggagttacctccattaaaacgtcaaagaaatcaacggtccccaagtctcctttcacatg

SEQ ID NO: 563516 - DNA, 984 bp, Homo sapiens
  misc_feature (436)..(436): n is a, c, g, or t
ggggacagagggtggctccggccccaggtgtcgtgaagaagcaggaggctaggagagtggtgcgtccccgtgtgtgagaaagggcctagcgacattttggcctgggacccgggacagtccgagggccaaagagagagcctcggcccagttattgatgatcctggcctccgcgtactactcagggttgcgagcgaggatgagacgaccagtcccctactagggcgtgctgagaagttgccgtccgtgcgatttaaggcatgttgcaacgcagcgcgcctaggtaccgcgcgaaagcatgctgactgccacgtaggctgtaaggctagggcaccactagagtgacgagaacgcgagagtacacagagacagagagtacaggaacgccaggagcactcgtatggctcgcgggtccggagcagagtaaggtctggctggngcgaacaggggtacgctgccagatcgaagtagacactaccgtgctgcattgcgacgccagcgatgttaagcgagccgtgcagccgaccttaggctgcgatgatacacaggagaacgctcaggctgtgtgggtgagttggacacagcgatcgctgtgatcgccatgcgacgcatggtgtgtcgttcgttggccatgcgcgctcgtgctcagtaagaagttgggcggtgcccttgacgtgcatttgattcagagggagataggcgaacgactggaggacagtcgtaaagtcgcaccaggaaggatcctgcaggcaactgtgcgggcttcagcgacatggtgaagcttcggatagaccatgagggcgcattaggcgtaaggctggtggaaagctatcagtgaccgaattacaactgacctgatacgagtgcagatctcgccggcgactggggtggcaactgtcctgggatcctaagtctgtgggtcgtatcgccaagctcgagaaggcaaagggtccagaaactggccagttaaactgggttaactgttca

SEQ ID NO: 563517 - DNA, 393 bp, Homo sapiens
gggagtaaacctctatgatttctgaagcaaacaggttaagccttgcccctcatatacattccgcccagttctccagcaggttagccacagccctggattgaacctcaaaagcctaggtcttatccacgctgacttttaaagcagacaacatcatgctggtggatccatctagacaaccatacagagtcaaggtcatcgactttggttcagccagccacgtatccaaggctgtgtgctccacctacttgcagtccagatattacagggcccctgagatcataccttggtttaccattttgtgaggcaatcgacatgtggtccctgagctgtgttattgcagaatcgttcctgggttggccgtaatatccaggagcttcggaccatgatcagatt

SEQ ID NO: 563518 - DNA, 262 bp, Homo sapiens
gcccagattaggttccaccgcctcgcctcctggcgtgtcagcgagtctcctgcctcagacttctgaatagctggggctacaggcccgcgtcaccatgcccagctaaattttctttgtagttttagtagaaatggggttccgccatgttggtcaggctggtctcgaactcctggcctcaagtgatccgcccaacttagcctccgaaagtgctgggattacaggcgtaagccatctcgcgtattgtttttttaataaagtaatt

SEQ ID NO: 563519 - DNA, 343 bp, Homo sapiens
aggctcgtgagagtataggacgatgtgctggacaagatgctgtagaggcgggaatccacttcatgtatctaccaaccaagcaccgtgggaggcagtctcagactcgatgaaacgactacaaagtgccatgacagaaggtggtgtggttctacgggaacctcagagaagctatcaataaatggcacccttaattgatttgaacatgtcaatatacatctgtcagccactacagggcatcagaagagcgcgtctggaagcacagccagcttggccgttttacagcactaatgttgcagtggacatattatttgtcgttaaggtcctcctcctccccgggatacag

SEQ ID NO: 563520 - DNA, 412 bp, Homo sapiens
cccttgagtacccttctccgcgtaatcgatgatctgtttcttgccctccacggtgtctccagagttcacagtgaaggcttctgagtggtacaccttttaagcctcgtccaaagtcttatccactagtctcaggccctcgctgaggaacagtcctttgccggtgttcagctgaacctgcctgtctggctggttaagggcacgaagcagttcctgaacgctttcatggttatgagcccccggaatctcctgtgaggttgaaattcaggccctccaggttttcttggtaagtgtcagctttggtccgcagtgatagcattgcaaaggttgtagcgatgctcactggggagaaaaagatattggatctgttgcactggtgcgacagctggcggtatagtctggagtcgatctctct

SEQ ID NO: 563521 - DNA, 314 bp, Homo sapiens
tcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccagggaggttgaggttgcagtgagcagtgtttgggacagaaactctgtgtcaaaaaaaaaaaaatttttttttttgaaagacagcacaggtaaattgtttaaaatagggcatcttgtatttattttaaatttaaggatttatcctttccagacacaaattttttattccact

SEQ ID NO: 563522 - DNA, 223 bp, Homo sapiens
tgtgtggccttcctacacagtatacgggggctccctaatagcatatgggggcttctatagataatcattgcgagcttcctacacagcactagggaggcttcctacagcactgggagatctcctataatgtacatatagagggctttctacataagcagtgtacaggggggcgtatcctcacagcatggagctacctggtagtcggagtatcactatgaacaag

SEQ ID NO: 563523 - DNA, 127 bp, Homo sapiens
ggactgtagatgtctgaggagaatggtgtgacctaggagtcagcaccttggtgaacaagaggagtggcacaaggccagtggtacctcgcagaggggaaagcaggcattacaggatagcatctcccag

SEQ ID NO: 563524 - DNA, 373 bp, Homo sapiens
  misc_feature (61)..(61): n is a, c, g, or t
  misc_feature (73)..(73): n is a, c, g, or t
  misc_feature (129)..(129): n is a, c, g, or t
  misc_feature (166)..(166): n is a, c, g, or t
  misc_feature (290)..(290): n is a, c, g, or t
  misc_feature (335)..(335): n is a, c, g, or t
  misc_feature (371)..(371): n is a, c, g, or t
ggaattgagttttaaagttcccctattgccagccttatgtcttaattgaattcatcttcanagaagctgaaanagttttcaaaagaataactaggccgggtgcggtggctcacgcctgtaatcccagcnctttgggaggccaaggcgggtagatcatgaggtcaanagatcgagaccatcctggccaacatggtgaaatcccatctctactaaaaatacaaaaaattagccgggcgtggtggtgggcgcctgtagtcccagctactcgggaggctgaggcaggagaatcncttgaacccaggaggtggaggttgcaatgagtcgagattgtaccnctgcactccagcctggtgacagaatgagactccgtnta

SEQ ID NO: 563525 - DNA, 1239 bp, Homo sapiens
cttgttctgatgtcttttatccctactgatagttcctctttctcattatagcaaactaaccagagctccagggacagcctgaatgatctcagtgcctcaggctctgaggtactcatgcctcacaggaccccagacagatgcttgtcgggttataactccaaaggcttccttatgtagaactcttctgtagaatgttggcaggtcacgagcaagatgttcacactgttgtcaatcctgagagaatttcagcttctgaagtgatctaggcatgttcgggtacaaaagtgatgctaaagttgagtaggtgtccttattttataagggaaaaggacgagttgatgcaaaacaaagttcgaactcttttgagagggggtcattttgcagaaagatctctatttgaatgatgaaaattgctcaatgtctctatagggcttttaatttgtgaactaatttgggtagcggatcactataagttctactagtttttagaattatttaagtaaatgtgcaatacaatctatgttccggcgtccctatggcaagatacctagccgagagcaatcacgtttgcccttggaccctagtcccttgttgcaggtccttcactgcctgatgcagggggttcatcaatggctcaggccactttgtgaaagtgaaggttggggtataaccggccatggaacgcctagaactatcccgatactgtcgttccctagtctctccttcctcgaataccaggataccatcttctaattggggagaactcacgttggttcattcttccctacatgtaggatagaggtgatggtgcctaaagtaggttgaattgggtctcgttaaacttggtggaacttggccctcaagtctgttcaagtctcattgttgacttacaggtaattggcttacccggcattatatttgaagtggttggggactaaaggcattggaacacttctttacaggacttggtattcaaagcattcaaattccccaaacattttaaaaaagccattctttgcgaactgctatgttatattctcgccctttcccacaaacttaaagaacaggattccaacgggcatggtaattcaagaaccacaaagccattatttgtgggctgggccctctcaagttcccttctgggacaccccattatttacgggaacacaatcgggcctgggtcaacccaaaaggcaaggaaggcttgggaaccatttccgttaagaccctttcttcgca

SEQ ID NO: 563526 - DNA, 1522 bp, Homo sapiens
  misc_feature (174)..(174): n is a, c, g, or t
  misc_feature (1225)..(1225): n is a, c, g, or t
gcttacctcgaactcttacgctggtcgcgtggacggtaagccgtgtgacccggttgtctgcgtccgtgtcgccttcggtctcactaaattccactaagccactatgtcgtgagtgtcatctccatccacgttgtgcccaggcatggatgtctccgagattggtgaatgccttgnctggcgaggctctagctggcctgggaagcgacgggcatccaggcagccgatggacctagatcgcctaaagtgaccaaggacccatgtggcggcggacgccgagatgacttgccattcgaacgacactttgctgtccagatcgatggacggtgcgcctggcacaaggccacgttgccaccgggtggcttgtatgtctctcgtaagatcttgaggaaaccccaacagatcgattgaatgcatacgatttcgcacattggacgaccttatcctgtcgcaagtgtactgtgccaaccccttgaggcaagcatcaatacacaaggccaaggcgaaagaattgcttggcaccaaattagagctaattggcgcacgaagggacggcatcgtaactagcccgactatgggtcgagagggacgactcgagtattgagacctttgatgttttgggacctccgaaagtttctgccaaatgctgtgggatgaaccctaggtggcagcctgggttcctttcatagggggcttgtctttgaggtatttcccaacaggctttttgggttggggggacacctggttactgggggtttcaaccttccctcttggcctcatgggcaacggttctcctcaaggttcgattaatcgggccagggaaaatccaaagctgggatgtttctccagagtttaacccggggttacccccaggatttccaaccaggctggttacgtttgaaggcgccgttaccagaaattccgattcccttcatcgaaacccagtagcgaacgcctgggaagcaacttcttggacttggtgggcctttcactgcgtaacacacattggaggggcaatcctattggagaatctgggttggttgggaagaccctcggagtattcgaaagggggcaaaacccttaaggaggtaaaacatgtaaaaaagggacttttttgttaaagggccagcaactcggtggtgtatcttcccacataaactgtgctaccccgtgaagagatattggaatggtgggcccccgtgaattgtttagacccggtcaagaaganttcccgagagaccacccgggggggggcccaaccacccgcgagactcactgatgctctggtgggacaattgtacccgacgcgggtaattctgtctgcgtgagaaaaaacaaccacgagaatcagagtttgtgctgtgcagagaaacacaacacgcgtggttggtggtcctccacccaacaccagtcgtgcagtgtagtccgcacccagctgccagtaagtcattcagtctaagatacgagatgctgacagtaccgacagtcagtggtagcaccactaaccacagacgtaagtagttgt

SEQ ID NO: 563527 - DNA, 266 bp, Homo sapiens
taggtatcagtcatgagtagccctggctgctccacccactcccaggtagaccagaagccttcatacatctcacgttgggggacaacaaaagggggaagggggggcacgaaggctcatcattcacaataaaacaaaataaaaaagtattaaggcgaagattaacaaaatttagcattacataatttacacgaaagcaatgctatcacctccccgtgatgtggacattgcgcaccaggcgataggagaatccatctagaagtcgacca

SEQ ID NO: 563528 - DNA, 662 bp, Homo sapiens
  misc_feature (2)..(2): n is a, c, g, or t
  misc_feature (21)..(21): n is a, c, g, or t
  misc_feature (25)..(25): n is a, c, g, or t
  misc_feature (31)..(32): n is a, c, g, or t
  misc_feature (48)..(48): n is a, c, g, or t
angacaggatcatttactgangctnacttanntagaagttctcatttncttttcaaccagaactgggctaagaaccctaaaaagggtttaataccggaaggggggggagggggttttttggtgtttttttcccaaaggggccttctcaaaaaaaaataccccaccaaccttttggggggggggggttttttttccaccccgccccgcaaatttatctccccccaaatttgggcccccccctcttgtttataaacccccctgtgggagggggggggttttttattttaaaaaaacccccccccccccttttttaaaaaagagggggggccccccctcttttttagtaatggggggggggctcctctcccttcttctttttttttttttttttccgcacaacggggggggccaccaacacaccccagggtggggttgggggcgccaacacacctccccttctgtgaggaaggaaagaacactcctccttttttttttttggggggcggggggctgtgtttttatataaaaaagaagcaacaccaccccccccccccgagggggggggggggtgtgttttttaacccgccccacacacccttttttgtggggagaggaaagatatttttttctttttgagtgggcgctgttgtcggcgcttctcc

SEQ ID NO: 563529 - DNA, 293 bp, Homo sapiens
cgaggccacagccctgccccagcctcctaccagcacccctcactttgatctgtggcatctgggggcgttttacagccccgtgactgtgctagaaggaaagcgggagggcaggacctctggctcacaggagtccaagacacagagccagcatttgaacaatgactgtggtcccctctgatttagacccactgtgcgggcgggaaagcagaggcctggtaatgcccctgggccagagctggggaaagcacgactcactgtgctcaggataggggactctgaagcctcttctcctt

SEQ ID NO: 563530 - DNA, 983 bp, Homo sapiens
tcccaaaaagggatttttttttaattcaagtaactgcaaatagaaaacaaaaaggggacccccgggtgggaacaactatgggttacccctcccaaaaaaaaaggggggaggggtgggcccttaaccctttaagggtcatttgggcccccctgtggcacactcgtggatgcggccattccttaggggcggggccccacctttcccgcggggaggggggtaggctcggcgcaccaagctcgtgccgatgcccaagccccttcttccccaaaaaggagtcatctggggggaggggactcggggcacaaaaacaggagggcaagtgaggaatgacctgttgggcgcgtggttagcacaagcaagtgagggagtgtccaagaagggaacttggaacaaaaaacacccacatgtgtggttccaaaggatagcttggggacaaccgcggaggaaaaggtggaaccaacaaccttgggggggccaggtagcaaccaggaggggggttgggaaccggcacagggttgacctctgtgttaattggtgtgccccatctgaggggggggaaatgtgcgtgatgtggcggaaacaagtagggtttgggagagcacagccagagcccacttcggggttgggccaacagggctggggcctccactggaaccaatagtgatctgcttttcatcacacaaaatgtgtttcagactccagggaaggcgaggcgggtgtggccccaggtaaacaggaatggggacttaccccgtcggctttagtagcaaggggttgtcaccaatagggatgggagtggcaagataaagggcccgttgacacaaaagtgctggaactggggcaccccaatggacctgttccaggtgaaagggcacgaaaaggtggcataggagaccgcccagacataggagagcccaacaaatcaatgagccaggaagactacagtatagagagcctcctgtgtgttgctgttctggtggaca

SEQ ID NO: 563531 - DNA, 172 bp, Homo sapiens
cggtacgaggcccacgtgcaggtgcccacaaaagtcctcctaccctgagaccagcacaacctaggaaccctgtcaaaagccccatggaggtgatttcacaggccccctgctatggcgcctgacacacgggggaagccacgcacgagtgagtgtgttgggaacaagccccaca

SEQ ID NO: 563532 - DNA, 244 bp, Homo sapiens
  misc_feature (197)..(198): n is a, c, g, or t
  misc_feature (233)..(233): n is a, c, g, or t
tgggcgagagagggagacactgtctccaagaagaaagaaatcccagcggtagatccaaactgtagacactgtaggcttcgtccgttatagtatgtcaggcagctaggccgattgacagtaagttcatgatccgtggcgaggggttcgagcgaatcagtggcacggattcacacccatgaggacacaggtcatcatgnnactgcacgggacaactttggcatcccaacacgtcntgtgtcatagc

SEQ ID NO: 563533 - DNA, 504 bp, Homo sapiens
ctcagagaggctccagcctcgctggggaagcggtggagtcaggacagtccacacgtgcgtggtttgcactgagctgggtttgtcagttgttatggatgttgagctgagtggcactgtttggaattggagttgtcatgtactgttgtgggggtatctgtaggggtgttgtcagggcctctgaacagtgcatgtgtggctggctagggtacggacgtgtagctgtccagaacagtgttgtaaggcagtaggcagctcctggccgtttgggctgctatcagatgtcaggttgtactgggaccatccggtggtgtttaccggctgtgagtgaatcctggccatgttttgggtgcctcttcccttctatctttgtacagaggggggccccaggacacctggagggaggtctcctgtcttaatcagtccctccacaggtaagcaggcaggcaggctcaagccccctcactctcagtaattttaccacggtgcctaagttcagagccaggt

SEQ ID NO: 563534 - DNA, 188 bp, Homo sapiens
tattaatcgtcggcgaacaagatcgtctttcttcttcctctcctctccaaacatcttaagtcattgaaatctttgtctctaattttcactccccagtatcaccaaggctgtgaagattctcatatccaatggaccatttcagtgttcactctgaagcataaatcatccaaccttcattaaatcaattc

SEQ ID NO: 563535 - DNA, 195 bp, Homo sapiens
tttcagttatctttatgggaatgccccatttatctgaaaccaattttctgtattagtctgttctcacactgctataaagaactacctgagactgggtaatttatgaaaagaagaggtttaattgactcacagttccacaggctgtagaggaggcattgctggggaggcttaggaagcttacaatcatggcagaag

SEQ ID NO: 563536 - DNA, 937 bp, Homo sapiens
  misc_feature (311)..(311): n is a, c, g, or t
  misc_feature (427)..(427): n is a, c, g, or t
atgagattgatgttagaagtggatgatgagcttgacaagacccggagtgaattcttggctggtgtccactgacagacgcacaacgaggagcatagtctactcgtagacaagcaagagtacctatcgtagtacaatagacagagcgatcaaagcacgagctttggaccgcactgcggctcgggcagtgtccatagcttcgacgcgtcttgccaaggaagacccatctaggggtttccatcgaggatgtacctggtcttccatgtccccagttgctatgcgtggaagctcatatgagacatcgacttgatgtngagatgggttacacccacgcagtgagcgtatctgcacgtaagctgattcttcgtatcttatacctagtcctcttgagggcgtcgatggaagtgcatagttgatgcacagtatgacntatcgtcatatccctagagtgttggccaagtcaagggagagcgcataaagaacagtctagaggtcaacgctctctttggagaaatcctgcgaataacataggggccatctaccgccaacatgccactgaaattcagaacttgcaagccaatttctttgaatttagtgagccccttgttgctttgccattgccactcactaggtatctagccatatgagttcttagctttgaggggccgtttaccatagggggacttgccttgtacgtgggttcaaaggtgaaccaaacaacccagaaatggacagacggggtcattcacagagaaccacgcctgtataatcccgttccgttcgttttcaacgcccatagtcttcttttccacaacccccaccagaggttccgcctttaggcaccaacagaaagattcgccattgtttgccattgtacgccatccccttgggtcctaacagtaggggaccgtctaagaattagtgttaagaagagaaacgc

SEQ ID NO: 563537 - DNA, 408 bp, Homo sapiens
aaattagcaacccgtcgacacggatcgaatcgatgcggtcgagagtatccgtgagcggtcctggaacgaccgcagtgaggtgcgcggacccttcgacatcatcggcgacgtgcacgggtgcgcgtccgtaattgcgcactctgctcagcaaactcggttggcagatccagtacgacggggcggacgcgatcgacgccacccaccccgaggggcgtcaggccgtcttcgtcggggatctggtcgatcgagggccggatacccctggggtgctgcgcctggtgatgggcatggtcgcgtcaggcaacgcggctgtgtgtgtccggcaaccacgaagcgaaactcgtccgcgctctcaagggctccaaggtgaccgtctcccacggtctggccgaatcccttgctcagctg

SEQ ID NO: 563538 - DNA, 123 bp, Homo sapiens
aggatccgcgtcgacttctgctcttggaggcagcagtggtcaaagtgccctgaagaaatttaagtctatccgtgagacatgaaggagaagggcttgtgggggagttcctgaggacccacaagt

SEQ ID NO: 563539 - DNA, 400 bp, Homo sapiens
gatcgcgagcggcgccctttttttttgagtctcgctctgtcacccagactggagtgcagtggtgcaatctcggctcactgcaacctccgcctcccgggttcaagctattctcctgcctcagcctcccgagtagctgggattacacgggcacaccaccatacccagctaatttttgtatttttatgtagtgaaaggggttttaccagtgttgggcaggctggtcttgaactcctgacctcaggtgatctgctccggcctcagcctcccacagtgctgggattacagggtatgagccagccacgccgcggcccattataaatttttgtttagacaagttctgttggttttaagagaaacggggttctgtgtccccattggcccaaagggggtggcgatgggg

SEQ ID NO: 563540 - DNA, 489 bp, Homo sapiens
  misc_feature (488)..(489): n is a, c, g, or t
acacaatgaattggtaccatccgttgttggagatcaaacctagaatgtccttagccagggacctggaaatgagtggtggccacagtctgttaggagtcgcttttgcagagtggatacatgtttctgctgttaaagctaacagcctttgcagaagttcagatcccttgttggccagtattgacctagtcttctaaaacgacagtaaaagtctacaagtctttgggaagcagctctatctatctatgctttaatactttctggactgcacaccagtgtgctgtgcagtcatgctgacactgaggtctcaggtgacttctgtgcctttgtgataaagggtgagataaaccatctcagagggaaggctggtgaatcattacagcaattttggggaccccttgtgccttacctcgaaatttttttaaaaggggttggagatttcttgggtccatgaaataagaggcgcttatattgattcaaaaaaaaaaaann

SEQ ID NO: 563541 - DNA, 1073 bp, Homo sapiens
  misc_feature (260)..(260): n is a, c, g, or t
tgaggtcgctcacagctggtaaaaggcggatgacagcgggcaggaaatccgatatctcgctcccaaagtgcccattgtgattcaggtgacgatagccttcccgtggggccccctccacaggatccgcagttcgtcaagaggccacagtcagcaacggtgtggtcagcgaggccgcaagtccaccagcaggctccacccttctcagtcaagtccctagacacagtcgagaggccgagtacgccgaggcccggaagcggatngctgggcagcgccaggccctgaggaggtagcaggagtaaacaccaatcgctccgataggccgatatccaggaatcgtcccagaacccgttacgcatcaggcaggtcagcccaagtaagtgtgattcagaccaggcttggggttcctgattggagtctcaatggtcttcaaaactaggcgcagactacaagtgtcgaggcaacgaaaatgatgccgccgattatgcgtgccgatcaatcgcgctcctggtgtcgtccggccacgggtttgcactgtccgtggcagggacagctggacttgagcagagggaacgacctgacttacttgcacttgtgatcccccttgctccggccactgtgaccttgaaaccccatgcactgtgacctcccccgcttctaccccttcccactgtgattggcagcatcgacaagggctgttccaagtcaactggaaagggaaagggtgggggatagcggaaagggttggggaaaagccaggacacgaggactcgaatgaaggccggaacactctgccactgttagtcaagttaggggatagaatccatgtccctccacccaatagtacaaggtactagctcgtgacctcaatcggactcttggggaatatggcataccacccatagagtagcacgttcacaacccaaacacgaaccgtcgccagttgccaggttagcccgcacacgcctaatgtacactaagatccaagggcaaataacatccctttgtctctaaagtatttgcggaataatatggaatgtatataccgcaaattctctatcatgacagtataaact

SEQ ID NO: 563542 - DNA, 781 bp, Homo sapiens
  misc_feature (1)..(1): n is a, c, g, or t
ntaccgcagtgtgtgtttggctttccgtggttgcgcccttgatatttgggactgtgcgtcgtcctctttcctggcctcgcccgtttttcgtgggtgggccccctctctcgtgcggatgctgctgtgttctgggacacccatgagtcgttcgcctctgtgtgttgaccccaccacgcctgaggagctatcctacctccctcgcgctcgcgggttgcattctcattccccccgcggtggccgttaattttggtcctgttaccgcgtgtctcccagacgggggggtaagatctaagtcttggcaccggtgcacgcgctggaatgagtgtcgatagttcctttgatggttacgcgcctctttcgacttcgcagaatgtgggcaaaatagtacacgttcggtaagcctgagtgttcgcacccaccgacataatccctgttgtggcccacgcgcgtggcgcagtcggtgtatgttggcgagagacgattggcgcttgcatagcctacttctttctgtttttgttgagaacatattttctgtagtgtagtgcagcgctcgtggagactgtcgtctgcctctattttgcacacgcaaccactattctctggtggcttttgtttcaaccccacgtatctgtggctagtgtgacggcatttatactcgtcgctacaccaaaaaggagataatattccctcactcacccctcgtgtgaccgctgacaaaaaaatctcgtgccgctctatacagggtgtagggataagaccaaaaaaaaacccacatataaca

SEQ ID NO: 563543 - DNA, 207 bp, Homo sapiens
gatgatctagaggatcccattgctcgccggaccagcagccctgttgaagtatcacaacctaccacagccgccgagctcaactccaacaacacacttttctgccagttccacaaccttgggccgtagtgaggaatcaacaacagtccacagcagcccaggtgcaactggaacagcactcttccctacccgctctgccaggaacccacg

SEQ ID NO: 563544 - DNA, 998 bp, Homo sapiens
  misc_feature (226)..(226): n is a, c, g, or t
gctgtggcccagtgacgcgagctgaacggaggtggatggggacagagcgatcagggtgatggggcctcatcgcgcccaatcggtggagggtggacagctatgcgcctcagcccgtgtacatggatcccaacctgaacttgatgatgcatagaaaatagactctcgtcgccctcaacaactcacgaacactggaggatatacacgagagttctcgagtggcgttcgnaacgggacgcgagggtggggtgatggattggggacggggaaggatgaatgatgatcagtcacgtgtgctcagcgatgtgggaacggtgtgtcaaagagaagtgttgcttgctgtgaggacgctgggaagggagtatgtagatggggggctgaactggaatactatgtctgctgtgagatgggagcgaatgggccaattcatgctacactcaccactggattgagtcccttgaagtggcccaagatctcgagtacctaggattctgatggggttaatcatcttcggagattgcgaacgagaccaatgtataggtttaccagaaggttcctttccattaactaacggaggtagagtacgatccccacatattgtggttcctggtgcaaccaaaggtagccttctgagtaagaaggggtctaaccagtgtctacctactccgcacgaaggtcggcatttcccgtcctagggggaagggacttgcgggcgcattgcgctaaggccctcaacaccatggagagggcacataattcttttgttgcatccctagggagaagtaggactggcaagtgggaactgggaccagcacggaggagggcgagaacaacttgggcccgctgttatcgccgctttaccggttgtgcagagtcaatctttggcaccaggaggtacaaggtgagccagcatggcgaattacaacgcctctcgcagagatacgggtcaatgggcggagattagcccggattcccagctcggttccagattaatatgaccc

SEQ ID NO: 563545 - DNA, 278 bp, Homo sapiens
  misc_feature (66)..(66): n is a, c, g, or t
  misc_feature (172)..(172): n is a, c, g, or t
tggtggtgcacgcctgtggtcccagctacttggggagctgaggcagaggggccatttgcacctggnaggtagtcaaggctaccatgttcacgccactgcattccagcttgggtgacagagtgagaccgtctctcaaaagaaaaaaaagtctgggcatggtggctcgcacctntaatcctagcactttgggaggctgaggcgggcagatcacagggtcaggggatagagaccatcctggccaacgtggtgaaaccccgtttctacgaaaaataccaaga

SEQ ID NO: 563546 - DNA, 115 bp, Homo sapiens
agatggccgacttcgatgatcgtgtgtcggatgaggagagggtacgcatagcttcctaaattaatcactcatgcacccccagggggaatttaatgaggtattcaattgacgttcg

SEQ ID NO: 563547 - DNA, 136 bp, Homo sapiens
  misc_feature (16)..(16): n is a, c, g, or t
  misc_feature (95)..(95): n is a, c, g, or t
tctagagatcctacgnagagagactggtgagggctgtatctttcagaccagacggggaggcatctatcagaaagtcactctgctagctcggcatnagcgacagcacgagcgcttccacagaggtgaaaaactcgat

SEQ ID NO: 563548 - DNA, 136 bp, Homo sapiens
gcaagaaagtatcgaagtacccaaggtatgtatctatactgtacaaaaaatataaagtaccaatgatgtatatatactgtacataaaatatgaaagtacatcaaatatatataggatgctgtacataaaagggaac

SEQ ID NO: 563549 - DNA, 290 bp, Homo sapiens
atatcagttccaagtgtcgagcaaaactcaaaaaggcttgagcaatatgagaatctacttggcttaagtaaagcttagagggtagctatacagggctgtcccactacttttgcaagtcctcccattctgccctcctcttcctgtatgatggcatcatcctgagcactgggtttcctacatgaagcagatgcttggaacacttacaagaatacacatctgcgcacttactaaccaaagcaggagaatataacgtgccattattcctaacacgtatccccagactccctctg

SEQ ID NO: 563550 - DNA, 945 bp, Homo sapiens
atacacacacacatttgaacactctcaagctacagaacaaattgaaagtgaagaataacgaaacatactttttaaatcacctgagagcaacgttactggtatggtatattctcaagaaacctgcaattattgtaacttcacttgtcaaactgagtaattcatacaacgaatctaatcacatttaatattggcaatattctcatgcatccagaagtgcaaagtcaggctatttcattcttctatctgtattataatactaaactgcttctgatatttctataaacaatcatacaaaatcattagagaacacctaatccaaatccagcatcacagatacaggacatttataccaacgttaagtcattttccctggactaccaggtttcatgtaaatcactttatacaagcagattcggacaaaacttggtatattaactgctgctctcaaaacacaatgtaagactgcaataactagtgtcctttttcttcaaagtggtctagcgcattatccatgtaagctataaacactacacacgaaaacaaatgcctgacaaatgacatatatacataaatgtcagtgtacgaagccactgggtttacgatagatcacctcacacttggcattaggggaacaattaaccacgaggaaacacggaatcaccacactaggcccaaaatactttactaatctagcttattcactatttcgccctcactatccatattgccccaaatgctctcgaactaatttgcccacagacacttgcagagggtcactcgcagtctggggaccaaggacacaaaacgacccgtatcagcaccttaaccatgcgctcacaagcgccataaacttttcccctatcgtgaccactactatgaaactacagcatatttatcaaatatttaacacatttcactcgtgcttcatagaccaccctaacttta

SEQ ID NO: 563551 - DNA, 438 bp, Homo sapiens
  misc_feature (346)..(346): n is a, c, g, or t
  misc_feature (395)..(395): n is a, c, g, or t
  misc_feature (404)..(404): n is a, c, g, or t
  misc_feature (436)..(436): n is a, c, g, or t
atgttcggctggcgcgctaatccgcatttcgggccgttccacatcctaagcaacctgctgatcttcggtggtttcatcatgctcgcttccgcctggcgggtgctgtatctggcgcagcagcagcaccgtctggccaccggtggactctatacccgcatgcgccatccgcaatatgtggcgtttgtcctgatcatgctcggcttcctgctgcagtggccgacgttgctcacgctgatcatgtttccagtgctggtctggatgtatgttcatctcgcgctgactgaggagctgagatgcgctggccgagttcggccgggcatacgaagcgtattgtgagcgcacaccnacgtttcatcccccgttggagcagtggtgcgtcgaaggcgtcgtctcanttgatcacngacaccctccagtcagcaacaatcctcctgcnaa

SEQ ID NO: 563552 - DNA, 808 bp, Homo sapiens
cagacctaaaatcgctcatgcatactcttcaatcagccactatagccctcgtattaacggtcattctcatccagaatcccctcgtagcttgcatccggggcagtcatggctcataatcgcccacggagttacatcctcattactattctgcctagtcaaatctcgaaagtacgaaggcactgccacaagtcgcatcatgatcctctctcgaaggacattcaaagttctactccacaacttaagtagctttgtgatgacttcgtagcaagcctcgctgacctcgccttagcccgccgactattaacctactggggagaactctctgtgctagtaatcacgttctcctgtatcataatatcagctctcctacttacagtgactcaacagtagctagtgcacagtccctatactgccctctacaatatgttaccacgaacacaagggggtctcacatcatcccacactactatttaaacaacatataaaccctcattcacatgagaaaacaccctcatgttcatgaggagcgtatcccccattctgcctcctatccctgcaatcccgtacatcattaccgggttgtgctccattaggtagtaggaagaattacaatatctttgggtcgtcgatctgccttggatgtcttttagcctcttcgtgaggccggcggcctaggagatctcattggttgctcgtcccctggcccgggctgtttgtggcggggttgccgtaaaaacccgggggcccggggtcgagcacccgcggggttggggcccgggctctgcgggttagggtgtttcccgggggg

SEQ ID NO: 563553 - DNA, 140 bp, Homo sapiens
  misc_feature (104)..(104): n is a, c, g, or t
ggcggcgcagcggagcggggcagagcatcctgcgccccggcgcggggccctgcggaagacaaatcgcctactttggacccgccgcagagcctgggcggaatacngattttgtttttatgaccacgcacgtcaccctggaa

SEQ ID NO: 563554 - DNA, 172 bp, Homo sapiens
catcgttggcggtgcttcgttctctgtcactccctcctgcttgttcctcctgcttgtgatactcctacgtggtgcccctcttcctggttgtctgtggcctgtttcaatgctgtcttgccatcctgtcgtttgttgtgcgcctccctgcctgtcccacccccatcaacccgtg

SEQ ID NO: 563555 - DNA, 871 bp, Homo sapiens
cgtctgcccctcgccgtcgccccgctgacctcaaccagccgccggcgaaatggcccctaagcgaggcggcaaggcgccggtcccggcgaagaagaaaacggagaaggtgaccaacccgctgttcgagaagaggacgaagcaattcggcatcggtggcgccctcccgcccaagaaggacctccaccgcttcgttaagtggcccaaggttgtgcgcatccagcgccagcgccgcatcctcaagcagcgcctcaaggtgcccccggcactccaccagttcacccgcaccctcgacaagaaccttgcaacgaaacttgttcaagatgcttcttaagtaccggcctgaagacaaagttgccaagaaggagaggcttctaaagagggcccaggctgaagctgaaggtaaaactgttgaggccaagaagccaatagttgtgaagtatggccttaaccatgttacctacctaatcgagcagagtaaagcccagctggttgtcatagctcatgatgttgatccgattgagctggttgtgtggctccctgctctttgcaggaaaatggaggtcccttactgcattgtcaagggaaaatctcgccttggatcgattgttcacaagaagactgcctctgttctgtgcctgaccacagtgaagaatgaggataagcttgagttcagcaagatccttgaggctattaaggcgaacttcaacgacaaattcgacgaggttaggaagaaagtgggcgtggtggctgtcatgggctcccaagtcgcaagcgaagaccaaggccaggcaaagggcttatcgcaaagggagctgcgcagcggatgaactaagtttagcattgtttgaaccaatatctattcctcattctt

SEQ ID NO: 563556 - DNA, 327 bp, Homo sapiens
tctctgctcccagattcaaccaattctcctgccttatcctcggaggagctgggactacaggtgcgtgccacacacaccggctaaccttttgtatttttaatacagacggggtttcaccactgttggacaagctggcttggtctggaatctcctggacctccatgcgattgccttaccttccgcctcccaaatgtgctgttgattacagggccgtgagccatctatgcttggtccccagtttttctatacatcttatgacactgttgatgatcacacacttttaatgtcatcagcatctctatactagtgctttagagactatgatcc

SEQ ID NO: 563557 - DNA, 880 bp, Homo sapiens
gcagagcggggggggggtccgaaggaagaaaggggagggctggtcgcatacggattattgcctactgggatccatcttcaaactcaacctgggacatgtgggcaatatttgttccaaaatattttgctccatagggtttgccatcgggccacttgacttggacgacttctccctcaacaggtggggccagcttcaaaccgcgctccgctcacgacgtcctcaagacacgcggctgtgacaacggaccatcgcagagcatgacgccgtacattgtttcggaggggcaccaggctccgatctgaacccgggtacacccgggccggaaatgggaaggtaaccagcgggggcgaaaaaaagaacagaggggggggagaacgatgcacgagcgagaaccgtgggtgacgggcgggacagggcgacgaacaacctgggtctggcggcgggacacgtgggataagggccggccgagaaaacaggggaccaaacgggcaggggcgggggggcaccgggggcgacacagggcgaaggaaaacgaaaaacccaaacggcgagatgggaacacactggcccggcacccgggtggtggggcggtgggggacaggagggagaggaggggggacgtagcgggcacggtacgggcggaggatggatggtggcgacacacggaccgaccgagaccaggtcccagccagccagcgagggcgacccgcagcgagccagccccgcggcgggcggttgacacgccagccgctcggcacgcgtgcacccaccaccggggggggtgcaggaaccagggtgggcgcggccccacactcaacccacacccgagtgcaacagccccgtgacacgggggggcaaacacaacacgaaacagtggtgg

SEQ ID NO: 563558 - DNA, 113 bp, Homo sapiens
actctagcaggatcccagatgtaagcagagaacccggctggagtcctgggacatgggctggaggagctgggaaaggctgagacttctgtcaactattccctagagtttgcagg

SEQ ID NO: 563559 - DNA, 315 bp, Homo sapiens
aatgccggtaaatacgttctcctaaaaagacaaaagcatattctgaaagaggcttgaagaagaagatcctagagacattcacgagagaggagggatacaaaagatgaaaatcagacaacaccgtttttcaaaaactgggctaccaggggatgccagcccccattgtctcaggagagcactggcaggtttagaatcccaggtccagtgaaacgtttcctaaacgcgctggtctctaaatcactaaggggacagctggccagcaggagagtcggctgcaacccaaggtctatataggaagaagacagcctacccgca

SEQ ID NO: 563560 - DNA, 364 bp, Homo sapiens
  misc_feature (285)..(285): n is a, c, g, or t
  misc_feature (288)..(288): n is a, c, g, or t
  misc_feature (349)..(349): n is a, c, g, or t
tgcactccagcctgggcgacagagcaagactccgtctcaaaaacagaaacaaaaaaagttaattttaaaaaatacaaacaaagctgaatttccagatctttttctattctaaattctataaaaattctaactttactccttttttttctgctgaatttacagttaaatattaatatgattacacttgctctgttacttctttccattcatactgtagtaccagtgttacttaaaggtcacacttggctgggcacaatggctcacacctgtaatcccaccactttnggngaccgaggcgggcggatcacctgaggtcaggaatttgagaccagcctgcccaacatggcgnaatcccatctttact

SEQ ID NO: 563561 - DNA, 257 bp, Homo sapiens
ctgcgccttgaaccatggtcctccagttcctgcgtccgattcctgtccttgctctcttacactgagtaccctggcatggcaatattacggtctactctgattacgcacgagctgttctagatatcagtgatgggttatccacaaatactctgatatacattatgtcttctcttcccggctattaatgattcatgatacaaggaactaggccgcgtggtcgttgttttctacagatgcgctcaagaagcaggaactgg

SEQ ID NO: 563562 - DNA, 346 bp, Homo sapiens
tagtcacggttggctcatgcctgtaatcccagcactttgggtggccgaggcaggcagatcacttgagattaggagttcgagaccagcctggctaaacatggtgaaacccccgtctctactaaaaatacaaaaaattagccaggcatggtggcgtacccctgtggtcccaggtactcaggaggctggggcaggagaatcacttgaacccaggggggcagaggctgcagtgagccaagatcgtgccactgcactccagcccgatgacagagcaagactccagctcaaaaaaaaaactagtgtggtactggcagaaagacagacattttaagaccaatggaatagaaga

SEQ ID NO: 563563 - DNA, 244 bp, Homo sapiens
agtcgctcaccgttgtcaccaactaccggtcctgggctctgtccaggcgcccagttacggtgcctcggaccgatcagcagctgcgtccagtgtctatgcaggcgctgggggctctggttcccggatctccgtgtcccgctccaccagcttcaggcgcggcatgcggtccgggggccttggcccaccgggatagccgggggtctgggcaggaatgcgacggcatccagaccgagaaggagaccat

SEQ ID NO: 563564 - DNA, 191 bp, Homo sapiens
aggctattgagggaagaggaggaaggagggaagaggaggaggagggagggaagaggagcaggagggagggaagaggaggatgaaggagggagggaagaggagggagaaggagggagggagaattggattccttgtatttttccaaacactctgtgccatttaaagacaccatgcttttgaacattctaatc

SEQ ID NO: 563565 - DNA, 957 bp, Homo sapiens
tccgcgtgcaaacttttcgagaggtataaatttgcgggacaatttttaggggaattcccttaagggcggcggttttttcccgcgctccaccaccttggtgtcgtaaaagcctcttggcagggctctctactcaattggtagttttcgccataaaactccgtggcgtcatctttgtcagagaccctcgttccccgggtttagagagcgaggttcttttctatctttggggcgtcttcccaccggttttccctccacaataggtcggagtaatattttccgctgtccgatattcggcctgtgttgggtataaccccccctggttgtcgcccccttgttttaaggttactgccttctcccagccccttgttggtgttccgccccggtggctgtaaccaaacgcgtgctgagcctccctggggtggggccactacctacaggcgccccctcacgcttcttgtgctgtttaagatggagacccacctgttgtacgacctctccggcagaatcatgccgtttctcaacaaaacatgggcggcgagagtatattttctggcggacaacagcacacgatgttgttttgggtcctgcgattgttcaacaggagccagaaaatattcacagaaaatgtctccggttgttgttccccggggcgccgtttaagtatgctgcgggtgtttataatccccggcgcgtaattgtcgccaggaccaccccttttggtataaatctccccactttctgcgagacacatcgcgcgcccacaattggcaaagcatacagtatggtgctttctcccaagatgatggccgccgggtttcacccagcgcacagcgtgcacgcccatacagatggtctacccctccgtttgtcagctcaccgccttttgtctaattatgtgagacagaaaatcagttggtttcgcccccccgaaataaattggggaaaagcccacataca

SEQ ID NO: 563566 - DNA, 137 bp, Homo sapiens
gacactagttaccccccggtcagcccatctagccctagtcctaccattcctcacgccatctgcatccacatcttgagtcctggaacggccctaggtgcatgcacctcactgtgcaactctgggagcagcatggcagg

SEQ ID NO: 563567 - DNA, 507 bp, Homo sapiens
taccggtccggaatcccgggtcggggcagttgtgggggaacacggtgggagtaagaccggcccttgggtttgtgtgggagctgggtgaggcctgtgactgccagctttcccccacttccctgacaacctgcatgactcagcagaggcagccataactctcctaggtacacgactccagtgacctgggaatctcacccacattccctacagcagccgcagcaagacccgcccaaggagagtctgagctcagacacgcctagctccacccccacctgatggtccttccctatgcaccctggcaggaagacaaagggcaaataaatcttgggagttctagggccccgcccactgctggttcctccccatattaccacagctgatgctttctggaaaggaccacctcctggcaggaggccaaccagcaaaaaaaaaatagaccattaacccaccaaagctccattgtaccctctgacacctccaccgaacaggcactggtagccatggctg

SEQ ID NO: 563568 - DNA, 312 bp, Homo sapiens
cccgtttgggtgcaacttaaaaaacgtggccgttaaatgttttaggtcccgggcctcccccacgtgggcccagggtggattcgagctgtcaggaagcatgccaagggcctgcccatagtgcctcgggtcctgttttagggctgggccttcgatgatttccgggacgttttagacagtgaggattagataaaggagctgagcaagaccgtgctttaggtgggcctttcggcccccccgggggacgtgttttttttttaaccctggagtgagtgagcaggggtgaaaaacaggccccccccccgttttctgtta

SEQ ID NO: 563569 - DNA, 974 bp, Homo sapiens
aagtgcagacaggctggtggaattgcccaggagaacggagcgtctacaatgcattcgacagttgggtgactccagaccaagcgtgcggacagcactgtttgctgtcttctcgcgtcagctgtttcttcgtgtcttcagaaggtgggccttctggaatcgggtccagcgtgggcgcttgggctccgctgacgagtattgacagggcatggacgctcgccctccatctcattcacaggccctttccagggcccaagctggggcatgacagggtggcatggccattggggagtctcttgtgcaactgcaagtggtttctgaacccccaatcccagctgagttgtcagacaggccagactggtgtgcgggaaactgggccctggccctgtggagtggttgctgggtgtgagacacactgcccacggcatgataccagtctctagctccatggagtggtccctgacagaggctggtgccagctcatctttgaactttaaccccttcaaagcttcaccagaaatttggttggcgcaaatccacaacagaaaggcgtgaaagaaagacagatccatgatctgctggtgggctggttgcccgtgggggcacgatgcctgtgtgacccccggagacacaggaccacggccttgtgaagattccgggcctgggttgagaagcgacctcccagcacttggggatggaaacgggggtgggaggataggccccgccccagcctggtgcaggaaactggaagtgtaggaagtggccccctaaaagggagaggcccgccttgaacccagggaatccaacatacccagccaggagaggccccacccgtgaagtaggtaacacggccaagcctgaaaagccaataccgatgcccggaggaggactggcgccgcccgtggaccacgaaggcgtgccgtgggcagagaaaaaaacgcggaacccaacagcaccgtcaccgacaccacggagag

SEQ ID NO: 563570 - DNA, 368 bp, Homo sapiens
ccggctctaacccatcttttcaggctgtcatctgtagaccacgacaaagtgccgggattacagagcctgagccactacaccatggcctgtatattgaatgttatattgattttctcggctagtagtttagcctgctccttcatgaagcagcgtcttccttctgtctttgcctgttttttgttagcacacagattgagaagtgacatcatcagtgcaatttagctacctacaggggtaagcgcattgagtcatacgccgtgtctgttatataaagaaaagtatggtccctggtgttaggggcttagaatctagcgatgtcagtaggcactatggaacaacaggaaaggacattttctgttggacccttc

SEQ ID NO: 563571 - DNA, 346 bp, Homo sapiens
  misc_feature (43)..(43): n is a, c, g, or t
  misc_feature (62)..(62): n is a, c, g, or t
  misc_feature (103)..(104): n is a, c, g, or t
  misc_feature (285)..(285): n is a, c, g, or t
cgcctgtgccataatggaacattaagcctgaatgactctgacncatgattactgaataaggncccactgttgagacctatgctcaccaaaaaaaatttcaaannttactgctggcaggtggattgcttgagtcaggaattcgagaccagcctgaccaacgtggtgaaatgccatctctgctaaaaatataaaaaaattagctgggcgtggtggcaggcgcctgtagacccagctactcaggaagctgaggcacgagaatctcttgaacctgggaggcggagcttncagtgagccaagatggtgccactgcactgtagcctgggctacagagcgagattctgtctcg

SEQ ID NO: 563572 - DNA, 785 bp, Homo sapiens
atttgtgttgggggggaaccacacccacccgcgtgggggcctcatcactcggcccaacttccccacgaaaaagttttaacacaccagcttgtgggaacatttggcgagacaaatatacacacgcgcccaccagagtttctcccacccgccacggtgtttctctcacactctcactctctttatctctgtatctctctctttctcgataaacaactcgtgaggtagccacgagagagcccccccacttcgtttgagaaaagctcctctgaggggtgcacaacttaaatgtatccacgccacatggcacagggtgtatagggagaccacatttgtgcacatcgtcacaacgtgccctcttgtcacatatggcctggtttgaagaaaattcacgggcccacacagtcacatgcacagcccaagtcccactatagtaaagtttaatttcccacacttatgcgtctataattatggttcacatttcccaatccccgatcacacactggaagggaaatcggacacacaggtgaatgccacgcacgttcctgccgtccgtctgtcacagggaaagccacaggcacgaagcccaccacagaagcacatggtccacatccacgagtgttccctgagccccctcccccatactggagacccctcttcagtgtaggaagatctgaaatgggtgctaattcccttcttcatgaaacccgggccctcttccttcatctaaagcagcccctcctaggtgaagaagtgggaattaaattggaaataaaccaccagtttaa

SEQ ID NO: 563573 - DNA, 130 bp, Homo sapiens
  misc_feature (44)..(44): n is a, c, g, or t
  misc_feature (66)..(66): n is a, c, g, or t
  misc_feature (85)..(85): n is a, c, g, or t
aagcgcatggatcgcatgatggtggagcacctgctgcgttgcgnctactacaacacggctgtcaantggcgcgccagagcggcantcgaggacctagtgaatattgagatgttcctgacggccaaagagg

SEQ ID NO: 563574 - DNA, 485 bp, Homo sapiens
  misc_feature (87)..(87): n is a, c, g, or t
ttttcttctttgttggctgtgtgggaggcacaataaccggagtagggagaagcaggtttcccatcaagttcctgaaacccaaagtgnaagatatatatgaagacaagggaatttactcggaaatttaaagttttcccccaagaaaaggatgacagaattaggaagtgggagatgatgtttaaaagtgaaccatctcagccaggcacagtggctcacgctggtaatcccagcactttgggaggccgaagcaggtggatcatgaggtcaggagatcgagaccatcctggctaatgcagtgaaaccctgtctctaataaaaatacaaaaaaattagccggaccggtgatgggcgcctgtaattaccccagctacttgggaggctgaggcaggagaatggcgtgaacccgggagacagagcttgcagtgagcctagatcgcgccactgcactccagccagggcaatggagcgaaactctgtctcaaaag

SEQ ID NO: 563575 - DNA, 1440 bp, Homo sapiens
atagttctagacgcgatgcggcgcccattttttttcatatttgtggtcttaccgtccctatgagggctaaaagaggattcatcaagtgcacagacgttgtgtggcacacaagaactccaggtttgacggaaacgggatgaaacgtcctgacgcttgaaacaactataccttgtggcggcatttcacaggacacacgcaacacagcacaaccggaccgggcagatgggtgctgcggagcagcgtggcgcgtggcaaactacaggtgggagaagacaccgggcacaaaccgcctctgacatgtgcgcaaggatacgcaagattatccttgagaattgccgcatggggggctcattccctgtgggccgcggtattcatgaacaccacgcatttccggtgtccacaaccagcgttcccacacaccacctgtggaaaaaggcaggagagcagtgcacactgagtgaccaataagaatagtcagaacaagaggatgaattctcaaagacataccacatcatacttatggggattatccacacacaccatatacacaaaatatcatagccaatataacaatataaaaacccatgtgaatagaaggagtttgcatgcgtatagacggagaacaagccagcatacacagagaaactatgtgcgtcacacaaacagaagggaagaacgtgcatataacacacttttgagagacagaccaaaagcatgcgcaatctatagcacagaagggatggtacacagaaggaccatctacatagaaggggagacaaaagaattgaacagacctatatgaggagcacccacaaggggccacgagcaacagcactcgttactcacacagaattgttgaggaccaggaaaagacaacattagcacaaaaagagcaagcgagagataaacccacaactatactcaaaaacacaaaaatatatcccacaataatataagaaaacaaaagcgacaccattcatcgcaacggacattgaggggacctcagcggcaaccgggagccaaacgacaaaaaggaggagaagcaaagaatagcaacaaggagaaacataggagagagcgaaaacaaagaaaccacaccaaacacaggacaacaaatgacacgcgaactaacgagggaacagacaaaacgaaccaccaaaacaacacaacaaaaacgaaacagacagaacaaatgagagaaacagaagaacagtataaaaaaacacagacacaaagaaaagcaggaaagaacaagcacacagagagagaaaacgcgagaccagaagcacgaccaaagacagaaagagaaaaaacaagaaagaagaaataggaagcaacaaagagaaagaaacagaaacaaagccagaaagaagcgaaggaagaaagagagaacaaagacaagacacgagaaaaagcacacacagatggtacagacacaaa

SEQ ID NO: 563576 - DNA, 410 bp, Homo sapiens
cggatttattcctggaagataccatcctgctacaccatccacccttccggtatcccccggacctctaaccacccttgtgggcagattgctggaagacaccatctctctaaacccaatccactgttacctactgcccctgcgggtcacaccaggaaaataccatccacatccaccttccatcctgtctccacccccactactgccagtgtgcctcattcctggaagataccatcttgccacaccatgcaaccttcctatttccctctacccctctgggtcatttcgagatgatataaccacatctagccttccctgtttccccacagtgactataccacattcctgaaagatactgtcacacctcccccaacacttccaccttgccttgtctccccctttcccctttgggg

SEQ ID NO: 563577 - DNA, 1211 bp, Homo sapiens
  misc_feature (578)..(578): n is a, c, g, or t
  misc_feature (972)..(972): n is a, c, g, or t
  misc_feature (1120)..(1120): n is a, c, g, or t
  misc_feature (1211)..(1211): n is a, c, g, or t
agcggaactactgtcaggcgttactgcagagttagagaagggttcccagagccgatgccgacagtgtgaaagaggcccttgagctagtgacagcttgtgtgctcattcataggagacggagaggacaatgtgtaagatgccaacttccgcagatattagaactacatggacatatggcaagcagaactggcagacaaatttcatcgcgtgtctgtggaacacatccagccgtacttggttgtagtagaagcatccacgctgttatcttctaagtcacagtcaataactcgtgcgaagatattcaagtgggattaattgtattgaccgatcctagagttagccagattatacgacagcttacatgaataaggaaatacttgcgagagcaaaggcaaatgtcacagctaccagagtacgcaggcagtgctaagaaatcctcatgaataccttcagcgaacaaatacatagtgcaacgaagcaccaaatccagccatgtgcacttatatagcgggttatataaaggacacgtgattcttatgcacgtgcaaaggaaaggaagggaaaggataaggcactgnaaagacatatacgaggtgcagtggacttgtactatgtatttgcaactgggactcatataaggacgctacgcgttggaaaacgaagaaaattgtggaaacggagaaagtaaaaaggaaggcggagggataaacacgtgaatgtgaatggtttggctataagtacattattttcttttgggcgctaatatataaccgatgacttagagaaaatattttgcgaatgttatccgctcccttttacgccagagaaagtcgtatggtgttgtttctagggtcaaagattataacaacggacagagctgaaagcgagccccagtgaacgacggagcaaggcaagagaaaaaagcaaaggggttgttaggcatcataacagaagacacgtatttggggaaanaccaaaagttgtgggtacagtcttgggagaaatttagggtaagagggaaaaaggcgcaaggaaacttagggttgacatgataagcctctatgtgtgtgtaaggcggtatatatcagacgaaaacctgtgttaagaacacaacggagcnttaacgtggccataaaagtgggcatagaggggtttgaaaccatatactatttggtgcaaaggacgctcgagttatatgtgaaacttgagan

SEQ ID NO: 563578 - DNA, 113 bp, Homo sapiens
ccagaaacgagatcgcacacaacagtatgaagaaagtcagggggactgcaaaggccaatgttggtgctggcaaaaagccgaaggagtaaaggtgctgcaatgatgttagctgt

SEQ ID NO: 563579 - DNA, 799 bp, Homo sapiens
ggttagctcagctctgaagaaagacttccttacattttgtaatctgttacacattctaggtgtggtgtcacacagctgcattcatttgttttcccccagatcagtttcttggtggctcaattttttgccctgtcagtcaaaaacaaattaagtgtctactgggtactcatgtgctaaagaaaaaggaacagtaacaaaaagcttcccatttttccccaatttcatgcaaagaatctgcactgtcactttcagagccatttaggatcctgcttttctgttgctggtggaagccctgaaaattaaatgaatttttagtattgctagtgtctggctaaattcaaggttttaaaacccaccctaactatgctgcaattctagactgaaataatgaacagatgtcatttgaactaacaatatcgagaagacttttcactaacaacacagttgtctgtctagagatggagatttaattttttttgtctgatcacatgtggagtcccatttaattttcccctatcagtcaaaaacaattaagtgaagagaaagaagctattcgtgatattgtccttcgcaaagaaaactctttcctgacccaccaacatggcaacgattcagaggcagaaggtgaagttgtgtgtcgactgcctgatcttgagaaggatgactttgctgcaaggagagcaaggatgaaccaaaccaagccaatggtgccattaaatcaactcctctatggcccttatccaaagaaaggggcagagaaatcagatggcagcaaacagctctcaaagggaatctcaaa

SEQ ID NO: 563580 - DNA, 538 bp, Homo sapiens
aaacgatagaggaagaggggagtgaagtggggtctgctggtgaagacaacccagctggccaaatgaatcctggttggaagccttccgatggtgggtgtgaattacctgacgcagtgggtaaggagcacccttcttcagacggggctgtggtggcaccagctcccaagtctgaagaaaaagatgctgctgagatccaaaagcgcaaaaggctagagcaagctggaatcaaggtcatgccagcagcacagcgctttgccagtcaaaaacaattaagtgaagagaaagaagctattcgtgatattgtccttcgcaaagaaaactctttcctgacccaccaacatggcaacgattcagaggcagaaggtgaagttgtgtgtcgactgcctgatcttgagaaggatgactttgctgcaaggagagcaaggatgaaccaaaccaagccaatggtgccattaaatcaactcctctatggcccttatccaaagaaaggggcagagaaatcagatggcagcaaacagctctcaaagggaatctcaaa

SEQ ID NO: 563581 - DNA, 698 bp, Homo sapiens
  misc_feature (1)..(1): n is a, c, g, or t
ntggcatgggccaatcgtaaaaagatttccttggtagtcataaaatgcgggctcccagttatggaggcggcatacttttatcacaggaggatgggctttcttttccaaaagcattctccctatctctctttagtccaatttgtcttttccctgtgtgtccctgagccagtcactggtagagcggataaacgtgcggtgattatcatagattattctggtgtgagaagaatggatgctgggaagcccccaagtatccaccccgatttctcttttccagtggggaaaaattacagtaatacttggcaggacatttcccttaaaggcaaaagtttccaattagacttctttttacaatttattccaatccctaagatgagctaatcaccaaaaaaaaaataaagcctaagttattttcagccaggtgcggtggctctcacctgtaatcccagcacttcaggaggccgagacgggcagatcacataaggtcaggggtccgagaccagcctggccaacatggtgaaaccctgtatctgctaaagatccaaaaaattgccagggcgtggtggtgggttcttgtagtcccagctacttggtaggttaaggcgggagaatcccttgggcctggaaggtgccggttgcagtaagccaagatggggccattccactccagcctgggtgacagggctagaccccgtctc

SEQ ID NO: 563582 - DNA, 81 bp, Homo sapiens
gcggccgcctactactactactactgctcgaattcaagcttctaacgatgtacggggacatggagaaaacccggtacgccc

SEQ ID NO: 563583 - DNA, 235 bp, Homo sapiens
  misc_feature (14)..(14): n is a, c, g, or t
  misc_feature (16)..(16): n is a, c, g, or t
  misc_feature (45)..(45): n is a, c, g, or t
  misc_feature (55)..(55): n is a, c, g, or t
  misc_feature (59)..(62): n is a, c, g, or t
  misc_feature (71)..(71): n is a, c, g, or t
  misc_feature (96)..(96): n is a, c, g, or t
  misc_feature (205)..(206): n is a, c, g, or t
  misc_feature (228)..(228): n is a, c, g, or t
  misc_feature (235)..(235): n is a, c, g, or t
ctctgctgtaactntnggaaaaatgataccactttattgcttttngaagtatgantatnnnngtgtatatnctctagacttcaaactctataaagngtctcaaagaagttggctggataaagcctactgtggatgtctttatattcaaagattgatgatgcaatttgaatatgtgtccccacggaatctcatgttgaattatatnncctaatgtggaaggtggacccnggataan

SEQ ID NO: 563584 - DNA, 264 bp, Homo sapiens
gatactgccgtagtggctatcactgctgagcgactcattgccaagctatttccctctccaccaagagacagagcgcagctaatctacccacacccacggctgcataactgcagtttcagttcctaatgagggactgagtgcctcttctacaggcatgctagacaaaactgtaggtctactagatactaactacccttcccactaacccctgcttgtaagagacttgtactcatagttttgatagtactcatctaacttactata

SEQ ID NO: 563585 - DNA, 176 bp, Homo sapiens
ccattcgtatcatcggcactcgctatcatcggcacttcgctattcatcggcacctcgctattcatcggcacctcagtttatttattttttttaatttcttaattttttgagatagggtctctctctatcactcaggctggagtgcagtggcatgatcatggctcactatcctcatg

SEQ ID NO: 563586 - DNA, 335 bp, Homo sapiens
ctaaaaaagaaaaagcaaaaagaagatacttctcactaatgtaaagatggtaaagaagaaccatcatttactgagaacctagctgataatcggcacaaggctagatgttataaatatattaactccaaaacatatataagctgaggaaactccaaagcctccaagttttctatagcatcttcctgagaatacttcaaacttcacacttaaaaaaattcctccttcacaatgtccaaataatttaacattctgatctttatgacttcaaatgtgatactgaaatggtattcttggaaaatgattaagaatgagggaaggccgggagtggtggctta

SEQ ID NO: 563587 - DNA, 732 bp, Homo sapiens
gtgaccagcagttccatgccatcactgtcacccagaagattgtggatggaccctccgggagactgaggcgtgatggccgggaggatctccacaacatcatccctgctctaatgacgctgtcgacgctgaggtcgatgtcgtccctgctgctgaacgggaggctcgcgtggtgtggtctgccgtgtcccccgcgtgccgacgtgtcaggggtggacctgacctgccgtgtatgaagaccctgcccgatatcgatcgagctcctgaaggtggtgaatcccggcgtcggagggacccctcaagggcagtcctgggcgtacactgcgcaccaggtggtctccgctgacttcaatagggacgtccactcctccagtctttgacgctggggctgacattggctcctcaatcgaaacaggtttgtcaacgctacatttcctggtatgagcaaacgaatttggactaccaggcaaacaggggtggtggatccttcatggtcctcatcaatggacactctcgaaggtagctaacgactcctcgtgtggaccagcacaggcccctaagcaatgagcacaagagaaggaagagcagagcacctacactgctggggagtccctgccagatctcagtaccctctccatgactgaatctcccgctcctcacaggttgctcatgtagaccccttgaagaggggaggggctaaggagccgacttgtatgtccagcctaaagtacctgg

SEQ ID NO: 563588 - DNA, 122 bp, Homo sapiens
  misc_feature (7)..(7): n is a, c, g, or t
gtaaatntacaaagataacgtcgcaattttcttagatttaaatcaaagacattcatcaacaagatttcgaatggaatattccagaaatttctgagccatctgatcacaacaaccgtctttga

SEQ ID NO: 563589 - DNA, 211 bp, Homo sapiens
ctgctaaattcatcactcatgcaccccaaggggaatttaatgaagtattcaatgacggtcggctactacttaataatgacaatcttcttaaggaaggggcagcacatgcattttccagtatatacatgggtcaggtcacgcgctctttagatatagaggatatataagagcacagtgctttaatacacagcacgcgggtagccctggggta

SEQ ID NO: 563590 - DNA, 143 bp, Homo sapiens
  misc_feature (55)..(55): n is a, c, g, or t
ttacaggctgagcactgcaccggcagagaatccatgtttgttggaaaatatcacnttcttgttcttgactttggttttgatattcagtttagaacttaccctagctttcagacaattactggggaggcacacgcttgcagtcg

SEQ ID NO: 563591 - DNA, 854 bp, Homo sapiens
  misc_feature (66)..(66): n is a, c, g, or t
aaatagtaaaaaaaaaaaaaaaaaagaaaaaaaaattgtaaaaaaaaagaatactacaagaaacanctctcctctgctctctccttatcacactactcaacatgaaggcaataagaatgaagacctttatgtataattgacttccacttaataaatagctagcttggacttgttctgatggaaatagaaggagtccgaactactagagacgcaatgtaaagggctaatcttatcaatggcacttatgatacttacaccatattgtttatgataaaaaaaattaataaaattaatttgtataacaatcttacgaaataataggcccttagcatgttcacatatatcgtaagaaaccactaaataccaaaggccacacacaccacaatgaccatcaccctctctcaacaccacactaagtcccctatctctattccaccgtaattaatatctaaaaaacgtgcaatgtcgctgatcaagctattcttggtagttcgagtagtgtatttggctattattgatgtcttcgatatccaatagagtgttattgtctgtcggcctggagagaacacatactatattcacaatgtgatgaacactgagacaaataggcagtgccctgccccgtattaatactctcacttcgtatcacgttcgccctctcgcgctcccaccgcacccttccgcagctattgctagaattacgcgccgggatcgcctgcgcgtcctcagcctcctgcacacccagcccccatccttttcactccacagtgcaccctcgccagcgcgatgactacgcacctgcgtagagcggacgagcgctcacgcgagcggtcaaggagagctccagcgtcacg

SEQ ID NO: 563592 - DNA, 917 bp, Homo sapiens
  misc_feature (917)..(917): n is a, c, g, or t
atgaatcccctggccaacccgtcatctactctaccatctttgcaggcacactcatcatagcgctaagctgcgcaccgatttgttcccctgagttaggcctagaaataaatgtgttagcttgtattccagttcgtaaccaaaaaaataaaccctcggttccagcagaagtctgccattcaagtatgtcctcactggcagctgaccgcagtccagtaatccttcgtaatagcgtatcctcttcaacaatatactctccggataatgaaccataaccaatactaccaatcaatactcatcaattgaatactcgataatggcatatagcgaagtaaagttaggaatagcccccttccactttcctgagtgccctaagaggttacccaaggcttccttgctgacatcctgggctttgtgtcttctgaacatggaccaaaatagtagcccccatctcatggcatataccaatatccctcctctcaatacaccgtaggccttctgcctcagtctctgcaatcttaatccatcatagacaggcagttgaggtggagaaagccaaagcgcagatacgcaaaaatgcttagcatagtcgtcaaattactcacgtaggatgattaatggaggtctaccgtacaacctaacatagccggtctgtaatttaactattgatatgatcctaactagctaagcggatgctactaactcaagttaagttctagggcccgacctataatattcgcactgaaaagctaaattgatgaccccttgattcttcacctctctccctggggtggcccgtaccgttgtgccactgcgttgagattcaaaaatggtcttcccacataccagcctatattaagggtttccccaaaccttaaaaaaaaggggcgagaaatgggggaagaaagtggaaccgcatn

SEQ ID NO: 563593 - DNA, 831 bp, Homo sapiens
gcccaacctggtcctgtgtctgcagaggcggcttctccggcctcctgaactgcagccccgcggccctccgacggcgccgcccgcgttgcgaggcaaagcccgcttgccgcccggcggacagcatgctcaacgtgctcgtgcgggccgtggtggccttctgaggaccccgagcgggctgccggaggcccagagcgcgcgtcgaaccgtctgccccgaagggcgccagacctgaggcgaggcaccccgcctccatccctggggggaagcgcccgcgaaaaccgtggagagaagccgccgccgggctgctgagaggcccggagagggactctgttccccgggggagccatcgccttcagttgtgcagggacgggcaccgaggagtcttgagccggggtcgcgggcggccttccgcagagaccttgcgccacagggtgctgtcttagtggactggggacgtgaacctttcgtctccttctggacctgggcagaagggaggcttgcgcttgtcggtgtacccggtcaggtacgcccgtagttgcaaaggatctcctcagggtcggacctacaatttgctacctgcaggctgtgcttggcccttttcaacgggtttctcaacgaagtgggaataggcgtttcccaacactcgggaaaaaattccagggatcgcccttcccacatccgtatagcataatttgctctacccggcccaatcgttgcgtacatggggcaggggttgggaaccaaacctgacggcattcctggagttgggcctagcagaaaatctgggctgtgccccgccctgggacgggatgaaactggccaaaatttccc

SEQ ID NO: 563594 - DNA, 1168 bp, Homo sapiens
  misc_feature (542)..(542): n is a, c, g, or t
  misc_feature (703)..(703): n is a, c, g, or t
  misc_feature (736)..(736): n is a, c, g, or t
ggagcgagcacactggccgggtggcaaagaaacagcccccctttccaagaggccgcccccaaaggggggcccccgaaagaaaaagggggtgagaccccgctttggtgaggaaagaatgggggaaggaaagtggaagagccaccccgcggtagggtccccataataaagaatatatttgggaaagaccgcttcgttccaccagggaccccaagggacccgcaaatggcatctgatggtctcaaagaggtcctgtgttttgaagtggagtctttgtctgatatttgcccggaattgatgagagattgcccgttttagggaagaagatttccagcctggagtttatctcgaaaagaatgttacacaggggtataaaactctgccctgagctttaactgtgccccatggcacatgggaatcttatcccccgtggagccacaaatgtgtttccacatgggtccaaagaatatgggccacgagccaccatgaattgagaggctctcaccgcttggagatgtgcacaaagacactacccgcaatgggtntaactcctggctcttcgcttctcgctttctcgtgtttgtgtttgttatacgtatataaataaacgctcacactcacactccacgagtatctcggagaagagcacctctctgtatatgggctctcacagcacctcacacacacggggtccgcgcgcacacanattccgcgagaagaaagaaatgagatgtgaganaattcactcgagactccgcagagagagggtgtcacagagccacacacttgagactctggagaaagaaagtgggtcacactaaaagttgagttgtccacgcagccacgccacattgtgagaaaagagcacactatgagaaaaggggcttggccacacttctagatttagttcctctctcccactcgaatgttctcttcgcttatgagaaaagtataaaaatgctgaagaagcgcccaagtttgaaattgggagaaggctcactggaggcttcactggtgaaaggcacgtaagtttctggagaaaagccacctcggggaacgaagaacacggtggctaaaagttgaaacgagctgatggatatgaaccccccgtcccagaatctgtttaaagttcagacttccaatagtggccaataaaaagtgctatttgtga

SEQ ID NO: 563595 - DNA, 175 bp, Homo sapiens
tcgagacatggtctgtgagatggcactgtgaggtatgtgaccatggggctgtgggctgtgaggtactcaagcctgacgtgtgaggtgtgactgtaacggtgtgcctgtgacggtgtggactgtgcggtgtgactgtgaggtgttactgctaggtgtggactgtgaggtgtgactg

SEQ ID NO: 563596 - DNA, 718 bp, Homo sapiens
  misc_feature (66)..(66): n is a, c, g, or t
gcagccatagttgtatatgatatcacaaatgaggagtcctttgcaagagcaaaaaattgggttaangaacttcagaggcagcaagtcctaacattgtaatagctttcatcgggaaacaaggccgacctagcacaataaaagagcagtagatttcccaggaagcacagtcctatgcagatgacaatagttctcacttattcatggagaccatccgctaaaacatcaatgaatgtaaaatgcacatattcatggcaatagctaacacattgccaaagcaatgacaccacaacaatccaggagcaaacttctgccagaggcaagaggcagtagaccttacccgaacccacacaagcaaccaggaactcagtcgttgctagtaactaaagcctctagctccgaactagactggaaatagctctctctgcttcctaaactgtcaataaccacctggaattgagagcattctaaccagcccagtactgacctatccaaacagcacagacgcacttcattgcatcagcacgtccaagtcctctcacacttaccagcaactctcattccacaaccgctcggtcctaagaaaacctctcaactctctcccacactcacacccttgcccattcgcggtaccccttcctccaacctcacattgctcccgcaaaaccaacattaagaggcgcaacacaacaccggagccaacccttactagtcggcacca

SEQ ID NO: 563597 - DNA, 233 bp, Homo sapiens
tcggacaggacatgtggcacagaggggagaggtaggcaagatcacacggagtgtttagaaggctagtactgagtatcaagaatagtgaatttctatgccctgcttactcagtatagccattaggcttgtgtgagaatgctgatgtcctaggatggacactctgggaggggaatatgaaggaagaaaatcattatgaatcaaagagcacttccattcctggacactttatacat

SEQ ID NO: 563598 - DNA, 540 bp, Homo sapiens
tataattgcagcttgtttataattgaaataaaactataggaagtcaaaatgctctacatcagagtttatttctgaaacgtcctctttgattcaataaaaaactaaaataagataatttacccattgataacatctctaggcatcattagagagccaataatgatgtagtagaatggtatttactatacacacaatctaaactgtaatcttctttcctctatcactcatgaaatcatgacatggtgccatttcagatttaaatggagaaatacaatttaaaaaagttactatcagcacaacttacaaaatacatattttcattttattatactttaagttctgggatacatgtgtagaacgtgcaggtttgttacacaggtatacacgtgtcatggtggtctgctgcacccatcaacccgttatccacattaggtatttctcctaatgctatccctctcctagctccccacccccgacaagccacggtgtgtgatattcccctccctgtgtccatgtgttctcactgttcgagtccactta

SEQ ID NO: 563599 - DNA, 143 bp, Homo sapiens
agcctctaagagtgattataatgtttcactgattgtatagccaatccatatttcactggactcttaacttgtataatactattctttcaacatttataaatacatcataacattggactttacatcgcaccagagcaccagca

SEQ ID NO: 563600 - DNA, 353 bp, Homo sapiens
  misc_feature (201)..(201): n is a, c, g, or t
ctcatagagcatccccggtatacgtgtggaactacccttagcgactgcaatcacattttaaacacaaaccttacattcttaacgatattagagcaatggctttgtgagagtaaaactactttctatacaaagcatagtcatcagttgatcaagagaagctggataacgtgtatttgactacattttcttccacactgtgtntatagtgcttggcacgggaagagttgagaattcctagcttgcttaactataagttagtgttgtatttcatttatctttttctattatgataaattttatgtcttgttttgctacaaaattatctatctaatacattactaacttgtgagtgg

SEQ ID NO: 563601 - DNA, 403 bp, Homo sapiens
  misc_feature (18)..(18): n is a, c, g, or t
  misc_feature (255)..(255): n is a, c, g, or t
tatccagccttaaattanagttttccaggagttaaatgcatcctaactatgttacccctaccccgtggaaaaatactgcatgcaaagaaaagctagaactcctaaagataatccgtgggctgggcatggtggcttatgcctgtaatcgcagcactttgggaggccaaggtgggaggatggcttgagcctagaagtttgagaccatcctagtcaacatagtgagatgctgcctctacaaaaaattttaaaaagtancccaggtgtggtgaaatgagcctgtattcctagccactgggaggctgaggcagaaggattgtttgatcccaggagttgaaggctgcagtgagctattatatcgtgccactgcattccagcctcagtgacagagcaagatacgctcttc

SEQ ID NO: 563602 - DNA, 1294 bp, Homo sapiens
gggaggctgtcccgaggacgaaggccccacgtgtagtgctgaacccccgaccgagccttgtgtacaaggagatccggaaaggcgagagtcggtcggaggctctggctgtggatggagctggtgcaagcctgtggtgcttgcagtgcaggctcaggcacccctgcacagggcaagtggcagcaaccatggagctatcccagccagcaacagcaggcaggcaggcaggcagcatggccagttgtgtccctgccaagtgcctattcctgggcgtgggcaagcagctggaggaggctggcagcacggagcgacggacgctggctctccaaggacgtgggaggacatcccaaaacagctggacagcaacgctgggaccatacatgggccaacggacgctgacctgtgctggacgaagccggctgggcaggggcacgggacggcgcgacggagcgaccaacccgtgagaaaacagagttagcgaatcgacaaagcatcacatagcatatccacatgaagccacatgaggacgtaaacagacagaattaccaagtggagagacacaatggagcagacctgcaaggactttgcgaacagaatggggattaggaaaggaccaaatcgaataaaacggaaggaataggaaacaagagacatatagacaaagtgcaaggaggaaccaatggaaccaccagacaacaagggcaacaccggaagagcatataaccgacccggacataccacagacaacgaaaaaggccagtgaaaggaacggagaacaagagaaagagaaagaaaccgacgaagaagaccaaagaaagggaaagcacacgagaagaaggaggacgaaagaccacagagacaacgaagagacacaaaggagacggcagaaagagaggcgataggagaaacgcaaaacaggatgggacacaaaacagcagaaaatgaaaaagagaaaaaaaaacgaggagagagaggaagggagaaaagaaaacgacccggcagagaagcagacaacgaaggccaacgagacagaaaagagggaacgaaaccaagggagaagaagccagaggaacggacagagcaaggaagagccagagagaggcggaagagggtaacaaggaggcaaagagcgaaaagagggaaacgcgaaggaaaaggaagaggaataagaacagagacagaagaaaggggaaagagaaaaagcagggagacaaaagagaaagaagagaagcacgatacagagaacaagaaggcgacggagagaacaggagagaagtcagaggggacaaaacgtcga

SEQ ID NO: 563603 - DNA, 1328 bp, Homo sapiens
  misc_feature (218)..(218): n is a, c, g, or t
  misc_feature (398)..(398): n is a, c, g, or t
atggccacatgcagcgcaagtaggtctacgaagactgctacgttccctctatcagtagaagagcattatcaccattatcactagatcgacgcccatcataattcatttgtccattaatctgtcttccttagtccttgtgaatgccctttttacctaactacttcactaacaaaacttaacataatatctccatcgatctcagacgcctcaggagaaantggagaaccggtcgtgaactatcctgcaccggcgcgatcaatcacgtagtcactccatcgtgcccatcccatcacctgacggcatccttctacgagtaacaagacgtgatggtccaacggatccacttcccgttaccgatccaggatcaatttgggctctacctatatggatcacttganacactacgagaggtgagcaccgattcacgagttggaacttcaattctttctagagctcactgacgataacttaccccctcgatttcattgcctaagttaaaaccaaggccgtaacctggcgaacttcgctttgacagtccgcactaagtcgaatgttatgataaactaccccccgcattgttagaaaaagccgcaccaagtgtccggtcattaaaactaaaattaacgctcttcagaggaaacgtcatttgcagagttgccacttgaatgcttgtgccccccaagcggtgttatgggctctaccaaaaagccagggattggcaactttccctctgaggactggtctatgaatcccaataacacgagtttttaccaaccccgggtaagaacctgagtaccgagaggggatgaatgaaccgtaacggggtgccaggatggggcgttccgttggaaagacctgccttgggtggggaccggccaagagccacaacaaaggttggtcaattgggcaccccaagtcacagtcccctaaggacaactttcaatctgcccccgcttaatgcaaaaattccttttgcgaagacattaagaggggggccccccgcatactttcgtaaacccccccttaaatttaagcaaacccccccacccgtttcatataacccccccccttttcttaagacaaggtctccacactacaccacaccaatcactctacgatcatacaatcacaacaatcgacaacactcatcacacacacattatgattctatctgagacgccagcaacaccatgagatgacgacatcccctacaaagattcaaaaatacactatctggcttgacacgaccacgcatatacatgatatacgtcgacaaacaaccgatgacatcgaccaacatacataacagtgataacaacatcagagaa

SEQ ID NO: 563604 - DNA, 349 bp, Homo sapiens
cctatttcctccaatattttttagttgtggcctacctagtacaatttaaaatttgtttttgtggcctggtacagtggctcacatctgttgtccccacactttgggagactgagacgggtggatcacatgaggtcaggagttcaagaccaggctggccagcatggtgaaaccctgtctctacaagaaaacacagaaattgggcgggcatggtggcacatgcctttggccccagctactcaggaggctgatgtgagagaattgtttgagcccgggaggcggaggttgcagtgagctgagatcacgccgctgcactccagcctgggtgacacagcgagaccctgtttccaaa

SEQ ID NO: 563605 - DNA, 1229 bp, Homo sapiens
gcatctagcagcacctttcacaacatagaggatcctgatcactgccagaagtgcaagatgaagtttcgccacttcttcaggatcaacgtgaagtacatgcatgaggtgcaatcgcaagagagtagctcagccccttggaccctacggtgtggcgaacgatctctgcagtgtcgcccgatcgcagtgactcggaagactgggaaacatgagtgtagccagtggttgcgaagtggaaggaccctgtcagcactggcaggcgatgctggctaaacaaaggtcgcctagccgagtccattctagttcgttgcgtttagtgaggttgacgcgacgaaatccgtaacccacagcacgaaccgcgtgcacccgtgatgtatgactggacgtcatggaacccaaccggaactcttcacaaggatccttcgaatccatcggtccacatgatgccagggctcccctgtatgcactaaaaaacccttatccgcccagaacgacgcacattggaagacaccatagggaaaaagcgagaatccaaaaaggccacgaaacgactagctaccagaattcgtggacaccgatttgccaggttggaccactcgttggatgccagcgtcggtaaacgggacgtctgccatgtccccgctagctggcccaaggcccacttggcaaaagacaaagcggtgttccactggttccgaaacggttggcccaagggcaagttccatggggaatcccgcaagactccatttccccagggcttggcaaatggtaacctttggtagcctgggcgtaacggttttgaccggttttatgttcaccctgggaagcccagatgtggtcaagaacagccccattggatccaccccaacgggatagtaacacacctatgcaaagggcaaggtgtccaggaaagaacccctaactcttttcacctctcctgttggacagaccttccgttgtattgtgcggcgaaaacctacgttgtcaacactttcccagcagggggccccctaggctgtgggaagcagcgtgccaacgcccatggagaaaactcccttgaagacgcacgccccaacacaggggttgcagtggaccgccaaccggggcaaaaacaccccacggggacgcccggaacccacgcacccttccactaggcattgggcacggccaaggcgctcggaaattgcccaaaaaacaccgcccgaggaaggggccccgattgggaaaccccg

SEQ ID NO: 563606 - DNA, 619 bp, Homo sapiens
gtaactgaaagaggtctgattcgcctgtgtagatcggccacagcacatccgtcttgcatcagaatgtgtggacttcatattgtatgtacatgcagatgaattagaaagaacttatcaactaactatcaggatcgtaggctatatatgaagagctgatcaccatgttggacgcagcactgggacttgagcgagctcacatgggaatgtttactgaattagctattctatactctaaatataagcctcagaaaatgagggagcacctggagctgtcacaggtctagagtgaatattcccaaggtgctaagagctgcagaacaagctcatctttgggcagaactggtgtttttgtatgacaagtatagaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgattagctgatggtgctagtatccacggttggatcacaatcgtgcagaccataattacagcaaggttaaacagctaccactggtgacaccgcatttggc

SEQ ID NO: 563607 - DNA, 1104 bp, Homo sapiens
gtaagccacttgcttggttatgattgtgtcttatcaggcaaaaggtgcccagctgccagcccagctccgctgctatctttgcctcactgtagtcatgtgcaattcgcgttgcagagtggcagaccattagttgctgagcttctgtcaaacacgtctgcatgtgctcagaagagcacctggcccaaagttggatctggttgttaatttaaaggacaaggctacatatattcagcttttggagatgaccaaagctagttagggtctccttgatgtagctaagctgcttcagtgatcttcacattgtgcaggctccagtttgtttctttccttatagaagagagagcggtttcgtacctctactatagtgcctgagtgatgatacaatcgctgttccagtatactagatgagcaaatccacaggaatgtggtacaagagtagaatctgaactatatcttgacaaagtattattcaagacttgaatgtaaatatatacaggtgtgtatagtttgtttaaagaagatttgcgttgcaatgagccttataagtgacatttgaatgtcatagcatgtaaagggtgcctgggtacatacaaaattataagaaatctgcagtaaaagaaccatgaaccataagacatcaccagatgtaaccaagaaactaccaagacatcttataaaccaacaagaacaatgtacgatcagtgggcaccagtataactaggacatcctaagtgccctactgggactcctggcactacacacattctaaacatctgtcccaatagaggcccaaattctaccacataacaggacggcaccacaaggcacaacacgttgaaaagcgaatgaggacgaaataaggcaaatccgccaagcgaaaaaatagggagaggaccaaccaaccgttagaagagaaaacccgaagagacaacaagagcgcacgagggaccccacattggagacccagcatgcgggaagacgagggaacagccctgaggcaacaacaacgaccacgaccgagaatgcagaagagcaaaacagaaagagcgacagcctgacaacgcaaacccagagaagtcactagaatagagacacagaacaaat

SEQ ID NO: 563608 - DNA, 139 bp, Homo sapiens
tcgatgagtctttgaaaagataaattgacaactttagctagaataactaggataaagaagaaaactcaaataaaattagaaatgaaagctgagacagttacaacgtgataccatagaaacaaaaagcatcataacaagc

SEQ ID NO: 563609 - DNA, 83 bp, Homo sapiens
  misc_feature (78)..(78): n is a, c, g, or t
cccacctggggactcttgcccccacatatttctccaggctcctccccacccccccagcatcaataaagtgtcataaanagaaa

SEQ ID NO: 563610 - DNA, 394 bp, Homo sapiens
gaatgtgggaagggttgaggaattccaataagaagattatcacccacaaagaatgccggagacaggtttttttccacaagagattaagtcattattcttaacccaagaggtgatggattgtctttctggtgcttactagtataatagctaagcagaaaataattgtctaatgtgaagtaggggagctggagataacatagaaaggataaaagtccctcaaattaaaaacaaaaaggcatcgacatgatttgtggtttcaaaaaaacttttttgggggaattgcctacatactattcttactggaaatggagcagtgtaggaagccacaaacatctaaatagtcatttctctctctttcttgtcagttgcttcaagtcacaaatgcagtttcaat

SEQ ID NO: 563611 - DNA, 107 bp, Homo sapiens
ggatgttatgctgctccctctacaccaactacagaggaggctctgagcacagagtccgggtccacggtcacccaagctccgtatcggaggccctaatccaggatctg

SEQ ID NO: 563612 - DNA, 190 bp, Homo sapiens
aagagattagaatgcagcttgagagttcccatgtggcacagtggcaatgaatccgactagtaaccatgaggtggcgggttcaatccctggccttgctcagtgggttaaggatccagtgttcccgtgagcggtggtataggttgcaagacatggctcagatgagaccgctctaccgagaccgctcttacca

SEQ ID NO: 563613 - DNA, 1543 bp, Homo sapiens
atctttttggtctgtgcttgttctgtgttgttgtggtcggttgtgctgtgtcgtgtctgcgtatacgcttggtctgagttttgtcgtgtcgttctgttgcgtttgcttgtgtttagttggtgtgtctgtgtttgggtgtgctgttggcttgtttgggttgagggttttgtgttgtggtctggggggcgtggtgggtgctgtgtgggtgtgggtggtattagtttggtgtgtttggttctgcttgtggttgtgtgctgtctgttctggtgtgtctgcggctgcctgcgcagcgcgctgggtgttgtgtgtgtgtgggaggagatcgcccgcgggcggcgcggtgagtgcgccaccgaagcgtggggtgagaatatttagcacgcgcctgggtgggcgccccccgtcttttatagtatgtgggggagttggcccgaatataggacacacccaatttggatcccggggtagttgttgtaagagggttgggaacgcgacgcgttggtatggtagtggtggctactttgtccgcggagaaaaggtgaattctccgccaccaccacgaacaagtgttgttggtgtggacgcccaaacatgttgtaataatgcgccctccaagtgccttttttgtggttgataagaaatagcgcggcgccacggggccccacaaaggtggagacagtgtatagtagcaccacggggttgcgccatcgaaaaagaggggtgtagaagccaccgaaaagcggcacatcgtggtgtgttgtggtccggaagtatttgttgcgcggcggcaactccacggatgagagaagattgtagggcttctcgcccccggcacaactagagagtaaaggtgtgttgtggcacagagtagagaaaaggataagtagagaggggcgacccctgttgttttgtgtggcgctactgtcgtctcttccggagaagagttgggtggtgagacacccccctgagtgatattgaccctacctctacttgcgacacgcactggtgtcgacacacagtagtgggacactgtcgacactgagggagaagtgtgaaggtctgtgtcacaacaagagtagtagactgtgtggcacacactgttcagagggcacacttcgtcatcagatagagagagtgttttcgcgaggaaatatgttgtgcgaccactctgataagagagagagtgtggggataactctccacagatgtgtggccgcgcacattgggacacacaccacagagcgtcgcgacgacacacaaacgctgtggtgtctgtgagcgtccacacaaggatataataagagaatgtgtgcgcgcactgagcccgaatgccgctggtggcaggctggtgtccacggaaaacgtgaatggagaggatggataagatgtgtcacccacaatgagagctgatgatgaactctgtgggtgtaacctgatgggacctggtgtgaccacctgtgtgcacaaaatgtgtcccagccccagtccaagtggatgtagaacttatccctgattgtcagatccaattaagttattaaagtgc

SEQ ID NO: 563614 - DNA, 275 bp, Homo sapiens
aaattttcccggggggccccccccgggggggggcccctttgggttgggggggggtttaccccaaaaaaaaaaaaccccccaacattttgggggttttgggcccccttgggggacccggcccccaaaagtagacaccccctttttgggcccccgggggaaaattttttttttttttaaaaaacccttttaaagtttttttttttttttaaaagggggcccgggcccttttaaaaaaagttcccctttttttaaggggtttttaatttccccgggga

SEQ ID NO: 563615 - DNA, 973 bp, Homo sapiens
cagaatatgtgtctgtgttagagaaagcgcccactgaataagcaagaatagggcaagaaaagaaatgatgtgattaccattcctagccaagtgtctccatcttggtacatgaacccaagttgaaagtggcacttaacgaaagtatctggcagaacctaagcaattctgcttaagacttatgcatttgcatgcaagacgagcgttcgcaatgcaaggttgtctgcacgagagttcacgagcaaggtccacatgggtacgagcacaatctttgcaaggtggaaaagcaacttgttttgcatatggccagacaggaacgtggcaagacacatactatgggcggagacctcgtctgggagaagcccaggaatgcatccaaagggatctatgccatggactcccgggacgtcttcctcctgaagaatcaagcccgtgcataccggaagttgggcctggaagatctatgtgacattacttcgagatctacaatgggaagctgttagacactgatcaacaagaaggccaagctgcgcgatgctggaggacggcaagcaacaggtgcaagaggcaggggactgacacggagcatctggttacatcagactgatgacagtcatcaaggatgatcgacatgggcagcgcacagcagaaacatctgggcaagacatctgccaaggtacccaaatccatcaccagaaacccacgcgtgcattccaaaagcactgctacagagactaaagggagaaatgcaatggacacagatactctaaagaccagactcaggcaagggaaatgacgcgagatcgccggaacaccatagccaggatggcatggacccgggtaagaaccccagacaatggaagagagaaagacagctccaacacagaagcctcgaaaccccctgtaaggaagaggcatagaggggaccacaaagcaacaggaaacaaggtacagacccgcgaacgagaaacaccag

SEQ ID NO: 563616 - DNA, 263 bp, Homo sapiens
ttttttcccccccccgggggggtggggggcccgggggggcccccttttttttaaaaacccccccccccttgggggggggggggccccccccccccccccccccccggggtccctttggtttttttttggggggggggggccccttgggggggggggttttttttttttttttttggggggggggggggggggggggggggccccccccccccccctttttttttttccccccccggggggaaaagttttttttcccttcccca

SEQ ID NO: 563617 - DNA, 955 bp, Homo sapiens
gaggctccgtctcaaaaaaaaaaaaaaaaaaaaaaaaaaggggccccggcgttgttttttaaaaaaccctttaagttttttaaaaaaaaccttactaatttacgaagtggttttacttcaacaacttacttaaaagagaaacaaccactccttttaaaaggaaattaaccggcggctcactaccacaaaaaccctttgtgttttccccaaactttgggtttctcaaaaaaagcattttttttccatctacccgagttcccccctttcatttaatttgggggtatttatcaaacaccctttttcttaagtgaacctcggtggagagcgcaggtgatatgttttagtccccccaatattaaggggattacccttttacacagcggtcccctctaaacatttttgcgggaggaagtgggtccccaaatagttaacatgagaaattacgaaaatgagtccgggtacacctcaggacgacattattttcaagggcaggggaacgcttggcagggtggtttcttattactctgtgaaaccacattgtcctgcggagagaaacccttttaacgagacaacatcttggccaatgtgacagcggcgccccgagaaatttaaaaatagaggggcgtgtcgaagggccaaaatatgtcgctctcaaagtggtcgtcacacattacctttagagggaatagatgcaccaaaaaggtgcccccttttaacagacggcgtacacgcggcatattaagtgtgcgaccccagtggggttaaccacagcgggggagagtataattataagctgcgcgttcaaaaatatgtgtgtgtgacagcaaacacaatatgaaactttttttctcaattatacaaacacaacacagactacagacagacaacacaacgacacaaaaagaacagagacaacagcaaaaacaaatacaaacagataacaaggatacgacga

SEQ ID NO: 563618 - DNA, 363 bp, Homo sapiens
aaaacttacaatagatctgcaccaagaaaaagaaagaaattgggtaagacatttcatacaaataaaagagaatgagccaactgtacgggcagagtgatacacgcctataatcacaacactttgggagacagacgcggacgaatcataagagatcagaggttcgagaccagactggaaaaaatagtgaaggtacatctttaccaaaaccacacaaaaaatagatggacatgatgcgtataccagtagtcccagctactcagaaggctgaggcaggagaataactacaacacaggaggcagaagatgcagtaagccgagatcgacaccactgcactccagactgggcgacagagcaagattccat

SEQ ID NO: 563619 - DNA, 119 bp, Homo sapiens
aatttttcccccaaagttttttaataacaaaagcaagcagttttttgtgaaatttcaaaaattgttgtaaaagtctgtttccattttaaaaaaaatccattaaaaccacccagggggga

SEQ ID NO: 563620 - DNA, 143 bp, Homo sapiens
ctgatgcattcaagtcatgagttggaagggtcatacaggacccagatagctcctcattactgtgacagagcagtagaatcccaggctctttcacgtatttaggctgataaacttcagcagcagtattggccttctctggtgga

SEQ ID NO: 563621 - DNA, 432 bp, Homo sapiens
tcaaggatcgcagccgagacccacagtgggctcccatgcagccaagcctccccgacaggtgctgcccctgctccgaggcgcccagtcccatcgaggcggccaagggctgaggagtgtgggcgcacggcacgagactggagggcagctccgcctgcagccctggcatgggatccactaggcgaagccagctgggctcctgagtcaggtggggacttggataacttttatgtctagctagaggattgtaaatgcaccaatcagcactctgtgtctggctcagggattgtaaatgcacccatcagcactctgtgtctagctaaaggtttgtaaatgcaccaatcagtgctctgtgtctagctaatctagtggggacttggagaacttttgtgtctagctagaggattgtaaatgcaccaatcagcactctgtgtc

SEQ ID NO: 563622 - DNA, 831 bp, Homo sapiens
  misc_feature (62)..(62): n is a, c, g, or t
  misc_feature (83)..(83): n is a, c, g, or t
  misc_feature (98)..(98): n is a, c, g, or t
  misc_feature (109)..(109): n is a, c, g, or t
  misc_feature (148)..(148): n is a, c, g, or t
  misc_feature (261)..(261): n is a, c, g, or t
  misc_feature (305)..(305): n is a, c, g, or t
gggacgacgggggcgacctcaccaacctcatccactagccaagttacccgcatggcttctgncaggctcgaggcatctctganggagaccacgactgngggtccacaancctctacaagatgatggccaatgggatcctcaaggtgtnctgccatcaatgtcaatgactccgtcaccaagagcaagtttgacaacctctatggctgccgggagtccctcatagatggcatcaagcgggccacagatgtgatgattgccggncaaggtagcggtggtagcaggctatggtgatgtgggcaagggcntgtgcccaggccctgcgggggtattcaggagcccgcagtcatctatcacccgagattgaccccatcaacgcaactgcagggctgccatggagcgtgctatgatggtgaccaccatggatgaggcctgtcagagagggcaacatcttatgtcaccaacacacaggctgtattgacatcatccttggacggacaactttgagacagatgcaaggatgatgccatttgattgatgtaaccaataggaacacttgtgacgtgagagatcgactgtcaagtggctcaaacgagaaacgccgtggaagaaggtgaaccatcaaggccgcaggtgaaacccggagatcgagacagaaaggaaaagggagcagcacgacaagacgagtccctgagatggacccgaagaggaatcagaacgtgagaacaaaacatgggactgggagcgccaaatggagaccaacacccaagaagtaacgcgaaagaagtaaaataccaataaaacaaaccaagagatgaatggcggacagaaatg

SEQ ID NO: 563623 - DNA, 198 bp, Homo sapiens
tacttgttggcgtttcggattcaggtggttgagccgcttccctgggcgctggggtgggggagaaagcccccgctgccgcgccgggctccctgcttcattctgtgatctgcggatttgccagtcgccaacctccgcgcccagagtcaccatcgcgcaggtttgggcaaaccatggagctcggagccagtcccacttagg

SEQ ID NO: 563624 - DNA, 837 bp, Homo sapiens
  misc_feature (10)..(10): n is a, c, g, or t
  misc_feature (66)..(66): n is a, c, g, or t
  misc_feature (75)..(75): n is a, c, g, or t
  misc_feature (116)..(116): n is a, c, g, or t
  misc_feature (152)..(152): n is a, c, g, or t
  misc_feature (186)..(186): n is a, c, g, or t
  misc_feature (189)..(189): n is a, c, g, or t
  misc_feature (191)..(191): n is a, c, g, or t
  misc_feature (199)..(199): n is a, c, g, or t
  misc_feature (201)..(201): n is a, c, g, or t
  misc_feature (209)..(209): n is a, c, g, or t
  misc_feature (213)..(214): n is a, c, g, or t
  misc_feature (219)..(219): n is a, c, g, or t
  misc_feature (226)..(226): n is a, c, g, or t
  misc_feature (232)..(232): n is a, c, g, or t
  misc_feature (234)..(234): n is a, c, g, or t
  misc_feature (276)..(277): n is a, c, g, or t
  misc_feature (279)..(279): n is a, c, g, or t
  misc_feature (289)..(289): n is a, c, g, or t
  misc_feature (300)..(300): n is a, c, g, or t
  misc_feature (302)..(302): n is a, c, g, or t
  misc_feature (312)..(312): n is a, c, g, or t
  misc_feature (349)..(349): n is a, c, g, or t
  misc_feature (354)..(354): n is a, c, g, or t
  misc_feature (360)..(360): n is a, c, g, or t
  misc_feature (394)..(394): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (420)..(420): n is a, c, g, or t
  misc_feature (453)..(453): n is a, c, g, or t
  misc_feature (486)..(486): n is a, c, g, or t
  misc_feature (490)..(490): n is a, c, g, or t
  misc_feature (502)..(502): n is a, c, g, or t
  misc_feature (545)..(545): n is a, c, g, or t
  misc_feature (547)..(547): n is a, c, g, or t
  misc_feature (641)..(641): n is a, c, g, or t
  misc_feature (652)..(652): n is a, c, g, or t
  misc_feature (697)..(697): n is a, c, g, or t
  misc_feature (753)..(753): n is a, c, g, or t
  misc_feature (764)..(764): n is a, c, g, or t
  misc_feature (766)..(766): n is a, c, g, or t
  misc_feature (796)..(796): n is a, c, g, or t
aagcggaatnaaaaaaggggaataaaaaatccatttagtgtattaaacatttttcactcatttgcnatagtgagngtgcaaatacaaatttgggctaaatgtacagattcttaagnaacaatgtacagcttttttcgtcctccatgctaagngatgtaaaagcttaagggtgaaacaataccaatngtntngggttgananaccatctnagtnnggggnttttctngttttngntaagatacacctgggacactgggaagtgatcacttacatagnntnatgtgaggtnaattttttggnanataaattttngtgggacaatcctggggggtaagaccgggggggtggnggggnaccggnggggggtgggcgaatttgttccggtgacttttgngtgcgtgtnctntnatctgaggtttnttctctttccctaagcggggggcttcctatgangtgagtgtgtatgttatggggaggggggggttngggngggaggtttttntttatggcaactgcggcattaattgcctaggacctcaacagcntnatgaaagtttgggaaatgttcatgcataaggttattgccttagctgatttaaaattgccccataaaatggtacatattaacccttagtgaagcnttttaaaaaanaaaaaggttgaaaaatgggtaaaagtaggaaatacagcatatctncctttagagccattaactcaggaattctctcaattatgaaatcttgcagataagtnatttttctttntnaaaatccaggtgatgacaatattccttacnccagacctggcattttttcatcatcactgttttgtgaataa

SEQ ID NO: 563625 - DNA, 385 bp, Homo sapiens
ttttaataagttgatattttttccctgtgtagatttaaataatttcctttaaaagccgtaagctttggctgggcatggtggccttatgccctgtaatccccagcactttgggaggcctacgatgggtggatcaccctgaggtcaggagttcaagacccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctggcgccgagatagcgccattgcactccagcctgggcgactgaataaaactctgtct

SEQ ID NO: 563626 - DNA, 408 bp, Homo sapiens
  misc_feature (48)..(48): n is a, c, g, or t
  misc_feature (68)..(68): n is a, c, g, or t
  misc_feature (93)..(93): n is a, c, g, or t
  misc_feature (144)..(144): n is a, c, g, or t
  misc_feature (202)..(202): n is a, c, g, or t
  misc_feature (223)..(223): n is a, c, g, or t
aaaatccaaggaaatatggtccccatggggacccttacccagataagngccctattaattaaagaccntggttgggctgccgggatttattanccttagccctaattttcctttcctgagttaaatgaatcttgccttttttancgttacccacccctggcataatcccaatgggaatatagtatgaacccacatagttaanttaaaattttctttctttaantttgttttttgagacagggtctcacattgttgcccaggctggagttcattggcacaatcatagctcactgtggcctcaacctcctgggcttaagtgattcttctgcctcagcctcctaaatagctgggactacagttgtatgcctccacgcctggctcatttttacatttttttttgtagagaca

SEQ ID NO: 563627 - DNA, 1384 bp, Homo sapiens
  misc_feature (223)..(223): n is a, c, g, or t
  misc_feature (226)..(226): n is a, c, g, or t
  misc_feature (228)..(228): n is a, c, g, or t
  misc_feature (237)..(237): n is a, c, g, or t
  misc_feature (240)..(240): n is a, c, g, or t
tcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggatnctntnctctggaantancaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagcccggcaaggcggggctcctgatgctggcccggagtgagtgctacgcaaggctacaattcaattgcgacagaaccagcagagtctccccttttcctgcagccagagtgccaggaacactgtggacgtctttgttcagaagggatcaggttggggggcagcccccagatccctttctgttccgagctcagattttcccaaagacactgacatgttaatcttctctattgtaaggatttccatttagtttgacattccgatgaattaaatctaaatcaatttgca

SEQ ID NO: 563628 - DNA, 864 bp, Homo sapiens
gatattacaaatgaagtccatgtcttttgatctttacaatatatctatttatcaaaggccagacagcaggaggctcacgcctgtaatcccagcagctagggaggcgggacagatcacaaaggtcaggagttctgcagcacctgggctggccaacagtggtgagaaccccgtctctactaaagaaatacgggaaacatttgctgggcaatggtggcgcgtggcctgtaagtcccagctactaggggggctgagcgcaggaggatcgctttgaacctgacgaggcagagggttgcatggctgagccaagactcactgccactttacgtccagtctgagcaacagaacgagacttagtcacaaataaatagaataaataagaataacatacagatgtactaactacaatccacactatcttttaatctttaagagtgtttaacattggtatactgctctgtagtcggtcgcatcagtcgtcctataaagggtcattttctcatgagtggaacaccctgaacaatcagttacctttgtgcctatgcccttctctctcctcagacagctgggatgtttatggtgcatctggccttgtaccgcgtttaactaagacccagcttacgcttgcatggttaatcaccacacattcttttctcaacaggggttcaccgtggtggccgattcttgtgcctaacgtatggtccccgggtgtcgcttccctgtggtccttccccaggtcataagtagctccctagatattcgggctcctccatttacttcctactgtggcctgcttggccgcgcgccgtttccctggcatcttgtggctccaacgggggggcggcgccttttcttctaccctttgcc

SEQ ID NO: 563629 - DNA, 217 bp, Homo sapiens
tgcggcccgcctttagtctacgcgtcctatggctgcctcatccgctcctcacgccaatagggctcaatattctctcatctgcctcttcctacacatcgggcgcggcttctattcacggctcatttctctactcagcacacctgcaccatcggcattatcctcctgcttgcacctttagcaacagccttcatcggctctgtcctccgtgagcctctat

SEQ ID NO: 563630 - DNA, 1174 bp, Homo sapiens
acgaaagaaaaagaacgaacacggactctattgctaggtacgagctggctggttattacggccgaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggtgggtgctagcaaatgagattctcctcggaagtagaacgcaacctccaggatgccatgcaagtgtgtcgcaatgttctcctggaccctcagctggtgccagggggtggggcctccgagatggctgtggcccatgccttgacagaaaaatccaagtgcatgacttggtagtggaacaattggccatacatgggctgttgccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagcccggcaaggcggggctcctgatgctggcccggagtgagtgctacgcaaggctacaattcaattgcgacagaaccagcagagtctccccttttcctgcagccagagtgccaggaacactgtggacgtctttgttcagaagggatcaggttggggggcagcccccagatccctttctgttccgagctcagattttcccaaagacactgacatgttaatcttctctattgtaaggatttccatttagtttgacattccgatgaattaaatctaaatcaatttgca

SEQ ID NO: 563631 - DNA, 278 bp, Homo sapiens
tgtgattctttactccgtgagatatttgtgtgggagaaacataaatcttgtctacgtgcacgtccaggcatagtaccttcccttgaacttaataatgatatggattcttttgctcacgtgtttgttttgttgttgctgttgaacttccccttattattaacctgctcccctactgcattcctttgtgctgtaataatgataaccataatcaataaaaactgagggaactcagaggccggtgccggtgcaggtcctaggtgtgctgagtgacgttcctc

SEQ ID NO: 563632 - DNA, 461 bp, Homo sapiens
  misc_feature (332)..(332): n is a, c, g, or t
gatttaaagagtttaggccactaaactataaattttttgaaaattttttatttattttaatttaaactctgagatacacgggcagaacgtacaggtttgttacataggtatacatatgccctggtggtttgctgcacctatgaacccatcatctaggttttaagccccacctggattaggtatttgtcctaatgctctccctcccctagccccccaacccccgacaggacccagtgtgtgatgttcccctccctgtgaccatgtgttctcactgttcatcttccacttatgagtgagaacatgcagtgtttggatttcagagtctctttgtnggagttttaaacagtgacaaagagatgtatctttcacccattttggaatacctaaattagtgcatttggagaagacaaagaaaaaaatataagactaaatgggtagtggttttgtagttttatgactcc

SEQ ID NO: 563633 - DNA, 812 bp, Homo sapiens
  misc_feature (748)..(748): n is a, c, g, or t
  misc_feature (791)..(791): n is a, c, g, or t
  misc_feature (799)..(799): n is a, c, g, or t
aaattagaactcaagattaaaaagcccactcaaaaccacacaactacatggaaattgagcaatctgctcctgaatgaatgactcctgggtaaataatgacattaaggcagaaatcaagaagttctttgaaatcaatgagaacaaagaaacaatgtatcagaacctctgggatgcaggtaaagcagtgttaagaaggaaatttatagcactaaatacccacataaaaaatctagaaagatctcgaattgacaccctaacatcacaactaaaagaactagagaatgaagagcaaacaaatcccagagctagcagaagacaagaagtaactaagctcagagtggaactgaaggagataagagtcatgaaaaacccttccaaaaaaatcaatgcatcccgtagctgttttttttttaaaatcaatgaaatagaccaccagcgagactaataaagaagaaaagagagaagatttcaaataaacaccatcagaaacgataaaggggataccactactgacgccacagaaatacaaccaaccatcagataataccataagcacctctatgcaaataaactggaaaatctagaagaatggataaattcctgcactcataaacaccctacaaagactgaaccaggaagaagttgaatccctgaatagaccaatacaagtcctgaaattgagcagtaataaatggcctccaatcaaaaaaagcccagctccgatggatttacagctgattcaccagangcacaagaggcctggaccatttgaacgattccaacattaaaangagagtantcctaccattatg

SEQ ID NO: 563634 - DNA, 635 bp, Homo sapiens
  misc_feature (68)..(68): n is a, c, g, or t
aggaaacttgttgggtgaagaccaaaggtttgaagcaactggcacaaaggttaagggctggttgaatnacccatgctttaagaattgggatgggtccccagtgagttcttggattctgctggctgaaagcaacagtgcagacgatgagaccgcgatcccagggaggtatcagaaatatggttacattggaacacatgagtaccctcatttctttaatagacccagcacactccaggcagcatccaccccacaggcagaagaggactggacctgcaccatcctttgaatgccagtgcattttgggggaaagggctccagtgttatttggaccagttccttcattttcaggtgggacttttgatccagaaaggacaaagctcctcagtgagttggtgtataatccaggacagaacccaggtttcctgactcctggccttctatgccctctatcctatcatagaaacattttcccaagccctcatttcattccccctattttttgaaaatattccctgagagagaacagagagatttagataagagaatgaaattccacccttgacttttttttgtgcccctgatgggagggtaatgtttaatgtattatcaataacaataaaaaaaagcaaatccca

SEQ ID NO: 563635 - DNA, 993 bp, Homo sapiens
gcataatggacaaagacctaactttatggttgggtgacacccccaaaccctttgcagataccactccccgccatcctatattatagtcgtgtgttatatattctcaggtaaataatctgccctgcccagtaggggttccaaggaccttttctagttgccctccttggtggtttactaactttggcagttaggaagtccttttggtgcctccgattttatgagtcatcaaggtttggcttcatactgtctgtttgcttctccaaggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagcccggcaaggcggggctcctgatgctggcccggagtgagtgctacgcaaggctacaattcaattgcgacagaaccagcagagtctccccttttcctgcagccagagtgccaggaacactgtggacgtctttgttcagaagggatcaggttggggggcagcccccagatccctttctgttccgagctcagattttcccaaagacactgacatgttaatcttctctattgtaaggatttccatttagtttgacattccgatgaattaaatctaaatcaatttgca

SEQ ID NO: 563636 - DNA, 635 bp, Homo sapiens
  misc_feature (333)..(333): n is a, c, g, or t
gcccagcctcggccaatggagcgatgagatcataggacataggccgtgtcccagcagatgcactaaaacacaaggctggcctctgcccactctcctactcttttcccctgccctgggaagcgagacccagatgggaactgctccttcagtcatggggagcagagccccctcccactacagccaccaacatgtaagatgagtgagaaataaactgctatgttttaggacatagcaatacagggccatttgtgactgcagcctcacctagcaaaagctgcatgacatgggaccttgttctcctcctaatcctccatctccaaagcagtgtctctngtctacttgcctgtggtccacagccagagaaccccatcctgctttctctgtcttgggcagaggcctcacctcacctacaggggccctcaggtctggctgtgctcgcttgtgatgctcagtgtaggtaggtggtcagtcccgggatgcttaggtatgggtcctgtgaccctgctgctccagccccgagaggaaagcttctcagcccaactcgcagccaattcccagcctcccgggggctcacatggacattccagagcccgagttcaagaccagcctaggcaacatagcgagacctcatctgt

SEQ ID NO: 563637 - DNA, 443 bp, Homo sapiens
gcacctgcctaactcccttgggtcctaaggttaagtaagaggatcctgagttaaatgaaactctctctcacttaacaaacttcccggtttagaaaccagcagtgcccatacactaagtttacacagttgggaggtccagtggaagaacagaggaatggaaacccatttgcctggggaaatgaaagacttcccagaggagacacaatatttgaactgagaattaggagtttgtcaggcaggcttggcagggtgaaaaagccacacactgggaagagcataaacagacaggcatgaaacagcatagtaaaggaggaagatagcaaacacctgtgtgtccgtacagcaaaagagcttgccctggagggagttgggggagatgggcaagaccaggtgaaagagggccttgaatataaagctaaggcatcttgagttgactgtacttg

SEQ ID NO: 563638 - DNA, 1330 bp, Homo sapiens
  misc_feature (223)..(223): n is a, c, g, or t
  misc_feature (226)..(226): n is a, c, g, or t
  misc_feature (228)..(228): n is a, c, g, or t
  misc_feature (237)..(237): n is a, c, g, or t
  misc_feature (240)..(240): n is a, c, g, or t
tcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggatnctntnctctggaantancaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagcccggcaaggcggggctcctgatgctggcccggagtgagtgctacgcaaggctacaattcaattgcgacagaaccagcagagtctccccttttcctgcagccagagtgccaggaacactgtggacgtctttgttcagaagggatcaggttggggggcagcccccagatccctttctgttccgagctcagattttcccaaagacactgacatgttaatcttctctattgtaaggatttccatttagtttgacattccgatgaattaaatctaaatcaatttgca

SEQ ID NO: 563639 - DNA, 405 bp, Homo sapiens
  misc_feature (304)..(304): n is a, c, g, or t
gccctttggatgtggaggaaaacttgactgctgggaaggcagaaatctgtccctgggaggtgggtgctggagcaggggaggaaagggctttgggagctgaggccattaggaaatctccaaatgatacagtcaagggagctcttccttccagacatccttgtgtgcctcttgctagttttttagggggtctccccctcttcctgccctatctctcaccagtctccagagctcgtctcactggctcatttccttccccctagcttttcagcgctgccatcaacaggacctctctcttttgtcaagncaactggagtcaaggggaatctctggttctgatgcaagatccatccaccctcccccacccctccccgcccaagaatcattgctcagtaacaagaggcacat

SEQ ID NO: 563640 - DNA, 308 bp, Homo sapiens
gctgatccgcttaacgcaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcataagcatccctctaacctcatctcctacaactcctgatgtggaattcatagggggcagcacattttggaccaaggaggtcaccacagttatgacctcagacatctccaagtcttaagc

SEQ ID NO: 563641 - DNA, 159 bp, Homo sapiens
aggtcaaaacagtggtgagagccaatgctgctcacagacacccacttgatgccacagccatgcaatgaggcttcctcccagctgctctgttggcttgctgaacgccagctctgagtcacagggttgccttggaccctcgcttgtagggggtccggctgt

SEQ ID NO: 563642 - DNA, 176 bp, Homo sapiens
cctatcagaatccaatgagaactacaatggtgtgcccagacgtagagctgagaatagcattaccaaatggaacaacgtgctacagtcaggattaaaaagaacaatactacaaaccaagtatatcaggctattatagcaaaggctgccatgaacaatacaacactgaattactcggc

SEQ ID NO: 563643 - DNA, 591 bp, Homo sapiens
  misc_feature (161)..(161): n is a, c, g, or t
  misc_feature (301)..(301): n is a, c, g, or t
  misc_feature (387)..(387): n is a, c, g, or t
  misc_feature (395)..(395): n is a, c, g, or t
  misc_feature (420)..(420): n is a, c, g, or t
  misc_feature (432)..(432): n is a, c, g, or t
  misc_feature (437)..(437): n is a, c, g, or t
  misc_feature (463)..(463): n is a, c, g, or t
  misc_feature (477)..(477): n is a, c, g, or t
  misc_feature (499)..(499): n is a, c, g, or t
  misc_feature (501)..(501): n is a, c, g, or t
  misc_feature (506)..(506): n is a, c, g, or t
atttcagaagagatgtttggttgaaagctttttttctgtggaaattctgaagcggactagtggggaaaaatttttgattggattggggtgtttctagaggatgactggtctcgagatgtattttggctttgtgaagttttttttttaagagggtcctgctntagtgtagtcggtggtattcgagatggaggagtcgggagtatagctgctgctggaaatgctgatttttaatttatataagcgaatctctgtttttgaagctctgtagtacttttatctatataaggatgaaggtaattgngagtgagtaatggagtggctgttatggaaggaagaaaagctgttattttctttctggatactgagagggtaatctttgcttttatntttgaggntatggagggtcttcttttatttttntatagagattantttgntgctttaatgatattcccttcccacntttctttttgaggnttctctttctccttcccatttntntacantaaggggtatgttcccttttgtccctttccctacctttatatttggggtccttttttatacaggaaaaacaaaacaaagaaataa

SEQ ID NO: 563644 - DNA, 140 bp, Homo sapiens
caggcctctaacaggagacagctccaaagcacgctatgatcgtctgccaagcatttgagggaaatacgtatgcatgttttgagggctctgtttttctagaattttgtaccacctggcagcagatatggggatcctctgga

SEQ ID NO: 563645 - DNA, 229 bp, Homo sapiens
tgatgatggtcatactgtatacagatttggaggtgaggaggtggattgctgaggcaggagtcgagacaggctgggaaatggtgaaaccaatctctaataaaaatataaaattagtgagcatggtggtgtgtgctgtaatcccagctattgggaggctgaggtaggagaatcgctggaactggagagatggaggttgcggtgagtcgaggtcgagccattgcactccggg

SEQ ID NO: 563646 - DNA, 287 bp, Homo sapiens
cacgttctgctctcggagagagtatagagagagagagagagagagagatagtatatagcgagagtttctcccttcatttcctcttcccttctcctttctcttccttctcctctccctttttctctttctctttcctctcccttttttctcctttctcctcttctttctcccctctctcctcctttctctcttttccccccttttccctccctcttcctcttttcctttcctccctccccctctcttctctttctcccttcttcttcctcttctcttctcctctccct

SEQ ID NO: 563647 - DNA, 426 bp, Homo sapiens
gtcgaccatttcaacaatgttcacagtgtcatcaccagcagtagattccatctcaagaaaccattttctttaaaaagaaactgctcatctattgatggtatcatgaaattggaaccaatacatctttaggctccacttctaattctagttctctcgctatttccactacttctgcagttacttcctacatggaagtcttgagcccctcggagttatccgtgagtactggaatcagctcctttcagactcttgtcaatgttgatattttgacatcctcccatgaatcatggatgttcttaatggcatctagaatgttgaattctttccaggaaggtttccagttgacttttgcccagatctttaagcggaatcactgtccatgtcagttacagccttacaaaatatagatatataaatatacttttt

SEQ ID NO: 563648 - DNA, 225 bp, Homo sapiens
tttgggggttccccccgggcccctcccccggggccgggggttcccttaggaatttggggagggggtaaacggggtgggcaaacccccctttatggccctggaaagttttacctccccgggcccctttgagcctccaaaggtgggtttccttttttcaaaaatttattgtttgagtttttgttcagcccttgctttccaaaaataaactcagggggacatgctgta

SEQ ID NO: 563649 - DNA, 684 bp, Homo sapiens
ccgctctcgccaggctttcatgtgaaagtgacatcgtgtttaaaccctgcgtggcaatccctgacgcaccgtcgcgatgcccaggtacgacagtccgatctggaagtccatctacgtccttacgatcatcctactatccattgattacatccagagttttatcagagtctagtagacatgtgagcctccaagcagatgcaccgagctgcgatagagccttcaccagatggcaaatatgcattgggacctttacctcagatgcacaagctcataccagggcacctgaagaccagaccagacacctccttattggtgtgtcatcagagcgaggactgtgtctcgctattcactcctccattgctaaacaggtgcaatgtcaggttgctcccctaacagctgctggcaaagaacccatccctgccccaactcgtgaccaaattcgcggcatacctttatcggcctcactcttgccaatttcttggctccctctcaagcactcctcacgtaagccccccactttttgtacacgcttctactctttctcctctgacatactttcctcgttattacttctatctaactctccctctcaccttaattaattctaggtcttcccccttccttttttatcgatcctcagcccctcctttttcctctcaccctctttcacgtcctcgccccctc

SEQ ID NO: 563650 - DNA, 110 bp, Homo sapiens
  misc_feature (108)..(108): n is a, c, g, or t
atcagggtgagcatcaaactcaaactacgccctgaatcggccgaactcggagccagtagccaaacaaatctcaatataaggtaacctagccaatcattctacttatanac

SEQ ID NO: 563651 - DNA, 115 bp, Homo sapiens
  misc_feature (60)..(60): n is a, c, g, or t
atgctgtcagttattcttacaaatagaaaacagactgtgtacaacagtgaactctacagncactagcatccacaaggtaaaaatgaatgtttcatcattcacacattaccacacc

SEQ ID NO: 563652 - DNA, 115 bp, Homo sapiens
ctggtcccccgatctctctaggtctgcaccccaccaagctctccccaccctgcggcccaagagccctgctctaagccagtccgcagcagagataccccttggggcgggcagaggg

SEQ ID NO: 563653 - DNA, 353 bp, Homo sapiens
catgatcaaacagcacccaaagactcgattatgccgagtagtgcttgatgccaagattcgtatactgtgaactgttgacggataaaggcagaaatggatgagagtgcactctgtggccacatggggtctgatgaatatgagcacctggcctctagaaccctggaggctgcccgaatttgcgccaatacgtacattgtatgaagttcttgcactggatcacatatgcgtgcgcggctatacacattacacggaatcctgattgacaagatgtagtcctgagcacaggctgacaggctgcagacaagcatgtgaggcgccttaggacagacatatgcactgcatcctgttcactt

SEQ ID NO: 563654 - DNA, 159 bp, Homo sapiens
tcctgactcaggtgatcacccacttggcctcccaaagtgctgggatacaggtgtgagccactgcgtccagcccagattggttttacaaaacatttttgacacatcttagtcttcatgataggagagtttaatccatttacatttaaggtaataaaccaa

SEQ ID NO: 563655 - DNA, 429 bp, Homo sapiens
agccatggcggacttgagtttgttgcggcgggttttggttactgcggcggcagctctgtctggccgtccccttggcacatcgcctcggatttggggacttcctaactcgcggctttccgaaggctgctgctcctgttcgacacagtggagaccatgctaaaagactatttgccatcagaccttctagattctatgacaggcgtttttcgaagctattgggattctacattgcattgactggcattccaggagcaactttcataactgtggcgaaggtattcattgcacaagctgaactagcagaaatttcagatcggtatggcccagaacactgggacaattatcagcaccccatatcaggacgcttagcccgtacccttgctagtccccggactcttcacatcaccacgcgccggccctcacctgccc

SEQ ID NO: 563656 - DNA, 379 bp, Homo sapiens
agatactctatcaatactttgagttcatttaactaaacttatgaattagtagaataatagactacaccttcagaccttaaactagtaaccttaaacctttaccatattactagcctggtcccacgaggctcctggcaaccacatgggtgcaacaactgctttcatacattgtcaatttctcacagctcggttagatactagcataaccacagacatcagcatctagcagaatacccattagctatctaatatagcagcacatcaatatcttgacttgtcaaggcaaataaaaatctcatgagataataaagttgtactggtcttcagattttatttataattgggaactatcttacacttcccatcgtaaagcttggga

SEQ ID NO: 563657 - DNA, 338 bp, Homo sapiens
ggtcgacttttttttttgagacagtttcgctctgtgacccaggctggagtgcagtgtcgcgatctcggctcaccgcgacctccgcctcctgggttcaagcaattctcccgcctcagcctccgaagtagctgggattacaggcgcccgccaccacgcctggctgatttttgtgtttttagtagagatggggtttctccatgttggccaggctggtctccaactcctgacctcaagtgatctacccaagtcggcctcccaaagtgctggggttacaggcatgagacaccgcacccagccactaaatacaactgcttttaatacaagataagtcatcacaa

SEQ ID NO: 563658 - DNA, 190 bp, Homo sapiens
  misc_feature (69)..(69): n is a, c, g, or t
  misc_feature (79)..(79): n is a, c, g, or t
  misc_feature (88)..(88): n is a, c, g, or t
  misc_feature (127)..(127): n is a, c, g, or t
  misc_feature (177)..(177): n is a, c, g, or t
  misc_feature (184)..(184): n is a, c, g, or t
gaaagagggagcaacggcccatagcctgggggttggacatctctagtgtagcgccacattgatttttcnataatcactnggggtttgnacatttttggggggagagacaggattttcacactaaaanagggacctagcttgaggcaattttaatccctgcactaggcaggtaataanaaaggtngagttt

SEQ ID NO: 563659 - DNA, 1222 bp, Homo sapiens
gaggaccctccctgcttcagatttaccaacagcatgaatcaagaaaagttagccaaactatcaggctcaggtccggatagggggcaagggtacagctcgcagacaagcaagaaggtggtacatagaacagccacagctgatgacaaacaagcttcagagttctctaaaaaaactggctgtgaataatatcgctggtattgaagcaggtgaacatgattaacgcatgcatgggcacagattcattccatttcaacaatcccaaagtccgaagcttccctttctgctaatacctttgcaattactggtcatgcagaagccgaaaccaatcacagaaatgcttcctggaatattaagtcagcttgcgtgctcgacagtttcaacaagcctataggcaagttagctgcaaccagttcccacggcaagtcttggcccagtcaaagcgaccaacaacccagaagcacattgcatgcaggaagcatgcatgcatgtccgagcatcgtgtagcaaaatttggatgaggcatccaacgcactgcaagctacactcaacagtccggctctgctggaagcaggcatggactcagatcaacacaaatcagctatgtggttccaaaagtcctctacagaccatcggcgcaacatcacctgtacacaagttcagtcactctagccctctgcgcgcatcatttacatcacacggccggacagacacaagaactcacacacgcgaccaatcacgaaacaacgcacacagagacacataccctccccaggaatatacacaacgagccacacataatgaagcacggacagccacccgaacgcaagctcacaggcacacagcataccggcaaaacaaaggacaacccgatacgaagagaaaacagggagaaaagcaacaaacaacgcaaaacgcaagaagcacaacaataaatacaaggaaacagacacaggaaaacaacggaaagcagtagagccaggcgcccagaggcacgcaaaccagcccacccgacacggaaactcagcccagcacacgccgatgaagaagacagggagaagggtgacacggagaaaacgacagcacgacaagacaagcagcgaaaggcaagaaaggaccaacagagagcgcgagcaacccaggcaagcacgcgcgagaataaccagactggccaacggcgcacagatgcagaacacggaaaaacaaggcaagctgacacaacaac

SEQ ID NO: 563660 - DNA, 139 bp, Homo sapiens
gctgactatgtgttgtattagaaataaactgagaaaagagctaaatattattcatttacaagaaataccaattacatgttaacataaataacatgtgttaaatgaaaatagatattttccaaaatgaaagaggagggtg

SEQ ID NO: 563661 - DNA, 208 bp, Homo sapiens
ctcaacgcttttatacttcactacaaatattgaacccaggttagaaaatttgcatgcagatcaaaccaatgatcttcaatgctctagtaatacacgtgatggcggccgaactgagatggagaccacatcccatgtgacgtgcagcaagtcaggacatgcagggatgccttcctatggctcacgatggtttcaggagcaagtcgcacgg

SEQ ID NO: 563662 - DNA, 481 bp, Homo sapiens
  misc_feature (479)..(479): n is a, c, g, or t
accggacaaggatgccgacggtgccttcaccgccggccagatcctgcgcgatgacaacctgtactacctggccggcgacttcttcctggccgatggcttcagcctgcgggcgctggcctaccaccacgatgaccgtggcgaaggcctcaactggaacagcggcgcgtggtccaacaagggcaccgcgcaggagattccgatcatcttccgcaacaccatctacaccatcgaccgcgatggcggcacgctgtcgttcgactgggagctgggcgcgcaccgcatcgaaggcggcgtctggtacgagcgcaataccagcagcgccgagcgctaccagaccgccgtggacggcccgcgtgacctgagcggcatgaacaccctgccctccgatgtcggcgtgttcgcccagcgcacgcgctagaagacccaccagttcttcctgaaggacacctggcgcctgcttgatgatcgcctgaccctgngt

SEQ ID NO: 563663 - DNA, 124 bp, Homo sapiens
caccgtcaatcatcgggtaaaagagtcaaggtatatataaaaaacacaagctaattgtctcctcaaattcattttttctctcccactccctttttagtaagaccctgatatttaccacagtacg

SEQ ID NO: 563664 - DNA, 601 bp, Homo sapiens
  misc_feature (52)..(52): n is a, c, g, or t
  misc_feature (509)..(509): n is a, c, g, or t
acgatccttaaatttagagcgatcgcgacgcgctggctcagtcaataaaggntccgggcccaacacgcacattcacagtagttcccagggcagcaggtactagacgttttctattctagtaaatacatgtagttatctctagtagtttctctttgtttttatactagattatgtgaattaagggtagatacacagccattttcagtagatagtcttcgtatttataccttatgccgtttatgtctcctctcttttttcaatcccacgctcattttgtactttttttttattacttttccactccatccatcaatgttaccttcagtccgcactcaattccctatagcaaatttcctccaccgctacaacccctcttcctaacggttccaatctaacgccccccttcttaccttcgcatttgcttctcttactgcctctccctacttttctctttaatttctgctctctctttccatcttctctattcttcccacctttcttatctcctnttaacccttctttcttccccctctagtctatggtcgtttctttttcttttccactcttctcttttttatatttttcctcttttttactcttt

SEQ ID NO: 563665 - DNA, 291 bp, Homo sapiens
  misc_feature (52)..(52): n is a, c, g, or t
  misc_feature (122)..(122): n is a, c, g, or t
  misc_feature (148)..(148): n is a, c, g, or t
  misc_feature (180)..(180): n is a, c, g, or t
  misc_feature (224)..(224): n is a, c, g, or t
acgatccttaaatttagagcgatcgcgacgcgctggctcagtcaataaaggntccgggcccaacacgcacattcacagtagttcccagggcagcagaaagtactgaaatcccaccttatgtnatgaagtgtccgagcaatggtttgtntagcaggcttcctgcagactgtatagactgtncaacaaatttttcctgtacctatgggaagcctgtcacttttgantgtgcagtgaaaccatctgttacctgttttgatcaagacttcaaatgccaaaagaacttcatcatta

SEQ ID NO: 563666 - DNA, 117 bp, Homo sapiens
  misc_feature (22)..(22): n is a, c, g, or t
  misc_feature (48)..(48): n is a, c, g, or t
  misc_feature (69)..(69): n is a, c, g, or t
  misc_feature (101)..(101): n is a, c, g, or t
  misc_feature (113)..(113): n is a, c, g, or t
gatcttgcaggtctagtatttnaataatgcactattacccagggcagntattatgagaaactgtttctnctctaagggtttatggcagactttgctttttnaacatgtgaganatga

SEQ ID NO: 563667 - DNA, 266 bp, Homo sapiens
  misc_feature (7)..(7): n is a, c, g, or t
  misc_feature (249)..(249): n is a, c, g, or t
aaagggncgaatgggtgctgggcaggacaaagcatcagctgtccagttcaggcctttcctctttcccgggggttttcattttcccccgtttccctggtgtcccttaccctttgcccaatttttcattactcctggttttgggagttgccttttgaggaaactcccctgggggtacctgagcctggattaaagggcagggggaggatattgcctagccaaagtgggtgttcaataaaaaaccctttgganatggttttttgtttgga

SEQ ID NO: 563668 - DNA, 249 bp, Homo sapiens
gctaacctaaaagcattctgtcgcaccccagtgatctctccggcctcctgatacccacaagcatataagcattcctttctctctgcaacctagcccgcatctgtcattgacttttaaacaataggcattctgactggatgagatggtatctcactgtggttattctctgcattttcctactaattaacaacgtgaatattgtatacatgtgcttgtaagccacatgtatgtcttctttagaaaagtatc

SEQ ID NO: 563669 - DNA, 214 bp, Homo sapiens
tcaccgtgtggacaggatggtcttgatctcttgaccttgtgatccaccgtgccgtcatcatcccaaagtgctgggattacaggcgtgagcgatgcgcccagtatgttagacaatttggaatgcatcctctctgtgctgttgtggtctcaggtgtgagaggaatatgctggtggggaccaggttacagagttgctgtgagtgtctcatgacatga

SEQ ID NO: 563670 - DNA, 440 bp, Homo sapiens
tctagaggatcccgcgtgaacttctgctctggcaatcaggtatatcatgtctccagaggagcttctccttcaggctcaagcctgttggccaggtggacaggagggacactggaacatgttgtgcttgggaatgctcttctggtgcattggtccctgaaggcctcagggcaggtatgtggtgtgtgggcgaatccacaaagaactggcttccattctggcaggccagcctgaaaaccgttgcattggaggcaggcaggaagcggcaggggtggctggctctccaaggagcccaaactggccttgaagtttcctggcccaacttggggccccccttccccttgctgggggcaaatccttggggaaaggtcttggaaggggttccctggtggaaccttcaggggaaagccaaggggcaaggctggtcaagggccctgaaggaa

SEQ ID NO: 563671 - DNA, 564 bp, Homo sapiens
ttctaccactcagatggattaaatgcctctgaaggagccataagtccgcatttcttcaatgattccaccttcaaaatggagatgttgtgggcagcattcctttcctggcagccttggaatggatggctttggccaaccagttggcaatcttggacgccctgccacagcatatggattccgccctgatgaaccctactactatggctatggatcttgataaaggatctgtttccatgtgtaatctcagcttaaaaaaaatctgtgtgggttgggttaattttggatccttgcctaataatgccaggtaatggtaatggggggctgggtttgtttttatttttatatgttgttagcggcagattaaccccagcccctctgttttttgttaaggaccgttgatactggcattgttccctcctccaacccccttttgatggtaagtaacctttcccctgagccccaaaactgaatgctgaaaagcttctagactgggaaaccaaccctgccttatgtatgttaagtggctaatttaatttccattaaaaagcgttaagtggaaatgga

SEQ ID NO: 563672 - DNA, 685 bp, Homo sapiens
ggttaaagttcaggattgatcctagtctggccgagtaaggcccgtgtccccgtctcaggaaagtagctcggaggcttgaggcgctctaggagaccagaagcctggacgccacagcaggggcaggtgtctcctcaggtgctgtggtctcatctatagtgccacctcagccagtgtacaaccttgggcaagtcacgccccctcctggagactctgaaaatggaacagaaaggtgtggtcatctgtgtgttcctctgtgatctggaaatgctacaacctttgcttctaaggcaggtagtagccaggcatggggacggggcttcatgtcagctcccctttgattaagtagacctctggctcttagcaaagagatgtcctaggaaggaagggcagtaccttggtgatcctgtcttgcacatatagactggagcttcagcccattctcacctctccttcacctgagacctgtggctgcagaaccagaaactcatttccagaagcagcagaatgtctctctttccgcagggctcagaagtatgaattaaggccttccattaactgcatcttactcagctggaaacataaaaactcaggatgcttcttgacggtcaaagaagcatcctgagttaaaagtagagtgcacaaatccaactagtgtcattctgtataagcaaatatcatatagtgt

SEQ ID NO: 563673 - DNA, 941 bp, Homo sapiens
gggcgcgatgatggacgtgctctgccagccatgtgggaaggcagtgcctgcgctgcgcgggaggcgcgggaggatctaggggctctgcggtcactggtccctggctcggttccccgcgaccctggggctcacacttaccctgctgcggatgatgcagctggccgggtgtccaccccgcatcctgcgcccagtctcctcgattcccctcgctctgagcccgggagagcctgaacagctgaagagagttcacttgactccccagccccagtgtgggcccttgtgcacatcatgaccaagttttgaagatgctgacacagaagagacgagtaaacttgtctccagatgacggtttaccatcctggccagttgcagtgtggacatatttcagtcaataagtttaacagagagaaactcccttccagcgaagtggtgaaatttggacgaaattccaacatctgtcattatacttttcaggacaaacaggtttcccgagtacagtttactctgcagctgttaaaaaattcaacagctcagttctctccttttgacaataaaaaaatatgagtaaaaagaccagatctgatcgtggacagcagagagctgggctacctaagttaaaatggacctgccatacaggttgcattggtcagatttcgggagagtatcagttactgaatggagaagggaaagaatggcgagtcattggaattttttgagactcaatttattagatctccaaggatcactctttggcacgaaaacaatttggccacagacaaggcccataaccggagtaatggcacattatattcgctacttgtcctcccagagcagttactccgaaagacactggattacaaatgagtcattgaccaccggaaggtctaacaggaagaattctgctggataagagcctgtcaatgttgtataggacagtaaat

SEQ ID NO: 563674 - DNA, 608 bp, Homo sapiens
  misc_feature (151)..(151): n is a, c, g, or t
  misc_feature (154)..(154): n is a, c, g, or t
  misc_feature (260)..(260): n is a, c, g, or t
  misc_feature (298)..(298): n is a, c, g, or t
  misc_feature (405)..(405): n is a, c, g, or t
  misc_feature (414)..(414): n is a, c, g, or t
  misc_feature (433)..(433): n is a, c, g, or t
accccaataaatgtttgtcattgatgccaagaagatctctgtatagtccccaaatatgtgggaaattataacattcatctaaattactcactagacaaaggagaaatcaaaagtgaaattagaaattatttttaaatgaatggaaataaanacnacatgagaatttctggggaaattcttaattaaagcagaatgatacttaggggaaatttatatcactaatgcctatatattagaaaagaagaaaaatctcaaatcantgacctcggctttcccctttaagaaactaggaaaagangggggaattaaactctaagcagaagaaagaaaatgataaaggttgagcagaaatcaataaaattctaagcaaacgtgatagagaaataaaccataaactggatcttngggaagatngaagttttttgagaaaacnaaccataaactggctctttgagaagaaacctgtagcaagattaatatggaaaggaaaagacataatacaaatgaccaatctcaggaattagagaggtaacatcgtaacagagtctacaaatactaaaaatatcacagggaatatataacaactttatgcttatatttacaactta

SEQ ID NO: 563675 - DNA, 783 bp, Homo sapiens
cacgcgtcgaaggcagcaatccaggccaggcctgcgatagatgagtttgtctctgaggcaggatataaatacagccaaagttcctggggatgcgtgactgggagatggcagttgccctgcctttttccttgtaagggttttttttttttttgagatggagtcttgctctgtcgcccaggttggatttgcattggcgccaaactctcggtcactgaacctctgcctcccaggttcatgccattctcctgcctccagcctcccaagtagctgggactacaggcgcctgccaccatgccgtggctaatttattaggtatttttagtagagacgggttttcaccgtgttggcccaggattggtctcgatctttctgaccatctgtgatccagcccgggtttgcgccttccacaaaagtgctgtacattgtcggtcggtgatcaccaactttgcgtcaacttggctacttgaaaggcgcatacctctgcaacgaccactcgataagacctttcttttccacaattgaagcatgttctttacgaagtgacggcgccagtgtagtcgagaattatcgagtcccctattataagttgtggaaagcgtctcgaattccaattatagagtctgactggtactctgagagaagggccgatctccgaatcctttcggcagctaacccgaagcgccacataaacaaaagcctacacacacctcacacagttcgtcatctggtcgccctcgtaccactccccacacctcagccacatcagaaaaacaccacttcatc

SEQ ID NO: 563676 - DNA, 203 bp, Homo sapiens
gcagagatccaatatgtgcctatccataatgaagagttcgttaattgtaatagctccataccttccactaggcacaaactatctagaggtcattcctggaaagccggtccatgcatcagtatcacatttgtgcaaaggcagatttatcagataaattctttgcaacttctgagggcttcaattaagtaacttaaaactatgaa

SEQ ID NO: 563677 - DNA, 267 bp, Homo sapiens
cacagacagagagagaatagatcagtggctgccaggggctggggaaggaaagaggcatgacggctaatgggtatcaggtttctttttggggcgatgaaaatgttctggaattagacagtggcaatggctgaatctacttaaaaatcagggcaggcgcagcggctcacgcctgtaatcccaacactttgggaggccaaggtgggtggattgtttgagctcagaagtttgagatcagcctggggaacatggtgaaatcccatttttaca

SEQ ID NO: 563678 - DNA, 195 bp, Homo sapiens
gggcctgacgtgttgtgcgcgtgagtgatggtgcatggagtacatacagttcattgagatgccaggaagccaggaggtgagcacccttgggtctgggagtagctccctgaaccccaggaactggagtgcgttctggtgtgcattctcactagcaccggatcgggacacaatagtgcagcaggtcgagctggtccc

SEQ ID NO: 563679 - DNA, 684 bp, Homo sapiens
attttcgctgataagtttctgtgcctcagtgggaggagatgctttttgagacgcattatctttccatgaatctggaattatgtttttgctcaaattatcataagatattcctgactgtttggcaaggcgctttaacaatagttctattcgatcggtctcttgtctgttagcccgacactctgcacttaaagcttttgttaattgaagaagataatcgaaactatcagtaccaccgctattcatatttgcaaatcactatatatactgctctgtgcgaacttatgatggaaaaaacgagcaagaagtaataaatcacggttttactttcttcattaatcgccgaatgctagccggagctttgaatgaaccttttattgtcgttatattgtcatacaggtgtcaagataaacaataaaagttgaagcggtggctcaatggtagagctttcgactccaattaaatcttggaaattccacggaataagattgcaatcgaagggttgcaggttcaattcctgtccgtttcaatttattttttagccctgtgcttgagattatcgtcgacaatgaccagctataagctggcaagattgatgctctaaaacgcggggaataaaataatcaagatgattaattgttgggattccattgttgttagagcctacaatattaggtacacagaata

SEQ ID NO: 563680 - DNA, 165 bp, Homo sapiens
gagccggaccttcaggctgattgcaggcacctactcatgcacctattggaagcacaccccagcaatatcaaccattaaccttccctctacgcgttatcatcttcacaagttctaattctactgactatcctagaaatcgctgtcgcctgcaatcaagacctggaa

SEQ ID NO: 563681 - DNA, 467 bp, Homo sapiens
  misc_feature (423)..(423): n is a, c, g, or t
cagatcctaaagtctgatcgaataataatagcattcttacacattcacctcagcctgtcttaagattcagaaactttccaagactctagagaaatctttccagaccctaggccctagttaaagattagatgttgattgaatgcaacacttctgcttgtaggtgcagtcccacacataccgtggaccttaagatgtctataaacactagaaaaaaacttgtaactttgagttggtctggtgagttacttggcccttctccatgtaatcggttgcagaaataaactttcttctttcccagtctgtctgcatcctattggagaatcgcgacggactgactcagcaaactcctcttttgtgtggttactgggactcctttgggagggaacattttaaattttccatttcaaagggttccattggcancttgcactgttatctctgcctacctgagattgagtctcctggac

SEQ ID NO: 563682 - DNA, 271 bp, Homo sapiens
  misc_feature (11)..(11): n is a, c, g, or t
ttttggacggnggacaggctcacgctggccgactgcagtttcctgcccaagctgcacattgtcgacacggtgtgggcgcacttccgccaggggcccatccccgcggagctgcgcggggtacgccgctacctggacagcgcgctgcaggagaaaaagttcaaaaacacgtgtccgcacagcgccgagatcctggcggcctaccggccccccgtgcacccccgctagcgccccaccccgcgtctatcgcccaataaaggcatctttgtcgaga

SEQ ID NO: 563683 - DNA, 317 bp, Homo sapiens
  misc_feature (4)..(4): n is a, c, g, or t
ttgntgcacaacctagggtcagttttgcaggtggtaagccatttaccaagatagttgtaggtaaagaagggcagatttattagagaaattgtgaaaatatgttgcagtgggcagctcagcagagaaggggcttcctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 563684 - DNA, 480 bp, Homo sapiens
ggcggatcagcgcgtctcctgctcatccaacacctgacgtggatgatcattacccggaatcgaactgtcgatcagcgccagcaattgcgcacccagcgccgtcagaatgaaattctcgccattgccgccctcttcctcaggccgcgactcgataaagccacgcttgaacagcagcgcctcgtaatcggcagcggtcttcttgagtgcgtccaggttgccagtgtcctcgccggctgtcgccttctcggccgcttctggttcggcgtatttgcgcggggcaaagctgccttcgccgttctgcacttcatgcagcagacgttcgatcagatcccaattgtaagtcgtcatcctgattcctcctgcaggccgatggagttagcccgtcttagggagtgacacgttccggcacgggccgttcaaccaaacggacaggcgtcatttctctgaactttccagaggttcgccgcctcaactgcacat

SEQ ID NO: 563685 - DNA, 997 bp, Homo sapiens
tgcccaaaaaattccgcttttttttttttaaatccggggaaggaagggggggaaaagggccccttgagggggaggggccaaaaccaaaaggtagggttctaaagaggcccgggggtttgtgggcaagcgcggggacctgtaattgggggctcatcccggcaggccggttttggttttctaagcccggagcttgcgtcttctgtgggggggcttaccacgtggggggggtcctacccacagagggggcgggggtataccccctctccggtggcatcataaatgctccgtgcttggataaatggggccccttcttgtggggggacctgctgcgtgcccaagggtttctgttcttcaggagaagcccccaatctggttgattagccgagggacccccctctagagaggaagcagagaagtggggccacctccgggacttgggcctacacgtgggttgatgacccgaggggggggggaagacattactcccccgggaggaggcaagaggaaacatctttttgtggccccctgaaataacctatggggtccccccgagaaagtctgctgggcggggatacacacccacccttggaaatgttttcttcggcaactggcttaagaggcccaacagctttgtgcttccatggacccgctggaaagcctatgcgccccctataatatggtgggccggcctgtccccgggggggttatcctcccccgagaaaaacggagaatccgcggctagaacaggacaccccacttgttggcccccaaatggggtgtaaggggccggtatacaaagcggctggcgacactcccaggaggggccccaacacatttgggcagggcgctcgcccggtgtaaaagtcgctcggaaacgaggtcgcgaagactaccgcgtggccgcaggaaaacacgcgcataatcacgatggcggttgatgtgtcaccacagagaaaacgagctgcaggacacacacacagcaacagaacccgcccgg

SEQ ID NO: 563686 - DNA, 203 bp, Homo sapiens
gggggttttcccccccttttttttttaaacgggggggggttttgggggggggccctttttccccctttttttaaccccttgtttttgggggggttttgggggggcccccccccttttttttttttttttttgggggggggggtttaaccccctttgggggtttcctttttttaggcccccttttaaaaaaagggggtcccgga

SEQ ID NO: 563687 - DNA, 143 bp, Homo sapiens
tggtggtatcctccacttagcgggaaaaggctaatggcacactgtccacgtaggcatcaccccagcaagtggttatactaggctaaactggacaaagacctgcaaaaatgatcctcgaacggaaagccaaatctcgccaagta

SEQ ID NO: 563688 - DNA, 327 bp, Homo sapiens
  misc_feature (53)..(53): n is a, c, g, or t
cagcgacttgcccagcgtgagcacgcggacgcagtcgccgtacttttcgccgnacagcgccaccgcgccggcctcgatggcctcctgcggggccatttccttggtctcggccgggacgttctggcggatgacttcgttgacctcggcctcgatgcggtcgagttcgtcggccgtcagcgggccgccgtggctgaagtcgaagcgcatgcgctcgccatcgaccatctgccccttctgagcgacgtgcgggcccagcacatggtgcagagcagcgtgcacaattttcgaagacgagtggttcgagcgcgtggtgtggcgacggtcggc

SEQ ID NO: 563689 - DNA, 359 bp, Homo sapiens
  misc_feature (45)..(45): n is a, c, g, or t
ggggggggaacccttttcccccggggaccggttttgcccggtttngggtttttttccgcccccctttgggggtttgggccccccgggcccaaatttgggccccgggggggggggcagggggggggggggggttaaccatgtcccaaaaaggttcccccccgggggttttgggggggtttttccccccgggggttaaaaattgggggcccggcccggttttttaatttaaattttttttttttggggaccgggttttgggttaaatttcccagattgggggggttccctttgggggaaaaattggtttttggggcccgggaatttccttttggttttcccccataaggccttgtttggga

SEQ ID NO: 563690 - DNA, 363 bp, Homo sapiens
  misc_feature (83)..(83): n is a, c, g, or t
tctaaggaccatgccatactcccatctgtggctgttcttcatttctaatgtcttgctgtgcagaagcttaacttgatgtgatncttgtcattttatttgatgtctggcttatggagtattactgaagaaatatttgccactccaatgtctagagagtttctccaatgttttcttttagtagtttcatagtttgaggtcttagatttaagtcttcaatccattttgatttggtttttgtggcaagagataagggtctagtttcatccttctccatatggatatccagttttctgagctccatttattgaagagtatctttttccccaatgtatgttcttggcacctttgtcaaaaatgagttca

SEQ ID NO: 563691 - DNA, 615 bp, Homo sapiens
  misc_feature (119)..(119): n is a, c, g, or t
taaccccgggcatcacatagataccacaagcctcaggagattggtatattgccctattatcccatagaattgagttatgtggcctatgacccacaagcagagcgcaggagagctccttnctctggcatggattccacagtcaatccatatggcattattggctgtgtgttctttcacagatgtaagcatatcaggatgcctctcggttataaattctatccaagaatagatttcattaagtgagtgattctgttcatagtacgatgcggaggctcggggcctgactgtgtcgttgcaaatctgctgttgaataagatcttccacgtctgccagcaagactgtgcatggaattccgctccacatttaaatgggctttcacattgtcgacatcagaggcatttacaaaaaaatggtcttgttttttcttcacaataaggtcagctgtcccggctgcacagagaacattctcatatgtgtgtagtaagattctgtagaccttgaccttgcctagaggttctaggaagagcagatagaacgtggccactctgaaacgcgaagacattctgctcacaggagagcactatgggtacaaggtgtgcaagtctgcagagcttc

SEQ ID NO: 563692 - DNA, 188 bp, Homo sapiens
ggctcgcattggggcttggctaatttttaagatttttttttatagatggggtctcactatgttgcccgggctggtcttaaactcctgagctcaattcctgcctccgcctttcatagtgctgggattacaggtgtgagctaccacgcccagcctggcaacctttatttcagcaactccatgagctctga

SEQ ID NO: 563693 - DNA, 617 bp, Homo sapiens
  misc_feature (537)..(537): n is a, c, g, or t
cattgatgcagactgacaggcagtcgtagaggtcacagggcaacgtccagaagagtcccagactgagtcttgctctgttgccaggctggagtgcaatggcgtgatctcagctcactgcaaaccccgcctcccgggttcaagtgattctccttcctcagcctccccagcagctgggactacaggcacatgccacctcgcccagctaatttttgtattttcagtagagacggggtttcaccatgttgaccaggatggtctcgatctcttgacctcgtgatccgcccacctcggcctcaccaaatgctgggattacaggcgtgaaccacagcacccagccaagactagatttttaagaaaaggcaatccagatgtcctagaagtgacagaaaacagatcaatgtcaccggccgctggaactcctagggagtactcactgcaaaggagcccttctggagtgatgaaggagcccttctggagtgatgaagatgttctctctcgattgtggtggtcgtggcatgggtacagaacacttgtcanaaggcatggaattactcaagatgggagcatttttactgaatgttaaatataacctcataaaattgattttttaaaattct

SEQ ID NO: 563694 - DNA, 155 bp, Homo sapiens
ccgtggtgtggtgaagaagggcggcagcttcagctgaacgaactgcaaggtcttaagtcctgccacacagtgccttcgcaggaccgcgtgaatggaatgtcccgtatagggacacttacgtccattcttgaatctggacgggtccaccgtgagcc

SEQ ID NO: 563695 - DNA, 571 bp, Homo sapiens
  misc_feature (1)..(1): n is a, c, g, or t
  misc_feature (86)..(86): n is a, c, g, or t
  misc_feature (191)..(191): n is a, c, g, or t
  misc_feature (201)..(201): n is a, c, g, or t
  misc_feature (206)..(206): n is a, c, g, or t
  misc_feature (208)..(209): n is a, c, g, or t
  misc_feature (219)..(219): n is a, c, g, or t
  misc_feature (229)..(229): n is a, c, g, or t
  misc_feature (232)..(232): n is a, c, g, or t
  misc_feature (246)..(246): n is a, c, g, or t
  misc_feature (252)..(252): n is a, c, g, or t
  misc_feature (254)..(254): n is a, c, g, or t
  misc_feature (274)..(274): n is a, c, g, or t
  misc_feature (281)..(281): n is a, c, g, or t
  misc_feature (289)..(289): n is a, c, g, or t
  misc_feature (294)..(294): n is a, c, g, or t
  misc_feature (411)..(411): n is a, c, g, or t
  misc_feature (418)..(418): n is a, c, g, or t
  misc_feature (428)..(428): n is a, c, g, or t
  misc_feature (440)..(440): n is a, c, g, or t
  misc_feature (450)..(450): n is a, c, g, or t
  misc_feature (457)..(457): n is a, c, g, or t
  misc_feature (467)..(467): n is a, c, g, or t
  misc_feature (499)..(499): n is a, c, g, or t
  misc_feature (523)..(523): n is a, c, g, or t
ntggtagacaggttctatcttaggagagatcttccatccccacctctgcggacttttactcacttctcagggacctgcatgggatntcaggcccattcctgaagcagttgttggcagacagagtggaatagtgtttacagcaggcaggcagccttggagtggaggcacacagctccaagtctatcaggaanaaggggaaangggancnncacagagagnaaggaggatngtngatagacgcacgangatctnantctgaattggtgattattanaacaatnactccatngggtnatacattagaagtgctccagggtccagagatttaacatgtaatgaaagatgaacagaaaaataatgaaaaaaggtatgctccacaacaatagcaaaacaaaaatctcataatgcaanagcatcnagtgtttgantctgaggagcgncttgtatgcncagttantctcgttctncctcagctcttgcttgtgcttctccacctgcnattccactttggcctggtactgcntgtagtcttcctggcaggccccagctccagttctttggagcagctggg

SEQ ID NO: 563696 - DNA, 111 bp, Homo sapiens
tgtttgcagcgctgagcttttatttctttttggtatttacctaggagtggccttgctgagtcatacagtagctctgcgtttgaccttttgaggaactgctaaactattttc

SEQ ID NO: 563697 - DNA, 475 bp, Homo sapiens
tacattgtctgatgacagcagggaccccgacatgcagtggtattacatttgagaaaacaggccagccaggtgcggtggctcactcctgtaatcctagcacttcgggaggccgaggcgggcagatcacctaaggttgggagttcaagaccagcctgactaacatgaagaaaccccatctctactagaaattcaaaaaattagccaggtgtggtggtgtgcacctgtagtcccagctactcgggaggctgaggcaggagaatcgcttaaacccaggaggcggaggttgcagtgagtggcgcttgtgccattgcactccagtccagcctgggcaatagagcaagactctgtctcaaaaaaaaaaaaaaaaatctatctttttccacccacacttacacagacacaaaccaaactttcctgtcccatagtatgcctagtgtacggggtccaaaactggactttggactctcatactgtg

SEQ ID NO: 563698 - DNA, 384 bp, Homo sapiens
ggtaacctttattaccgttctttttctctatagctcggcttattccacgggagtgtttcgttgatatgcacacatgattgaggctgctcattgcgataaagattttatacatgacgatttcatagtcttggagatgagtgtcttagcttagtctcttcagcagtgttcatttcgaagatcatgtttaaatattggatgaatgaactgcatttgcgctcagtggagactaattatgcacagttgcatctcttcgtgaaagctatcgtgagatggttgactgctgtgcggttcacgatcctgacagtgaatgcttcttgccacatagatgacgacccagacttatcccgattggctagaccacaggttgttgtgatgagcactgct

SEQ ID NO: 563699 - DNA, 269 bp, Homo sapiens
agttcagtgaggatcacagtctataacagtatgtcgatattagacctgagcacacatcctataccagagatacacttattcactgctggaaaccaattctcacaaatatgtcagtttaccggtcgaacctttaaattcgctcataatgtttaccctaccaacctttattcccactcactgaattcatgaagatgtgcccccgcttggtcggctcaattttagtaaatgtgtgatagtggtactgtcatcatcattcatgtatctaaaac

SEQ ID NO: 563700 - DNA, 148 bp, Homo sapiens
ccgtgtatcatccctccttatgctcatccctccttagctattgtctgggaggagcagcccaggttttaggatgcattcaggtattgtcatgtcctatattacaaaccatggctgctcctcccagacaatagctaaggaggatgagcat

SEQ ID NO: 563701 - DNA, 369 bp, Homo sapiens
attcgcggccgcgtcgactgaattcaactgtccttttaaactaaggagttttactggtctcgcggctaaaattttaaagatgtatgccaggtgcagtggctcatgcctgtaatcctatcacttttggagaccaaggcggggatggatcacctgaggtcaggagttcaagaccagcctgtccagcatgatgaaactccatctctactaaaaatacgaaaattagtcaggcatggtggcacacacctgtaatcccagctactcaggaggctgaggcaagagaatggcttgaacccggtcgacggaagttgcagtgaggcgagattgcaccattgcactccagcctgtgcaataagagtgaaactctgtctc

SEQ ID NO: 563702 - DNA, 366 bp, Homo sapiens
  misc_feature (47)..(47): n is a, c, g, or t
gttttttttccctttaccctttggggcccccccctttttaggccttntttggggggggtttattttttttcttccccccccaagggggggtttttaccccttgggaaaaattttgagtcccttgggcccctttgggctcccctcccccctccccaaaaaattgaaaccaaatttttgttgaggggttctttgggggggcctaaaggtttttgggtttttcacaaagggaaggggccggttttttccccttgggggcttttttgggggggtttcccccccctaaaaaatttggggttttttttggggccttttttccctttttgggcccccggcccccggggcattaaggggggggggtttttttca

SEQ ID NO: 563703 - DNA, 474 bp, Homo sapiens
  misc_feature (30)..(30): n is a, c, g, or t
  misc_feature (65)..(65): n is a, c, g, or t
  misc_feature (214)..(214): n is a, c, g, or t
  misc_feature (231)..(231): n is a, c, g, or t
  misc_feature (238)..(238): n is a, c, g, or t
gacctcctcccaggtggcaaaatagctatntgagtaattgtcaaccgggttgaattcccgacacncttcctgtcaactatgtagcaaagtgaaaactaacaatttgagctctgtaattttgagcacgctctaacaacagctaatataaattagttagattttgcagtctacaatgagctcttgcaacgaactcacgctttttacttttttcccnaactttagcaatgtagnatcttgngccttaatttttgggtttttttaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattg

SEQ ID NO: 563704 - DNA, 125 bp, Homo sapiens
gacccagcaacagacaagttactattcaaaagaagctactcacatcaaatcaatttccagtttcttcccagtggcaggagaatgcctagaccataattttgatctcttctgtgacctaagtatta

SEQ ID NO: 563705 - DNA, 126 bp, Homo sapiens
ttacgactatttcctggaacgtcgacggtgacggtgcgcgccgatgcctatgccaaagaagcggtgcgcatggcgctggtcaatctcggagcggtggcggcgccggccggcaatatgccggtggtg

SEQ ID NO: 563706 - DNA, 323 bp, Homo sapiens
  misc_feature (5)..(5): n is a, c, g, or t
  misc_feature (191)..(191): n is a, c, g, or t
agatnctggtgctgattgtctactgtgggcaggtgttgagaagtcccccctgcggtgaagaacttcgggatctgctgcgctatgactccggagcgcaccacaacatgtactgtgaataccgggacctgaccaccgcagtcgctgtcacccagtgctaccgagacatgtgtgcctggcaccgtgcccgagcncactccattcagatcatgaaggtggaggagatcgcgggcagcaagtgcccgccgcgcgtttgtaagccagtccacgacttccaagatcaggttcccgttgccccaccagaatcgggtaccggggctcgaatt

SEQ ID NO: 563707 - DNA, 570 bp, Homo sapiens
atcatgccacggcactccagcctgggtgacagagtgagactccgtctcaaaaaaaaagagaaagaatgattgataaaccaactgggatactggcggatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaggccgggttagttgcaatgtattcggcaggggaaattgtggtaccagataatttggcagatggttcaccgcaatggattggttaccgagctagattcggaacatggcatagt

SEQ ID NO: 563708 - DNA, 110 bp, Homo sapiens
gtttcatagaaacagtgtaacctaagttgtatagtttttcctcagtatctgtgggggattggttccaggacacccacccccaggataccaaatcccttctataaaatgga

SEQ ID NO: 563709 - DNA, 130 bp, Homo sapiens
ctgatggcaacgaggatcttcgggctgacgacttgcctcggccagccttcgagagctatgagttccatggaggcttgtcctgccccgtctggaggcgcagggcccaacgttagccgtcagcgacggggcg

SEQ ID NO: 563710 - DNA, 120 bp, Homo sapiens
aaaacaaacaaacaaacaaaaaaagaaaaatgaaagattaaaaatgggaccccaggactgtggctggactgggtctgtggcatggggctagtgcggcgaacgcgagacatgctaatggca

SEQ ID NO: 563711 - DNA, 421 bp, Homo sapiens
tgacagaataatggctgcattatatcatagtactgactatcaaatttagataatcttgactttactcaagccactgaacaccaagcagagtgtcatcatttaagtcagctttctttctttcttttttggagatggagtctcgctctgtggcccaggctggagtttcagtggcaccatcttggctactgcaagctcggcctcccgggttcacgccattctcctgcctcagtctcccgagtagccaccacgcccagctaatttttggtattttttagtagagacggggtttcaccagtgttagccagaatggtctctatctcctgaccttgtgatctggcccgcctcggcctcccagagtgctaggattataggcgtgagccaccaggcccggccaagtcagcttttcaatgaagcataattg

SEQ ID NO: 563712 - DNA, 433 bp, Homo sapiens
atcccagagaggctgtattgactgatttgtggatagtgtcttcgtgaggatgcctggagcagaggagcacagccagctcacgcgtcctgcagcacccatttgtcaggagtgccaccggagtgtcaatactgcgaggacttaattaatgaagccatggatgtgacactgaaacgccaggaatcccagctgggggaaatggaccatgccgaggccgacacctcagaaaaggatgaaatggattcagggacgatggttcgagcagtgggtgatgagatgggcactgtccgagtagccagcaacatgactgatggagccaatactatgatttgagcacgatgacacgttgccatcacaactgggcaccatggtgatcaatgcagaggatgaggaagaggaaggaactatgaaaagaagggatgagaccattcagcct

SEQ ID NO: 563713 - DNA, 441 bp, Homo sapiens
tgagcccagatgtcccagccaggctctgtgcacggagatggcctcaacaataacatttataacagccagatgtggaaactgattcctcaccccagacacagcccagcatgcactctcacttgctacatagatcggagcggcctgagatctatggactcctgggtcccaggacaggatagtcctgctttaaccagatgatgtcaaacacaggtgctttttcttcaggattcaaattaccctgcaaaaaagtctattggtgccctgccctgaagacactgggaggggggctgtccttgaacgaacatatgtcttctgctccagccactcacattagctctagagagagcatgtctttagagccctgaatcaaaacagtccaggagtgtggctggtactgcctgagggcaccgttgccgaagcaactgtttttcctcttggaat

SEQ ID NO: 563714 - DNA, 188 bp, Homo sapiens
actatacactaatcaagactattacaggattataaaaatccatgtactgttggatcaaataataaagatgcaaaaaaactttatagagatgtaaaaacaaaactataatggatctcctattttactttaaatacaaaaaataaaaaggtaaatgaactattctcctgctaactgctaaattccccatt

SEQ ID NO: 563715 - DNA, 364 bp, Homo sapiens
ctagaaaaatctatagtaaatggttttgttttcctttcattgcaaagtctcatacttgttcttccaaaaatcagttctatgagttgctttaaaattagcctgggacgtccaagaagtgttaagacatctgcagtaactggggcagccagtccctggaggccaactcagggaacaacaaactccttcgccaagccgtccacacatgccagctgatggtctaggacccaagtatgtgccaagagtgaggtgtcttacttctaaggagaggcaagcagtttgctatgcaagcgggtcgctggccctggacctaaagatcttctctctaactccatattctttaaataaacttgtcttttatgaggaa

SEQ ID NO: 563716 - DNA, 294 bp, Homo sapiens
  misc_feature (15)..(15): n is a, c, g, or t
  misc_feature (130)..(130): n is a, c, g, or t
  misc_feature (174)..(174): n is a, c, g, or t
  misc_feature (186)..(186): n is a, c, g, or t
ttagaggatcccggnctcagtgatctccatactactcattctacttacttttttctggagacaggactgctgtatgccaggctggagtgcagtggcgcgatcacagctcactgagcctcgacctcccagnactcaagggatcttctggtcagtccggaatagatagatggaagncacagacatgcnaccacatccccggataagtttggtatttttggtagagacgaggtttcgccatgttgcccaggcttatatcaaacatgtattatttcttggcattgagatactttgtgg

SEQ ID NO: 563717 - DNA, 296 bp, Homo sapiens
gatgtacaggcagtgaatcgagctcggtaccatctcgtgaccggcgattatagcagttccagtagtgactgattcacatttttttccacatgtgattgcagcactccatatgcgttcagaccgctctcccagtcatcacagtctggtttcttgatatcctgaaagaagatactgggcacctcgttggttctgtagcttcatcagtttctcacaatgtgccctctcctcatgagatagtgggaaaaaagtatttgggaaagttcttcaaagccacataatcgtccgggtcacgagat

SEQ ID NO: 563718 - DNA, 224 bp, Homo sapiens
cagccggctacttgtgtatttttaatggaggcaggatttctctgcttaacccagttgtcgtctactatgtagatttgttcacatgcatgaaaccagtgttttcccaggcaatgtcaggacaatggtgcaatctcggctcactgcaacctctgccacacgggttcaagcaattctcctgtctcagcctcccgagtagctgggactacaggcacacgccacaatgc

SEQ ID NO: 563719 - DNA, 766 bp, Homo sapiens
  misc_feature (35)..(35): n is a, c, g, or t
  misc_feature (63)..(63): n is a, c, g, or t
  misc_feature (69)..(69): n is a, c, g, or t
  misc_feature (87)..(87): n is a, c, g, or t
  misc_feature (92)..(92): n is a, c, g, or t
  misc_feature (106)..(106): n is a, c, g, or t
  misc_feature (113)..(113): n is a, c, g, or t
  misc_feature (118)..(118): n is a, c, g, or t
  misc_feature (133)..(133): n is a, c, g, or t
  misc_feature (138)..(138): n is a, c, g, or t
  misc_feature (140)..(140): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (184)..(184): n is a, c, g, or t
  misc_feature (189)..(189): n is a, c, g, or t
  misc_feature (195)..(195): n is a, c, g, or t
  misc_feature (197)..(197): n is a, c, g, or t
  misc_feature (205)..(205): n is a, c, g, or t
  misc_feature (242)..(242): n is a, c, g, or t
  misc_feature (268)..(268): n is a, c, g, or t
  misc_feature (338)..(338): n is a, c, g, or t
  misc_feature (358)..(358): n is a, c, g, or t
  misc_feature (755)..(755): n is a, c, g, or t
acactgatgtggcagtatacaccaaatccagagtnaggggtgttcattcttttattgggagtnagatanggtggggattaagaagangtttntggaggtttagggnccaaggntggtntcttttttccctccnaattncnttgatacctttctctgatcaggggaaaggngctgagtnanggangttgngttggngngggaaggnttccacttgatagagtgggacagactcctccagagtngagcttggagggagattgaaagtggngataatactgctgacacctcccttgaagctgagatgggaaatggacatacttagaaatttagtgactttnatagcctggattttcctctncaaaacttttagaatggaaaatcccatccccttccttatatagtgacttctacccactaccttctaccattttctactttgggcttaggatgatggccattatctacatgtgttttcagtatttggttggttctaaatgggatctggagacccagcttcttggagatttttaagaggaagtattaactggacaaatggaatgggcacagaaagaaatacagggtcaccagaatggcagaaacctaggtttcccagagtggaaagagagaggagacattcaacaaacaagtatttattgagcgcctactatgtgccaggcactgttctagacccccccagaagaaaaaacaaaaacaagatagaggcagcaacacaattctgagggagaggaaagggnagttgagtaaa

SEQ ID NO: 563720 - DNA, 336 bp, Homo sapiens
actaatctcggtatcgttagtagtagagacggtatttcaacatgtaggccaggctggtctccaacttctggcctcaagtgatccgcctgcctcggcctcccaagctttgggattacaggcatgagccactgctcctggccttaaactttgtttaaagaaagaaataaagcaatgggccagattggtttggacacagattgaacaatttaaacatttattgctcaaaagattaatgaagatcatgggccactaatctgcttcagacaaactgttaaaccagtttttaaaaaactaaatggaacattttctgaatttataccccttgccaagcttgca

SEQ ID NO: 563721 - DNA, 293 bp, Homo sapiens
  misc_feature (264)..(264): n is a, c, g, or t
tgagactgcatagggtcggcgtggtagctcatgcctgtaatctcagcactgactcagaccaaggcaggaagatagcttgagcccaggagttcaagaccagcctaggcaacaaagtgagaccctgtctctacaaacaaatttaaaaattagctggccatggtggcacgtgcctatagttccaggtacttgggaagctgaggtgaggagattacctgagcccaggaggtcaaggcagcagcaagctgtaattgtgccactgcactnccatcttgagtgacagagtaagactctag

SEQ ID NO: 563722 - DNA, 948 bp, Homo sapiens
ttgtgtggagccaatggagcaccttggacatctggagtctggcaggagtgatgacggtgctggaggggctagctcgaggcagtggctggtgggtggcctgaggccaggtgagtgagtgtggagtagtgcgcccaatgggcatctgtgcagacatgggcgacatcaagctgtgtggaccgatgggcctgagctagtggctggaagagaatgggggagccaggcattcatccctggtcactttttggttacaggacgtggcatgctggttggacgagcgggagctggtggggcagggtttgatcccagggcctgggcaacggcgtgtgtactctggcagcagcggtggcacggttgatgtgacccccagtcttgcccgtgtgcatgcgttgatgtccctctcccttccccaggtgcctccgctttcccccaagctctctccttgagacacgaacggctgggtttacggcggatccgagggtgcttgggctgtgtggcagggcaatgctcacgaacacgccttctccatgtccagaggggtgcatcgtgcacttggcgcggccacgtgacgacgttacgccaaaatgtgttgaccatccttcttccggggggggatggcccggacgaactttgctggcaagcgcttggccggtgcgttatcgcgggcccggcttcccagggcgatgaacacagcaggcaatgatggtgccatcggcgggtgcttgcccatgggctgttgtcgccagcgtaacggtgtcccaggcactggttggggggttggttacccccaaggccctgggagtcatgaccacggcggtccattgcgcttcggtgcacgccagcgcacatgagctcggttcccccaagcgttgccaagcctctacctcactgcaattccatttaagttagcaggcccaggcggctgcgtccggccgcgggttttctcaggga

SEQ ID NO: 563723 - DNA, 143 bp, Homo sapiens
ctctagagtgatccccccttaactagagaagaggaagagcgtccattgaaagatactgggaagagaaaagcctggctcgatagtccaagcgaatgatagttagcattcttggggtatccgagcgtcggaattccgtaatcagt

SEQ ID NO: 563724 - DNA, 1032 bp, Homo sapiens
  misc_feature (381)..(381): n is a, c, g, or t
  misc_feature (449)..(449): n is a, c, g, or t
  misc_feature (771)..(771): n is a, c, g, or t
gagaggctatgttccgtagtcagctcagatcgcatcacatcggttgcagacatgatagcgtcgacatggtgactcactgcggtcgtatggatgacgtagcagtgaggtcgctcctctgctgagttacgcgctgttgagtctgtggtgcacccgaagcgggtgtgctgcggtgaggatgctatagacagcctgcgaggatcggagatgttctgccccataccacttcactcgggtgtggtgctacccactggagtcccgagggttaggttgtgattcagatgcgtctactcgactgtgatgcacatacgcgatgtttccctactcgactagaataggcgagatcgcacggatgggctatctagtcaacgctggaaatgacanaggtctgtaccagaagacattgatatgatagccgctgtagtgctagtagtccaacgggaccgctaggnattctacttgattgtagttgcgcacatatggcgtcaaagcgatgctgagcaagccccctagagactatgtcttttaacgccgtgtacgacgtcgccagctagatgggcctttctcggtgaggtgagttgcctgcggcagggtgaatgacattagggacaaggtgccgactgagggggtgaacacccgccaactatcaggggagctatcctatgcttgaaggaacagaggacatcaagtttggatcctctgtgtgtgaggggattactctcctgacgagatttccctaggaactaacagctgcatgtgtagacggtagtgagnggaggctgggagacgattatggcacttagtgaatgactgtttgagcgataggggtgatgacaaaatagcgctgtgtactgcagtggtgcgcatagtggcgaggtgcaatgagtgtgctattctgaaacatgcacgttgaggtcacagggggtgtgacaacggggggtctactcggacagaaagaatggaatgtggcgtcggccagggatttttcatggtgataattgccggtcggaaggcgagtggaccgtaatattggaa

SEQ ID NO: 563725 - DNA, 448 bp, Homo sapiens
tgccacatgtcagtctgagggcctcaacgtgttattacggagtcccccaaaatgaggtttcctcagctttattccaccacgccctttatgtggccccagatatcccgcgaggagctctctggcagctctccgtcctcgatactggagacagagaactgtgcatgctggtcctggttctgtcatagccccttcgtcgccaccacagggttcgccagacagctcctcagcctacctgcgtgccctctttcccctcaatttcggaccctccacatacacagcagagtcttccccgaaatattcgtttgcccagcacgcgggtttcacgacaatgctgctcttagaaatgcatccaggtccctgcgaggagccaggcaatgggtgctcggtgattcttcccatggtatgggaagctctgcggggaccaggacgcgaacgtgagacctgagga

SEQ ID NO: 563726 - DNA, 540 bp, Homo sapiens
tctttcatgggtggcgacgcctgtgagcttctgttttcagaacatacgtccccaaatcataactgccaagtagttcgagtactatggaatctcctatgggttacctgtagctggtgccatttctcctcatcaacccaaatcccgcttcccagatggaccttgccattgtctaggatatacttgtccatgacaggcgcaggagcggggtaataggacgacgtatttgcttcctcactgaaagtgctccgtaactccggctcgggctcgagacattctgactttactttttccagatcaatggcgggaccgctgccaagcctcaggagcagcacgtcctggagcctccggttaaggtcacggagctccttcatttcagacacaagtgccccgtactccttgagcttctgggcctgttgtaccagctgcctccgagtccgctccagctcctgctggaggtggcgcatctcttcctgttgctgctggtagttgcgcagcagctcctcatacagagcccggggcaccacagcatcttctagactg

SEQ ID NO: 563727 - DNA, 678 bp, Homo sapiens
gatcgagtcggtaccgattacgctcatagagggggcaaagctttgatggtatgagaaaacagtgcgattatcttttctttaagggtgtacaatgaatctgctttattatagcattacataggacaaccaggctctaaggacttgggcagcccaatggaaggctctcaaaggcctgtgagtttagctgtcgggcttacgatggtgttaattagccacagggagaaaaaaagccatcctgatgtgggactcctgaagtgtgtcctactgaaagccaaatggagaacggaggaatgtcatcctctccagccagtcatgtacccaccacaagaatccaagcctcagtcccaagcttacacatggaaaagcactgctttcgctcttctccaggggtctacagatatttcctccttgcatgtcatcagatgggtcttcctcctaaatgcctctgaactttactaagatgatccattaggccaggggtccccaacccccagaccacagaatggtaccaatctatggcctgttaggaaccaagccacacagcaggaagtgagtgccagatgagtgagcatcatcacctgagctccacctcctgtcagatcagtgacagcattatattctcataggagcatgagagggatctaggctgcatgctttggatataggttgcatgctcct

SEQ ID NO: 563728 - DNA, 253 bp, Homo sapiens
acgtatatgtaccatgatttataattattaaattacttattataaaatagacacagaagttgctgtgggttttctggcatgagcccttggattctgtgtttagcattcatgatcattctctgggcactttattcttacacaacctttttttttttttttttttttaaaatacttcaggttctagggacccggtgcccaaggcgcgggttggttacatatgttcacatataagggggggacccggagcctcgaa

SEQ ID NO: 563729 - DNA, 407 bp, Homo sapiens
gtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgccagtacctaatatataaactcaattgccaatgaacctccaaaagtaaatttttaatttttttttaattatatcaatacattccacgcgcccccccccccctcgcccccccccctagaaatggaaggtgtacaaaaattaaattaaaacacggtaaattgactaaatatttggtttttatataaataaaggtcataaccacaaaaaa

SEQ ID NO: 563730 - DNA, 549 bp, Homo sapiens
  misc_feature (247)..(247): n is a, c, g, or t
  misc_feature (257)..(257): n is a, c, g, or t
  misc_feature (348)..(348): n is a, c, g, or t
  misc_feature (352)..(352): n is a, c, g, or t
  misc_feature (431)..(431): n is a, c, g, or t
  misc_feature (456)..(456): n is a, c, g, or t
acaaccggtacattgccactatgatccagtgtttttatctcgtctgctgtgtccaggttgctcatggactctgtagtgtccaggtgctccagtcctgtgtgtcattctgtgtctcttccaccatgcagcagtcactgtcttaggaaccatggagaaggcacagacacacctcagcaccaatcaccagagtgtcaccagagtaacaaaaactgcaccaaaataggactgataacaatttaagattgtntgaggggaangaagtgtcctgagggtatatcccgcagtgtgtgcacatctagtcactgtgcttggaagtcattggaaggcctctcggtatgattatgccancaantagttacacattgtatttctggtttttgggaattgggctgtgtgtgtatatttatataaatttcaatttgttttgtaantatgtataatgatgtagtgtatttnacatacatttatggcaaagtaaaaagtaagcactatggatgtagttagatagctgcgactataggggaagcctcagctgatacctgaaccata

SEQ ID NO: 563731 - DNA, 150 bp, Homo sapiens
attgacgtgctgtgtcatggccttaagtatatctgtcacttttaaaatagatggcatgaaatacaaaaatgcctcttggattcccaaatctatcatgtgcaacctctttccagaattcacatcatagtcatttattgctaaatccatgag

SEQ ID NO: 563732 - DNA, 129 bp, Homo sapiens
caccatggtatcccggctgcctgtttccaaggatgagcctgacacactgacattgcgctctggtcccagccccacagaacgtttgggaatggaaagtagaggagcaagtagaacaaataacgtatgaac

SEQ ID NO: 563733 - DNA, 478 bp, Homo sapiens
tgggcaccgagtcctaggacacccccagctccacccaaggacaaatgtagaggtggggggttcttgtgggcctggttgcgtgctgttttcaggacagtgactgtgcagcgtctggacatgagtgacctgcagggtatatacgggggggactttgtccctgcagcccagcactgcaagtgctgtcaggaaaatccacagaccaactccatggatacagctattgctcctccgagagccaaaaatacatcaggatgtggctagagaacacgttcagactcccgcataggacaagatcaacaagatccagccccagaaacctcgctagcacgaagcccagcacagtagggtccgggtgatcctgctatgaaggtgggagactgaaccagtctgtcgccagcatcccacttccagcggatggcagagtgtatccccggggcaggcaaagctctctaccagctgcctgactgagagcaagggg

SEQ ID NO: 563734 - DNA, 253 bp, Homo sapiens
agaagacaagagtataccttcaaagaagaaaacactcaaagaagcagcagtcctgaatggtgtttcatacaactgacagacaagttcctaagtttacagttcttttacattacatatacaatagtgcttgtacaagcttgccaaagatagaatatggatcgccagtctttacatcgcactttcagttcctccatttggaattcaaaaaggggagggatcctgaagaaatcatatgttaaacatactttgacac

SEQ ID NO: 563735 - DNA, 948 bp, Homo sapiens
ctcacgcaagcaacagcatccataatccttctaatagtctatcctcttctaaaatatattctccggacaatgaatcataagcaatactaccaatcaatactcatcattaagtaatcataatggctatagcaatacaattaggaatagccccctttcactactgagtcccagaggttactcaagggcacccctctgtacatccggtccctgtgtcttcgtcgacatgactaaaaattagcctcgcatctctaggtcgatagttaccaaagtctctccctctactgaaatgtaagtccttctccatgcgctctcgtcaatcttatccatcatagcaggcagttgaggtggattaataccaaacgcacagtctaccggcagaagggtctatagccaagtacatccctcgaattatgcccagaatacggatgaatagactagacagtttctagcgggtagcaatgcctaaatgagtaaaccaattcttaacctttaagtactatagtataatcgctaactattgaccggagttcactactactcgatctgaaactccagccaaccacagaccctactatatctcgcacctgaaaacaagctaacatgataaacacccttaattccatccacctcctcttcctaggaggctgcccgtaacggttttgcccaaatggcattatcgagagtcaaaagagcatagttatatcccaagtatagcacatagcttcttaactttaatttaactaagctattgaatcatgataaataatccatattagacgaaataatgggtggagatgaacccccatttcccaaatggctaaggatctacttttcttttaattttaaaagaaaggagaaaaaaaatgggggctaaaaaagggggagaaagtgcaaatggggtgaacggcgaatttctgttggtcggaagagagaggagagagatagaag

SEQ ID NO: 563736 - DNA, 326 bp, Homo sapiens
  misc_feature (48)..(48): n is a, c, g, or t
  misc_feature (53)..(53): n is a, c, g, or t
  misc_feature (74)..(76): n is a, c, g, or t
  misc_feature (90)..(90): n is a, c, g, or t
  misc_feature (100)..(100): n is a, c, g, or t
  misc_feature (131)..(131): n is a, c, g, or t
  misc_feature (133)..(133): n is a, c, g, or t
  misc_feature (151)..(151): n is a, c, g, or t
  misc_feature (163)..(163): n is a, c, g, or t
  misc_feature (185)..(187): n is a, c, g, or t
  misc_feature (246)..(246): n is a, c, g, or t
  misc_feature (310)..(310): n is a, c, g, or t
gacgataggagtttgtggtataaagaagatagcgctaggatcaagtanagtgngattgtgtgcgcctagaggcnnntgagatgaatcttncgtgggctcntgcagattctataggccagcgcattctttancnccggctcttccttcatcntcaaagccagcnatagagcatcttagaatcttgnnngtctgaatagtattctgttgtcatatctcctctgtgtattaaggacttatgtgattatnttaggcccgtctggataatcatggttgatcttcacatctcaagatcttaatcacatctgcaaantctgttcgttccattt

SEQ ID NO: 563737 - DNA, 289 bp, Homo sapiens
  misc_feature (67)..(67): n is a, c, g, or t
  misc_feature (76)..(76): n is a, c, g, or t
  misc_feature (153)..(153): n is a, c, g, or t
  misc_feature (187)..(187): n is a, c, g, or t
  misc_feature (227)..(227): n is a, c, g, or t
caaccaacagcatagatgtatcttcaggaaaaatcccttcccttgtaaaagtcaattcaaaaaaaanttggaagangtgactgttacacccgaggtacagttatcaacgtaaaaacacaagaaaccaatccaggcaacatagcaaaccttgtntgtgctaaaattaaaattaaaatgttagccaggnctggcagcacactgcaggctatagtcctaattacttagcnggttgaggcaggcttgaggagtaggaacttgagttcatagtgagctatggattgataacact

SEQ ID NO: 563738 - DNA, 341 bp, Homo sapiens
ttggggctcattcagggtaacatttctgatgagagatgtagagatctgccttcatccttgtcccttcaggaccccccagcaatcaataagaactacagtccctgatctaacctcagagctaacataaaaattctgaccagcacttggcaacaggcaggggctacagaagcaatggggcccatgcagcagggctggggagagcctgaattaagctagagattcagtcccaagcaactcagccttctacttacaaagcaatcaataaaggatgaaagaaactaacattatcaagcacagaccaggggcccggttggggctaggttatctctttctcccctgaa

SEQ ID NO: 563739 - DNA, 366 bp, Homo sapiens
caatacgaaggacgaagaatatgcagaaccagaacaacaagtacgatacgaatcgagacagtgcagacacattacgcacgtaccacggacgcctaagtaagtataaggagagtcattcatatgcgcggagtagtgacgccaattatcgatttgcgcgagcggttcaggcattgaagcgaagccatttaatgagcagcacgcgcatcatcatatgttgcgctaggtgaaatggaagtagggcttattgtcgatgcggcgaacgactgtcctcgatcatcctataaaaagcattgagccgactacctgaaagtgatcgaggcagtgaaagccgaatatatattcacggtgtagcgaaagatcggaaac

SEQ ID NO: 563740 - DNA, 350 bp, Homo sapiens
aatttgggggggggggtttttccccttggcccccccccccccctttcccccaagggggacggggaagggtggttaaaaacccccttggcgggggttttgcccccccccccagggtttgggggttttgggggttttttttaaaaaaaaaccccccccttcccggggggggtatttttcttttccccgggggttttgggggggggatttccccctccccgggccccccccccccttttttttttttttttttggggggtttttagggggggggggggccttttcccgggggggggtttttttttttttttttggaaaaacccccccttttttttttttgggggcccccccca

SEQ ID NO: 563741 - DNA, 342 bp, Homo sapiens
gcgcactagcctacatgcttcgcgatgctagacagtatcccatcttttaattttggtccatctaatgggtgcaaaatggtatcttgtgctttcaactttattacttactagaggaactatacatcttatcattacatttattattctctgtcacttgtactactgtcactcgtttatctgtctctacttgtatctgtgtgtttttatccaataacaacactggtttgtgtcttaccaacaaacaaccccaccccccccacacaccacaccacaacccacacacaaacacacacacaacaaacaaccaacacacacaacaacaacacaaaacaaaacaaaaac

SEQ ID NO: 563742 - DNA, 265 bp, Homo sapiens
aataccccacgaaaacgtgaacaagtgacatgacaaacacatgcgtcaaaagaagatacacaaatagccaagaaacatgtgaaaaatgtgcaacatcactaatcatcagataaattcaaattaaaaccacaatgagatacaaccttaccccagccagaatggccattattaaaaagtcaaaaaacaatagatgttggtgtgaatatggcgaaaaaggaacacttatatgctgctggtgggaatgtaaattagtacaacctctata

SEQ ID NO: 563743 - DNA, 175 bp, Homo sapiens
ctgtcttagaaagatgtgtctatgcaggatgttctctgcaggagtattcctgatgagctaagctttgtctctgttggcaccagctaatgcagtggcaggtcttctgctggtggtgactctgcctactctacccacttaccaggttcgcgctgttcactggctgcttgggggttcc

SEQ ID NO: 563744 - DNA, 565 bp, Homo sapiens
actatgtcaatcacatttactccctggctgaatagaacgccttgctagtgttccctttcgtgatcttaatggtcacaagtaatatattcactatccagtaccctatccaacctgtaccgaatctctacatggttcatcatgatcactaacatgttatagatttctagaattggggtatgctagcagttttcagaatgactttgtagaaaagaatttagatttcaccaacttaatatactagtaaaagctccataatttaaggtgggtttaaaagttactttaatgaacttctagcgcttatgttacctatactttcatggttgacaaaagtcactatctctaggataattaatactaccttgggaggtattaagaaaatgctttctcggccgggcatgtggctcacgcctgtaattccagcactttgggaggccgaggcaggtagatcgcctgagctcaggagtttgagaccaccctgggcaacatggtgaaactccatctccactaaaatacaaaaaattagctgggcgtggtggcgcacacctatagtcccagctactcagga

SEQ ID NO: 563745 - DNA, 215 bp, Homo sapiens
gggtttttcagggggtttttttggggtttgggccccggaaaattttgggggggggttttttttttttaaaggggttcataaaaaaaaacaagggtttttttttttccaagggggggggggaattttttttttttcgggccccccttttttggggggtttgggggggttgtttttccccccccccgccccttcttttaaattttttgggggggcca

SEQ ID NO: 563746 - DNA, 361 bp, Homo sapiens
cagctcggtaccaaagagtgtcttcaacgaccgtaggacttgaccagcgagcaatcttaaggacaccttccccgtcgcagcataagccatagtgctttgataacctcctgtctggtatctgcgtgttcccgtgagaagtacgaattgcagcatcttacccatgtcgttgcaggcgtcatcccgagcctcgtccatgcgctctgcattctccggggcagagaacgcctggatcacctccgcgaggaccacctttgcttgctcagcgctcaaggccgccggttgggtcgaggcggacgccatagggcgtctgaagctctaggttcagcggaggtaaatggaaaactcacgaatgaagagccac

SEQ ID NO: 563747 - DNA, 108 bp, Homo sapiens
gtcatgtatgcgtcgcgtacatgagtggccatagaatgctgccctggagcaggtaggcggctgcaatgtcccgtggcactgccatgcccgccgcggtggctctgactt

SEQ ID NO: 563748 - DNA, 953 bp, Homo sapiens
tatgtttcccagctggcatgcacaggagaggacatcgctgaaatcacgagagatggaccactggataggtttccacctcagatcaccctcgtggctacgtaggtcttacgccaatgctctgtacagagaccatttacccgctgtccgaccatccgtgtctaggtcacgtcccagtagggggtcgagtcctctgaagcttgagatctatctcaccgactaggactttcggagtttcgcactatgacatgactgagggatgatatacatacgccctgcccgctgtaagctaggtgaagctgaagaaggcaaaaggcctgttctgagtggggagacgccagtaggagtcctcacgttcaggtccatgcataggtaccaatgctccaggcatttggctcttcgtggtgactggtgtgtttcgcagggtaatttcaagtcagaagtttcagaagctgttcgcttgtgaccggtactgcgttgtcccgggcgtggtagttctgtcgagtgttgcaaggggaaccttgttgacagctcctgttccaccacttctggcggtttctcacgattcctacacgtatcctgtgaatgctgcgctggagccgcggtgtgggtacttggagtaggcacctggccctttctgggttccaggctacggcaactgccgtagcgttgtccggaagaagaccaggcgcttcaaaagaaggtgaagtgtgcgcccggtgggcagcccaacatctgtagttctttgagggacgccgacaatagttaatcgttttccagacggcataggataggcccttcaaaaaggcttcggggtcacggacacagaaagacaacaggggtttgtggaatgtctgcccattgtttcacaccgggaagggtccgcacctgtgtatcacgtagagggccgtgtaaacacattttgtcgtgcgcactaacactctacacccagggtt

SEQ ID NO: 563749 - DNA, 632 bp, Homo sapiens
  misc_feature (590)..(590): n is a, c, g, or t
  misc_feature (600)..(600): n is a, c, g, or t
tattaaaactatcttttcgtatgctattttaagcttatgaactgaaagtcttttagagataatttacttcaatgaactattattatttattttatgcacaaattgtcacaacttggtcttagcaagctccactgttcgcttacagtctctaatgtttctgaaagcatccatgatttctgctacaaagatacttaggaactactctgttttcctactctgagacctaaaattgactggttcttcaatggaaatgagatccatatctaggcactaagggtatacagaaataattgtgggcaaaaggactaatgcgatttttgttgcactatattttgagatctctttaaggctctatgttcttattgatttattcctatttaatgtattacactattgcatcctactttttctttttaaatatattatgattgactgttaacagactttctgttaaactgacaggaagtttttataaacaataacagcacttacattttgaaagactggttcccattgttctcttggtccaattgcatctgaacgcccaacaacaagtccatttgaatttatacccagatattttccatagncagactttanggcgaatcttgaaataagattatttgacagcc

SEQ ID NO: 563750 - DNA, 521 bp, Homo sapiens
atgttaagaaataatgagtaagcactttaatttatggtgttagtgctttatctggtaactctgagtatagaggccatatatgttttaaaaatttacagggaggtttatatatttttttgtagcatattaaatttttattcatcaatttgccagattttgaggtatgtaggggttatcttgatttctcacgtcttgcaatttcagtcagtcctattacctgttagtctggaccctgcattgctttttacaagtttgtcttttgcttgcagtactttttcattgcttctttccttgggatcagagagccgagaagagtttcaggagatttgtgttaatagttaattgatccacatgtgaaggttgtgagtttaaattcccaatttgctgttccattgctacatctcgaagatttttcctgcaattagaaactacttaaactgttaacttttatctattattttgaaactagacatttttagtgtttaaacttttttaacattaatgtacaaatgaattgttag

SEQ ID NO: 563751 - DNA, 453 bp, Homo sapiens
atcccaagctctggtcaggaccataaggatagagaagaaataatggatattcaacatcaggaagagaggaagtcagatgtctctgtttgcagatgacactgatcatatatttaggaaaatccatcatctcagcccaaaatctccttaagctgataagcaacttcagcaaagtctcaggatacaaaatcaatgtgcgaaaatcacaagcattcctatacaccaataatagagaagcaaatcacgagtgaactgccattcacaattgctacaacaagaataaaatacctaggaatccaacttacaagggatctgaaagacctcttcaaggagaactacaaaccactgctcaggaaatgagaggacacaaactatatgaaaaaacattccatggtcatggataggaagaatcagtattgtgaaaacggtcatagtgatcagagctagtgtaccgag

SEQ ID NO: 563752 - DNA, 175 bp, Homo sapiens
attgtgtgtctcgaccagtgccgcagcgtgatcaggtgctgcatgaagctcaacgccgattccaacaaggccatgaccgaggtcatggccaaggtccacgaagtccaataccgcctgccgcaggacgcctacgacccggtgctggtcaagtccgccggcgaggcgacggccgtgg

SEQ ID NO: 563753 - DNA, 211 bp, Homo sapiens
tgactctccaggatctctctaagtggctgtatcatataagacagaactatgcacaaaaacagtatgattatctcaatagattcagaaaaagggtctttgacgaaattcagcaactcttcatgctaaaaaactctcaataacattacgtattgatgggatgtatctcacgataaataaagagctatcttatgataaacccacaggcatttag

SEQ ID NO: 563754 - DNA, 150 bp, Homo sapiens
actcctgaaaagaaaatgacgttggccgggcgcggtggctcacgcctgcagtcccagcactttgggaggccgagacgggcggatcacgaggtcaggagatcgagactatcctggtttacgcggtgacaccctgtgaatactacaaatcca

SEQ ID NO: 563755 - DNA, 247 bp, Homo sapiens
tgctggaattacaggcgtgagccactgcgcccagcccacgtacaggtttttgtgtgaacctaggtcttcctttctctgggataaatgaccagaagtgcaactgctgggtcatattgtagttgcatgtttagtttttgggttttttttttttttttttgggaaagggagtctggctctgtggcccgggcgggtttgcgggggccccatttgggttcattgaaagttcaactttttaatttaaggcaat

SEQ ID NO: 563756 - DNA, 120 bp, Homo sapiens
  misc_feature (5)..(5): n is a, c, g, or t
ggatnggaggcataggacatagggagggaaggtcccgtgggtgtcatgcagaagaataaaaactggacttcttcctttcacattatacaaatattacatcaagatggggtaccgagctcg

SEQ ID NO: 563757 - DNA, 994 bp, Homo sapiens
tgtgtggctggggtccagtgtggatggtcttgagtgctatcagatctggtatggcatttggcgtctgggccctgcaaggcgggcgctagctggctcctgtggcagctcgtgccttgtgtggtgcttcggggccccgcagactgcggtggcgtatgagtgagggctgtgctgctccactgcggaatgtcgtgagcctcctcccctggatagggtgtacgagatccctggactggagcccatcacctttgctggtgggaacgatgcactatcgtgccctgtgctggctgcgggccgaatctatatcctgcccctggtgaccagctggatacaatggacccgaagggttctacctgctcgccccctcttcacgacgcatccgctgtacaaagaccaggcctgcataatatctttcaccaccgttgcccgacttctcgagggtgtaaatgcatggccctctggctcaccaagaccacagttaatagaaggccttcccgagaaatgtgcttagccttgttgattgatccaaggaaccacatagagaacccaaggacgaagtgcgtactgaactgtgatctctcacgcccgtctctggccagagcacttgagtgaaatccccaaagagagagacctactggccggtcaatcgtggacaagctaatacagctgtgtcaatctcagattctcaagcatccttctctggccagtgaggatctgtgtccaagaattccagtatactgattatctggaaccgaagagtctcttctcctttcaagtccgtggttctgggtggagcccgactgagcacctaaggactcctcttgccccacacattcgcctccagaagagggagcatggacgctaactaagaagtcatgtactagaggaccttctacgccagatataagacaatgcatcgatcttcgtggcatgccatattatgcatgtgacacacatggacgcagggatcacaggaacggcaatccttaccgctatc

SEQ ID NO: 563758 - DNA, 82 bp, Homo sapiens
ggccacctggcacaacttccattcctccctttcttcccggatgatcacggggatctgcttgaccttgggggccggggagaac

SEQ ID NO: 563759 - DNA, 332 bp, Homo sapiens
acggtttatcctaaggatatttaaggatacaaacaaacagccagaggaagagagacatagggcgaggtctgagtgcaggagcttctgtccctgtagagttggggtttgccattctcctggcatgtggatgagttcttgttcacctttctgtcagtctccacatgttcagctccctggaagtgttcagctcctggaagttcactaaaccctgtcctcttgggtttttatggagtcttcactatgtaggcatgattgattcaatcatctaatggccattggcgatcaacttgaccttctccccttccttccttcctcccctcctcccctccttc

SEQ ID NO: 563760 - DNA, 324 bp, Homo sapiens
gaccccggaaattcggccataatggccggtaggagattgccggcaccgtggcttttgccatttaaaccttgaccctaatttaacggtccaatcaatataatcggggggccaaaattttccaacattcttttttgtgggggccaccatttttgggcctccatggcctgttgacctgccaagccaatggccagttaagaattcgaatttaattgggcctttcggaatgggttccttaataagcatttcaaaaggttttggggtttaatccataatggattaaagttggaacttgggattaaagaatggtttaaaggcaccaccagc

SEQ ID NO: 563761 - DNA, 410 bp, Homo sapiens
  misc_feature (19)..(19): n is a, c, g, or t
acagtgtattagtccactncagctgtacgtctctcctcatgagagggtgtgaatcgtgatcaaaaacaaatggaggacgggaactctttaactgtaagacgtacatctttagtgctgtgttaccagacgaagtacttattagctcctactccagtggtctgaaatcactgaaacagctcacagtccagggcaagccacaccgcctcggtgtatggatagcatttctccatttctctacatgctgaactttggtttttgagtcacataaacatatctggcctttaaatcactcatcctgtgattaaactagaaaaatgacttaaacttattaggtatctaaagaaaaaacttagggttaggttaggtttctaaagaaatgaatgctcagtcacgctatgcagatctcagag

SEQ ID NO: 563762 - DNA, 681 bp, Homo sapiens
gctcccggcaactttctccctcgcagcgccccgcccgccctgcggctccccagccccaggcctgggatggcccagatgggtggaaccccggtgctggtggcctgccctgtgactgatgtgcagctgtgctggactgtggcatgtgatgtgaatggcagtgatgtgatgggtacctggctgtgcagtgatgtgggtgcttggtgtgtgttgactgtgtggtgccctggatgcagatgtgggtgtgtggagcccagacattgatgcatgagcttccatgtgatggccctggccatctatccaccctgctggcctgcctggaaaataatttttgtcttgacttgaatggcaatgatgtattggtctggaatgaacttgatcgccctgctacatcaacgcttgagaactgtgggaatgaccctgaactctgaaaacatggtttctatgtcacatccagggtttttggccctgaagggaaatcaaggtgaaatccatgtccaatgtttgaatgtgaccatgtgtttccaaatggacaatggctttccagacaatggcaaccatgtcctctgcccagctcatctccgcgccttctctgcaggccaaacttgggtcccactggtcctcatggcctctgagcttttccagttttgtgtctggatggatctggggccccctgggaatgtc

SEQ ID NO: 563763 - DNA, 90 bp, Homo sapiens
tatctgcttacacgctacctcttccgtttgctatattcctttttctactacataattgtgaataactaataaacacagctattgactatg

SEQ ID NO: 563764 - DNA, 368 bp, Homo sapiens
tatttatttgagacagagtctcgatctatcacctaggctggagtacagtaggcatgatctctgctcacatgcagatccgcctcccgggtacacgccaatctcctgcctcagcatccagaatagccgggactacaagcgcctgcagcacgcctggccaattttatttttgtatttttagtagagacagggtttcaccgtgctagccaggatggtctcgatctcctgacctcgtgatctgctggcctcagactcccaaaatgctggggttacaggcgtgacaccggcgcctggcttgggtaaggcaatttcttatccatagcaatgcaaataaattttgtctgataaagatacaattggtcgacgcggcc

SEQ ID NO: 563765 - DNA, 136 bp, Homo sapiens
ggggtgacttgaggatccggcacaccgctaggacaccgtatgcacacccgtacggagctggtgtccccgctccggggctcacatattgatgcgaacttagtgcggacaccgatcgcatgcgcactacagcccggta

SEQ ID NO: 563766 - DNA, 448 bp, Homo sapiens
  misc_feature (7)..(7): n is a, c, g, or t
  misc_feature (38)..(38): n is a, c, g, or t
  misc_feature (45)..(45): n is a, c, g, or t
  misc_feature (216)..(216): n is a, c, g, or t
  misc_feature (443)..(443): n is a, c, g, or t
  misc_feature (445)..(445): n is a, c, g, or t
caaaaancccatcaaaaatccccctaaaactgtcccanaacccancccccctccccttcacacctgggtccccaaacttaatgaaaaaacccttcctgatgacctaataccagggtgctggcacccataatgaagtgttttgaatagcagaaatgggctaggcatagtggctcacgtctgtaatcctagcatttcgggaggctgaggcaggcggancgcttgagcccaggagttcaaaaccagtgggctgggcaacatggtgagacactgtctctataaaaaatacaaaaattagccgggcatggtggcgcacgcctgtggttccagctactcaggaggctgacgtgggaggatcactcgagctcgggaggcagaggttgcagtgagccaagatgacaccactgcactacagcctaggcaacagggtgagaccttctctcaantntta

SEQ ID NO: 563767 - DNA, 1590 bp, Homo sapiens
tggaaaatgaaagtggttcccctcatgggggtttttaaccacgcgctctctctcaccaagcgccacagagggccgctctctcttgcgactctcgccgcataattcccagccgcgaacggcaaacagggggagaaagataaggagggacacgtggaccaggggctgcgataacaagagccaaatggccgcgcaaatatacaaacgcggggtgttagaaacaccacagagaaagacaagcgggtctaacacaaagccggcatcaccgacaaaagtggggacccttcaaaaaaggagaggggtgagacaaaaaactcctacaacgatgaaaaaaagagcctgcagagaaacagtgggagacagacccaagagagaacataaaacagatctgatatactaaaaacacgcgcccaacgtgacacaacacagatactccccaacacaaatcaccacttaacaacagggaacaggagcgcgaccaaaaaaaacattggcgcacacgaacacatatacaaaacaacaaacacccgtggcgactaacataagaaacaacgcaacaacaaacaagggagcgcaatataaagaacacaagaacaggtagaccaaagagagaagacaacggcacaccaaaaataacgtagggaagatgaagagacaccactacaatgagcaacacacaaaccaccaacaccacagtgatgggagagaaataaaacacgaagtgacaaaacaaaccggagtcgttaacacaaatcaataaatgttgacacaaaaacaaacgaaaaactacacaaaacaacaagatcagagtaacacgaacaaaaacaagggtgcccaaaaacacacagtccgacatacatcacaacacacctcaacataaatagaatcagaggaagaacaaaaccaataaggacaaacacaccaaaacaacacaaaacaaaaaacaaacaacaaaaagactaaatcaccaacacacacacgacagatcactagaagtgagcacaacagcactactagacaacaaagcacaaaccaaagaatacagaactcacaccacaaggaagaacgaaaaaaacgacaacatcaacacgaaacagaaatgacacacaacacagaataccacaaaaaaaacagagcggagaacacacaaacaacaaccaaaacagaggcaaccgcaacagcaaacacctacacacaaccatgagcactcgcgcaaaatacctacaacccaaaactaaacgagcaggagaagacagctcataacacacaaacaacggatcaaaatcataaagatcaagaacagcaacgatcaacagagcataaccacacaaaaatccaacacccaccaagcgcaacaaacagcgaaacaagcccagcaagaaggacaacacagaacaagacaacagcgagaagccaacaacacaaagcaaacaggcgccacactaacaacacagccccaaaaaaaacaaataagaaaagcaacacacaagacataaacaagcaaccaacaacagagcacagcaacaaacaacgagaccacaaacaaaaaaataaacaagcaaacatacatcatcgagcaaagcaacaaaacca

SEQ ID NO: 563768 - DNA, 293 bp, Homo sapiens
tgaaaaatatagcggcgacaattttattgaaattaaaaaatcacaataaatctgctcgttagtctcgcattaaatcctaattccaacaagctgaaaacttcttgctggatggttaataaaataaaccctcagggccgaattttacgccagagacaacacgattaataaacttaatcctgattattatttgacaggatttttatattttgccccctaagctgtactcgtccatacatcgagctatagcttgaacgttgcactcacaacctatactggtcgtctctaatgataca

SEQ ID NO: 563769 - DNA, 269 bp, Homo sapiens
  misc_feature (97)..(97): n is a, c, g, or t
gcgcccttctgcactgcactttcgcttcgaacagcctgcagacaattccccaacgttgatgtgacatttaataccatgttcagagcctgtcctgctntgattactccctatgctggagtaccccggggacagggaaatgtaagaaaagttactatccaggagtcctagtttcgacaggacacagactcaaccagctcggtgtgggctggctggacggttgaggctgataggtggggctgggctggccatccatgcccagaatcgtgccc

SEQ ID NO: 563770 - DNA, 431 bp, Homo sapiens
ggctaatttttggtattttttagtagagacggggtttcaccttgttagccaggatggtctcgatctcctgacctcatgatccacccgcctcggcctcccaaagtgctgggattacaggcgtgagccaccgcgcccggccttttttttactattatatttttattttttcccaaatattattcatccatggttggttgaattggcagatgcagaacttgcagacccaaaaggtcaactgtatgtaaattattccatatttgttaaagttacagcatgattgttataaatttatgagctttagttaatatttttctattgtgttagtgacatgattgcatttatggacatttaccattggctccagttcaaatgatagatctttgataatgggactttgggaaaatggagatagacaaattttcacattatct

SEQ ID NO: 563771 - DNA, 167 bp, Homo sapiens
cttgggaccgcacacacttagcagcgcatgcactgacacattcattggcacctgtatatgttccctaggttcccagaagtctgattcttttttgagagagggtctcgctctgttgttcaggctggagtgcagtggcatgagcatagctcactgcagccttgaactcc

SEQ ID NO: 563772 - DNA, 405 bp, Homo sapiens
atttttcttccctcaaaactaaatggatatagacctcaaggtttcttgacaatataaaaagaaccctggaacatttatttattgcccattttatttctaaaagacccaagtgttcttttcataattaatcatgttaaggatttttgagtgcccccccacccttgaaaaaaggggattcaacccaaaaaaaccttttcctaaatggtgcttttaaaaatcaagtgtattgctggttctgctgcagtatgtagtcgaagaataaattagtaaattgcttctgagggtctgaaattgaataaagtaatggctttgtatttctataaaagttgtctccccttgtttcctttccattctggcacatgtagacatttaatttatgaataaaaccctttcctgtccttcaaa

SEQ ID NO: 563773 - DNA, 634 bp, Homo sapiens
  misc_feature (599)..(599): n is a, c, g, or t
attcctgaactaacatatctcaagtgctggggactgtctgtaatagtatacaacaaagtggagcactatgctttgaaattatcatccaagtgaatgctgaaggaactttaaaagtaaagatagggaaggagttagtcttataattctcataattccacagatgccgttggtattcaggaatactattctttaaagactatcaatattctacaaagggaaattcacttatagttcccaattgtgaatgaaaaggagtatcaataggcatgacccaaaaccttcttctacacagttaaacaaaatttctcaagacctgatttaagagcaaactttttaaactgagtacttatggccgggtgtggaggcttatgcctgtaaccctagcactttgggaagtaaaggtgggaggattgcttgaggcccaggaatttgagaccagcctgggcaaaatagtgatacctaatttctacaaaaatttttaaaaattagccaggagaggtagctcacacctatagtcttaactactcaggaggctgaggcaagagggtcacttgagcccaggagtttgaggctgcagtgagctatgattaagccacagncctctagcctgtggcacagagtaagaccccgcttt

SEQ ID NO: 563774 - DNA, 193 bp, Homo sapiens
tctagacgatcgcttagggtttgtgctcactctcccgcttctgtccggagtgcaccagcgtgattgtagaacgtcttggactgatgttgtgggccgtccagtgacaccgtgatatcaccataagtgcgtgcaaagtggaacaccatgcccgccacgatcatggtcttggacttggggctttcatcctccaggc

SEQ ID NO: 563775 - DNA, 110 bp, Homo sapiens
gcgtcatcatgccatcatgagtcccaatcatccaacagggcaatgcatcagccattgcaaggcatcggggcatggggcatccctctcacagtcgcacctgccaggccatg

SEQ ID NO: 563776 - DNA, 586 bp, Homo sapiens
tcttgttgcagtgaaataacctcctgctccagctcttggcatcgaggacaatagccttcctcgtcctcctcctcctcctcttctggcagtgtagatgaagatgggtggccatgggattcggacgttgctggggaagtccagccacctaatgtatgcacaggagaggttgacagaggatccacgtcggccagatggccatattcactggctgacgaggggtttggagttggaaagcttcccgagagcaggtaattttgtagagagtcagtgaaaaccctcaaaaaggcagaagtttgttgtttcctttgcatatactgcatctctatgtctacattgtctgaggtctgactgtggacccctttcccaatgtgacagtgctcctgtctttcgttgtaacttgagccttcctgctttacgcaagaaatcatggactgagaatggttggagtccaggagttttcctccacaatttaagaggctaagaactcgactgcactgctgggcaaaggcatccaagatcattcgactctctgcgctgagctccaggctggcgctgtcgctacccgtgccgccggtgccggcggccg

SEQ ID NO: 563777 - DNA, 180 bp, Homo sapiens
atctagaggatcccgctccaccgtatggggtggtcagatgttcgacattacaagcagtggaccttcaattacattctaccgggagcttgcaaaagtgcccaccacgtgccagtgtgcgtgctggggaactaacgggacatgggcgagcaccgagtcatcctgccggacgatgtgcgtgac

SEQ ID NO: 563778 - DNA, 224 bp, Homo sapiens
agctaccgttatccgagataaggaggcccgtgagatgtcaccagatactcagtgataacagtgcccctaattaataaaggagggatctcgatcctggaagatggtgataagcaggccattgatgacaagcttcccgttctcagcctagacggtgccatggaatatgccatgggtggaatcatataggaacatgtaaaccatgtagtagcggtcaaagaaggggt

SEQ ID NO: 563779 - DNA, 448 bp, Homo sapiens
ggtgctagagaccataccagctatcagaaatagatctgtataaagaaggtaggtagggaaggggagagtctacactgtcatatatgtaagggagcatctctttccccagaaaggagtatgtaccctcctgggaaacctggttggacccaaggccaacctaatacccatccaggcaggagtactgcctatgtagaggggcagaacaaaaacaaagggggtaatatgaaccaaaagtattactcaaatactttcgggttcctcctctaacagagaaaggcagaaagaaaacagtatttcaggatttgagtttcccccctatctgaaggcagagggattggactgtgcctttctcctttaccatcatcccattccaagacattgttaggaagtaggccagagtctcacttagacctcctttcttcatcctctagatgtcgtctacaagtca

SEQ ID NO: 563780 - DNA, 432 bp, Homo sapiens
ttgtgttttctctagtgtttatacttccacttttaggtcttgaatgactttattcaattccttcacctgtttatctgtgtttttctatatttctctgagcgagttattgatatcctccttaaaggactctattatcttcatgagataggattttaggacagaatcctgattttcaggtatgttggtatattcagggcttgctgtggtggaagaaccagtttctgatgatacccacatattttggcttctgttgcttctggttttgtgctttccttttgccatctggatatccctggtttttgttggtctgagtgactgtctggaatctgctccttttgtccctggattgctttgggcctcccagtaggcctgcagccctgactatatcagaaaacctgtgcggccttccaccgtagacgcgcccgcgaattt

SEQ ID NO: 563781 - DNA, 112 bp, Homo sapiens
acctactacgtttgtctgtcccagtgctgctcattggctttgaccgagatggtgacgtagatacgtgtaaagtgctttggtgctttcccatttggtttgaccctgtggaaaa

SEQ ID NO: 563782 - DNA, 775 bp, Homo sapiens
gcgaaggaggaaacagaaaagttatcatgccagagctacgccagcgagaaatcgagagagagagagagctagcgagagaagataccgggatcgtgccaaggaacgggagagatgcgagtgaacacagattatgaagaaaccgagcttatcaggacctacgagtctaaggtatggggtgtgttggacctccagatgttgaggctggacatatatctagagtgacaggagaagagaagacgagttgatcgaggagtccaaattcttgggtggtgacagtggagagcacacccatttggtgaaaggcttggattttgctctgcttcgaaaggtacgagctgagatgtgccagtaaagagagaagaggaagaggaactgatggaaaagccccagagagagaggcaagtaaaagatgaggatcctggaagaggataagaattgaattgaaaacgcgtctggggcgataatgtttaccgaatgcttgttaagagcaaagcgatatgagcggtaatgagtagttcctggcggggcgatggactatgtggtagagctggatgatgagtatgctgacacagatatccccacaatcttatgcgcagaagaggtgattgccccaccatggtaggtccagagcaaatgacacaagtgaggatgtcattagcaagctgaccgagatcctttcatacctgaggcaggaacccgtacagaagcttaagaagaaggctaagggaagctggaagagaaaaacttctgagggtgatgaattttttgagaatgg

SEQ ID NO: 563783 - DNA, 160 bp, Homo sapiens
  misc_feature (7)..(7): n is a, c, g, or t
  misc_feature (13)..(14): n is a, c, g, or t
  misc_feature (24)..(24): n is a, c, g, or t
  misc_feature (39)..(39): n is a, c, g, or t
  misc_feature (47)..(47): n is a, c, g, or t
  misc_feature (120)..(120): n is a, c, g, or t
ccggtcntaaganngaaggaaaanggaggaaacttgacntcaaacangcctccctgccgtgaaagttgctgaaatatcaacggaacatcgtttctagaaaggaaaaaatttctgcattgnaaaagcaagccaatcacattgttcagcaggctcagagaga

SEQ ID NO: 563784 - DNA, 987 bp, Homo sapiens
  misc_feature (178)..(178): n is a, c, g, or t
  misc_feature (832)..(832): n is a, c, g, or t
gagatctcgccggctttacgttcacgctcggtgtctgcagcaccctccgctatcctctcctagtcagacgagacccagtgttgctagaagtatcaccatagtctgattctcagcggatcgcatgccagggtagcatcgttttgactctgctgcgggaatcccactgtatgaggttgantcatcttcagcctcgagaacaggtcgtcttcagtagtcgtgctgtgcgccacgctggtgtcttcgaatctggttagtcgtactgtatggcccgtaaatgcctccgggtcctgagtgattaatacttcgcttatactggggaacgggtgtcttcaaacgtgctgttgtagcactgtccagataccacttattgcgtcgcttgccctggtctagcgagagacttggatgttgcacgcaacatacgatcatagattgaccagatacgtgtagtgagtctgcatgatggactgagaagcgagacatgataatctctaacgtgtgtgctcgccttaaacggccaattctggggtgtgtccctttggccgtcttgcgaaaggctggtgccggcttcgaagaatgcggcggcttgccctctgtgacctgccatgagtcgcctgaagtttagcggcattgagacaatctcttgtagagttcggtaccttgcacaaagatacccctgcgtcgtttcgagatggttccgagtccaatttgggccggttcatcaattgtctcgcttcgcaactaaatgcctgggcccaattgcagtgcatgcttcagttgaatcgcttccccaagtgctggctgcacgtcacacacatctttcgagggggaaggnctcagtggagcctgttttggagtcctagggttttacccaacaacgcttgagtgcacgtgttcatccaggggactacacattatgggcaacaggattgccaccaaatgtagagggagtaacggcggggtttgatccccaggatcctggacgaagtg

SEQ ID NO: 563785 - DNA, 133 bp, Homo sapiens
  misc_feature (21)..(21): n is a, c, g, or t
  misc_feature (57)..(57): n is a, c, g, or t
  misc_feature (106)..(106): n is a, c, g, or t
gccaggccgctccagaccatngaggagaagaaagcacatgggaccactgaagaaagnccgaattgcaaaggaagaaggagcttaatgccaggaacagagcagttgntggggtctcaataaaagttatccactt

SEQ ID NO: 563786 - DNA, 445 bp, Homo sapiens
  misc_feature (6)..(6): n is a, c, g, or t
tgatanatatatacacttactatgtactcacaaaaaataaaaattacaaaaaaatgatctgaagcgtttcttcaaggaatgaacaggagatgaaacatgactttaccactacaatcctgaagaaaaagcataatcaaagtaatggcaagccggacacacatgtggtccaattaaataaaaacaaacaggtcatgagcaaaggtcatggcaaaagttttactggatattcaaggcattttgcttgttggctttctagggggtcaaaggcaataacatgagcttactatgaaagtgttttgagaaaatcagccaaagccttagaagaaaagcactcaggaaacctttaccagagagtcctgctcaattctgtcatcaaacgagggcaattttgccagagttttgatgggaaatcattatatatttaaattacaatcctgatttgaaa

SEQ ID NO: 563787 - DNA, 887 bp, Homo sapiens
  misc_feature (1)..(1): n is a, c, g, or t
ngtttgtgttttttttttgttgtttttagagcgacagtcggcgagggtcgagagagaggagcgagaggaggactcgaggtttttggtccgatctgtgcggtttcacaacgggcccgcgcttgctattcggaccttttcgtgccagctgttaccccccccccagcagagttcaagcctgggtgccccccccaatttcgtgtgggacctggctttcagagccacacctgtcagacttaggtttgaaccaactcgatcacgtcccgtcagtggtgccatctggaagaccatcatccccctgatctctcagggcaccccccagtgggactttcccccggacccagctgacagcactcactgggcggatcccggaggccggccccgaggtggtcacaggcttaacccgagccaggctttgccaccctctccctggcgtatgccggcgccccctttgtcttctcccttgtggatgccatggatggaaaggaaggtgttgtggaatgttccttcgttaagtcaccggagaacgggatgtacctactttgtccacaccagctgtctgcttgggaaaaagggcatcgagaagaacctgggcatcggccaagtctcctcttttgaggagaagatgatctcggatgccatccccgagctgaaggcctcccatccagaagggggaagatttcgtgaagaccctgaagtgagcccctgtgacgggtggcccagatttcccttaatttatgaaggcatcatgtcactgccaaacccttgccagataaactttgtattttaatttgctttggtgatgattacctgtattgacatcatcatgccttcccaattgtgggtggctctgtgggcgcatccaataaaagccggtcccttgattttta

SEQ ID NO: 563788 - DNA, 915 bp, Homo sapiens
  misc_feature (466)..(466): n is a, c, g, or t
ggactttcccaggaatgggcttctgatgcctctcctgggtgtgagtcttctaaaagggcaaactctgtccaccgtaggaagagatctaggcaaattcatgaatgtgtaaggtgagcctatgatggagaggagcacttaatctatggggaatcccgtaagttcatcaccacaagatctggtgcaggagaaatatcgtgaagtgcagagacaggtgccctaacaagtgatccgcgccacgtcatatcaagttcactatggaggtcgcgaggagccatcatgcatgataacgctactccaagacatgatagagtccctccgaaggttgtttagggctcatagtaatcgaagtgtgtgcactatctcggccgccgtagtacttatcaccatcgcgcgaattattgacagatggcgtttcgacgacggattgacggtaatgaggacgcagcaccatatgtccagcatcgcngatgtctacgacgctcacggcggtcgtcatctgactggcacagctgaactattctagagacgcgcagtgtgcctaagagaccacacattgcgagccgaggtaccctcgcgcacgcaccatggtgcagagactcgatgcgcagcatgtgtctcacgtgttgtctatttcgtcggccaacgattgcccagagcttattcgagagtgagatgagacacggccagagactagtgggctacgagacgactcgagtcatagtatcatctcccctttggtgttgccctgtatcaacgcacttagatattctcttgcaagggtggttcttatcgtatttaaatacgacatggtgctcatgccaagacggtccgggagtcgtatggtctaatgaagccgcacatggactccacacatttaattgagtggctgccagactatttagccatacagaggtt

SEQ ID NO: 563789 - DNA, 473 bp, Homo sapiens
  misc_feature (131)..(131): n is a, c, g, or t
  misc_feature (137)..(137): n is a, c, g, or t
  misc_feature (161)..(161): n is a, c, g, or t
  misc_feature (170)..(170): n is a, c, g, or t
  misc_feature (177)..(177): n is a, c, g, or t
  misc_feature (185)..(185): n is a, c, g, or t
  misc_feature (187)..(187): n is a, c, g, or t
  misc_feature (190)..(190): n is a, c, g, or t
  misc_feature (198)..(198): n is a, c, g, or t
  misc_feature (206)..(206): n is a, c, g, or t
  misc_feature (222)..(222): n is a, c, g, or t
  misc_feature (240)..(240): n is a, c, g, or t
  misc_feature (252)..(252): n is a, c, g, or t
  misc_feature (257)..(257): n is a, c, g, or t
  misc_feature (261)..(261): n is a, c, g, or t
  misc_feature (268)..(268): n is a, c, g, or t
  misc_feature (287)..(287): n is a, c, g, or t
  misc_feature (289)..(289): n is a, c, g, or t
  misc_feature (327)..(327): n is a, c, g, or t
  misc_feature (333)..(333): n is a, c, g, or t
  misc_feature (347)..(347): n is a, c, g, or t
  misc_feature (361)..(361): n is a, c, g, or t
  misc_feature (378)..(378): n is a, c, g, or t
  misc_feature (394)..(394): n is a, c, g, or t
  misc_feature (415)..(415): n is a, c, g, or t
  misc_feature (439)..(439): n is a, c, g, or t
ccttaaaaaatggatgccaagacaacataaacaagacccagggacccccacagggtatggtgctgtgccccagagtcagggtcctgggtttttacccagggaagtgagaaataaaaataacttttccctgntccctntttcctcccctgacaatgattttnccaccctgnacctccnttttttgntnccnaacccccncccagtgntcagttgcagacatcnctgcctgcagggcatgcncagtgcagcccnttgcncccnaactacnaactcccagaaggtgatgncnatttgtgtttgggacgtttgattgtgaaaaagggaggncagggnacttgcagccccanagactgaaactggnacgtgatggaacggggntggaacgtgatggagntttgacataacaaacgtgtgnctttgtgtgaaatgtgcagatccntgtggaataaaacccagcctagcctgtgaaaaaa

SEQ ID NO: 563790 - DNA, 869 bp, Homo sapiens
gcaagagaatcgcttgaatctgggaggcggaggttggcagtgagccaggatcacaccattgctgtccagcctgggtgacagagcaagactgcgtttcaaaaaaaaaaaaaaaaaaaaaccctttaaaaaaggcctcctttcctccattctttcaacccctctgtggggtaacttgaaaagagttgttttcctctaaaatgtggggatggatatcgtgatttaatctcgcaataggtgggaatacccgggggacctgggttttgatttttgtgattgcacccagcaaatttatccttgagggtgtgatgggtagaaatagggaaaacaccaaaagaaaaacattaccaaaaaaagaaagtgtgatggctggggtgcagtgggctcacgcctgtaatcccagcacttggggaggcttaggcgggtggatcacctgaggtcaggatttcaagaccagccgggtcaacgtggtgaaacgccgtttctactaaaattttgcaccatttcgtggggtgtggtgggcatgcgcttgtagctctcagctactccggaggctgaggcaggagatttgcttgaacctggaaggcagatgtcgcatgagccgaatgggcccttgtactccaacctgggcgattgacagaatcctctcataaattacaggaagtctgatagggtaatggattttagctctgaggtggcgtgaacactagggcttttttttaatggtttcgcgattgcccctttgttggcctttttggccggaaaccttctggtttacggccgggaaagacacccaacacggctttgatgttgaggcgggcctccttatttccccccttgaagccgtgggaaatattccattggtagtactg

SEQ ID NO: 563791 - DNA, 243 bp, Homo sapiens
  misc_feature (7)..(7): n is a, c, g, or t
  misc_feature (202)..(202): n is a, c, g, or t
agctcgngcatgtaggactttgtttttttttgtgagaacagagctttgctcttgtttgcccaggctggagtgcaatggcgcgatctcggctcaccacaacctccacctcccgggttcaagcgattctcgctgcctcagcctcccgagtagctgggattacaggcttgcgccaccgcgcctcagctaattttattatcttgantagagactgggtttttcccatttttggctcaggcgtgatct

SEQ ID NO: 563792 - DNA, 479 bp, Homo sapiens
agaatgcgttacaaaccaaggaaaaacatcctgtaggagaaaacaaaaaaaagcccttcaaaataagctgggagtgggattccagttccacccttgtcacctctagctgtgtgaccttgaaggataaatttctctaactctcagttccctgatgggcagaatagcgcttaccatacagaagacattgtctataaggggtctctcaccaagcttaaccaacagggggtgctcaacaaatgtctatccatacgtatgtatcccacaatgaagtgcagtgttacacccttgttcctacaccttttcctacaaatgctgttgtgaccaggaactcatctaaaacattagatctctgccaacttcacacaaacacaaacctgattcacgacactgaaccacgggctaaaacaccttagaatacaattataacccaaacttgggcgggccacagggatccatgcctgtaataccagctcttgggc

SEQ ID NO: 563793 - DNA, 276 bp, Homo sapiens
gcggtcatctctagacggatcccccacattcgatcgcggagacagaggtaagtagtagctatgcctatcagtgtactatactgtattagattattaggaaactcaggatctcaaatcgtatgcccaggcggaattataggtggcataatcacgagcccactcctcccaaatcgctggaacgacgggtgcaagcaacaacaggcggttaacctaaaaatcccttcgcaaagataggttcttgctgttatcgcccaggatttttattcacctgtttgg

SEQ ID NO: 563794 - DNA, 860 bp, Homo sapiens
tagtagagacggggtttcaccagtgtggccaggctggtctttgatctcctgacctcgtgatccacccgcctgggctcccaaaatgctagtattacaggtgtgagccaccgcacctggccattttatgctttttcatatgactgattatggtgggccattttggtgcatcttttggctatcttatgcatgggaaattcagacacattttcttggagatggctacttgattggggggcttcgtgttcagtccaaacctaagtgcccatcagtggatgaatggataaagaaaatatggtatatatacacaggggaatactattcagccataaaaagaagaaaattctgtcatttggcagcaacagtgtataggacgtggaagacattatgttaagtgcaataagccaggctcagaaagaccaaatatggcatgttttcactcatatgtgggagtttaaaaagttgatctcatggaggctgagagtagaatgggggttaccagaggctaggaaagtgggaggggggatgacgaagaggctggttaatgggtacaaaaataccagttagatagaaagaaacaagttctacgtgtcgatagcacagtaggggcggatcattgggtagcggtaaatttattgtgatatttcaaaattagcagaaggaagaggatttcgaatgggtccctggcatccaagaatttcaccagtggtgtcaacctgggtgaattttcccagtcattctgacttggacacatgccattggtctggctatttggagagttcccggttgttccccaatactttggtaccgtttcatcacccgtcacatccttgattacttattaggggcgcacgtgtggaatc

SEQ ID NO: 563795 - DNA, 687 bp, Homo sapiens
  misc_feature (496)..(496): n is a, c, g, or t
  misc_feature (586)..(586): n is a, c, g, or t
gtggatttctatttgctgtggcttgctggggattgaagggattatggttgatgagaggtttgaaattcaaccagtttattattagtgggggcacatgaagtttgaaaatcttggttgtcttgatctgtcttttttccttttcttcctttaatctttccctccttaccccttccctcccctcccctacccttcccttccctttaaatgtaaggggaaaagggcacactggtcagaaatgcaatgagctagttgttggtttttgtcacaattattcatatgtccacttctattttttcccacttgatagttaaaccaaacatctagtttttactgccttctcaaagtacataattcatttaggttcagtgtacttattgagtgacttatgtgcaaagcattgtactaggtgttctagtactagtgtaaagagtaattcacattaaaatgggaaagatgatgacttgagtgaacttgggatgtcttggctcttgggttntcaacgagattgtggttactttcaatgacacgaaccaaagttcttacgtaaaggttgagggaaacacaagtaattggtttaagctatggntggagttggaaattcggaccactattacaggtggtccgagacttccatgaattggtattaagcctataattccccttattgcttgttatttcatggcgtgg

SEQ ID NO: 563796 - DNA, 481 bp, Homo sapiens
cgtgccccatattccgacatacacctacaggcttgaaagaatcatttctttccattaagaaaacctaactagctgggcgtggtggcatcatgcctgtaatctcagcactttgggaggccgcggccgggcagttcacctgaggtcaggagttcgagaccagcctaggcaacattgtgaaaccccatctctactaaaaacacaaaaaattagccaggcaaggtgacagccacctgtaatctcagctacttaggagactgagacaggagaatcgcttgaacccgggaggtggaggttgcagtgagtcgagattatgccattgtactccagcctgtgtgacagagtgagactctatctaacaacacaaaatattaacaaacctaatgcatatgatgggtcccttatctccataaaaatatatgtaactggaaacccttctcctaaagtacttatacagattttaaaaataatcaatataattact

SEQ ID NO: 563797 - DNA, 182 bp, Homo sapiens
aaaaacggacaaaagatctttatttctgagaactggcgtacaaaaggttaaggatggggggagggatttaaagagcgagcgtggcctggggttgatgccagcttaggggcctcaaactccaattagggaagctcggacaccggacagaaagagaaacccccaattaggaaaaaaaacaaaaa

SEQ ID NO: 563798 - DNA, 305 bp, Homo sapiens
gggggggccccccccccccccccaacaaagcaacaacagggtggggggccgcagctatttgggcctggcgcctgggcagggggagtccccccaaagctccacctgccggggtccgcattaagggggccccgtggagaaaaccgggggccccacagaagggttttggggtttaaaccccccccccccccccggggggttaaaggtgcggggtccccggggggggggttttcccccccccccagggggtcaagcccttttcccggccccccataaaccccccataaaatttttccttggccctccga

SEQ ID NO: 563799 - DNA, 296 bp, Homo sapiens
cacacaaacacggtgatggctcactctcagcatactaatgggaccatctgagttaacaaccctgttccaagaagacttaggtgcagaactttagtataaggtggtcataccttactcaccaccactttggaagacacagcctaatgctcgatgtcacttacatgtgcccctttcccagcatagcaaataatgtctcgggtaacagccatccaacaatccactaagcaatgaccattggcaatagctcatgcagcacacagtcagtagcagcaattgcattataaacatcatcaatt

SEQ ID NO: 563800 - DNA, 400 bp, Homo sapiens
  misc_feature (16)..(16): n is a, c, g, or t
  misc_feature (60)..(60): n is a, c, g, or t
  misc_feature (321)..(321): n is a, c, g, or t
ggaagaatgaaaattngtgttcggtagtatcaacatgaagggttttcaatttgaagaaangaagaaaacagataaacaacaatgctgtacaggttattgactgggtattagaaaagacaagcaagaaatgatacatactcattctctttaagacagttataaatcggatggagctattacttactacttcttttcttactgtgaccatgataaacatattttaagttgttttcgaagaatagatgttatatttctaaagaactacacgaatattcatccctatattcgcacaatccgccggatgctatgcaaatgcacccnaatcacatacactctctgcccccagctacactccccgcaacgcccccccccaccacccccacccccgacccccatccag

SEQ ID NO: 563801 - DNA, 150 bp, Homo sapiens
  misc_feature (17)..(17): n is a, c, g, or t
  misc_feature (47)..(47): n is a, c, g, or t
  misc_feature (53)..(53): n is a, c, g, or t
  misc_feature (76)..(76): n is a, c, g, or t
  misc_feature (128)..(128): n is a, c, g, or t
  misc_feature (132)..(134): n is a, c, g, or t
cgttttattcattctcngcctttcacccagaaccacctcatcatttnaaaggnaattccaccatatccttcaactnttaacagattgcctggtatattattggtttgttgttattgctaattatgttntaannngcttacattgaacaat

SEQ ID NO: 563802 - DNA, 630 bp, Homo sapiens
  misc_feature (593)..(593): n is a, c, g, or t
gtattgcttttacatagccaaaacatggctatagagtttagttttttttaaatcatttaataagcttttcttaatatcgtatagcatttcaatcatcattgcaaaaatcattcacatgcataaaccccagataggcaccttcttatgtcccagcaactaaggctcttctgtagtggccactcctctcttccatcatcttacttccctaaaggaatggttttagtagcacatcacttcagtagcaaattggcagggcacaaaactgacatcacattgaatgtaggttttcatgtaatcatatgagattgggaaaggctgttgcaccagccatctcccattcttttccttcagcagctgctctacattccctgcctctgcttcctggcctgcctgagaggttttggaatgacttgaagcagccaaaattccgagtcccttggctatatgattatgatgacaaaggggagagattaagatatccaagctataggcagagaaaatgatcggagtcctgacatctacaagtcttggggttaaaaagataaggggaaaaaaaatgatgataccagacacaatctctctcttatctcctncccttgacttcaaaaaatgaaaaaaaaaagtcgacgc

SEQ ID NO: 563803 - DNA, 575 bp, Homo sapiens
  misc_feature (506)..(506): n is a, c, g, or t
  misc_feature (518)..(518): n is a, c, g, or t
  misc_feature (551)..(551): n is a, c, g, or t
gtattgcttttacatagccaaaacatggctatagagtttagttttttttaaatcatttaataagcttttcttaatatcgtatagcatttcaatcatcattgcaaaaatcattcacatgcataaaccccagataggcaccttcttatgtcccagcaactaaggctcttctgtagtggccactcctctcttccatcatcttacttccctaaaggaatggttttagtagcacatcacttcagtagcaaattggcagggcacaaaactgacatcacattgaatgtaggttttcatgtaatcatatgagattgggaaaggctgttgcaccagccatctcccattcttttccttcagcagctgctctacattccctgcctctgcttcctggcctgcctgagaggttttggaatgacttgaagcagccaaaattccgagtcccttgggctattatggttatggtggacaagggggaggggtttaaggatttcccaaggttattaggggcaggnggaaaatggatnccggagttcccggaacatttttacaagtttttngggggttttaaaaaaggttagggg

SEQ ID NO: 563804 - DNA, 327 bp, Homo sapiens
gcgggtattggctgctctgggtgggctcagccaggtggccctgctccacctgtctccccctcctcctggccaagcaagtgtgcaagaggacaaatgagtacacaggacatgtcttaggtcctggcacgtgccagctttaagcccacttctgcctcattctgttgtccaaagtgagccacccaactcaaaccgaagggtggagaaatacgtcactcctgtagctgaaggccctccaaagtggcaaagaatgtgaacatgggaagaagaaaaaattgagaccaataatgcaatctatggtaaagagtaataaatgactatcaaattccc

SEQ ID NO: 563805 - DNA, 582 bp, Homo sapiens
ctggacgagcacggaatatctggggctttggagggaatcgtgaatcgtcggcgaggaggccggggaccacacacgagaataactagtcttggctacccgtactacttggcttgcagaagtgctgactatgagcacacacacgtacggagaataactggagaatacagctgctctgaacaagaactgagatcccgagagatgattactttggccctagaacaaacaaataaatacatgtttcagtcctgtgtcctcctgctatagtgtgtccggaattgggggggttcttgggctcactggatttcaagaatgaagctgcgaccctcccgggaccgtgtgtgaatgcctgctctgtgagccctcagaatctactgggcgaatgagtgcgtggaggaaatgtgctcagagctgctgtgtgtcatcctgtgtttgaagtgctcctgcaggtttcattcatccagttaagaatttgaagaagtgtgtgcaccaaggtgaccctttgcttatactttcccccaaattacagttcttaaattttcctatacaatccttctaaattggttgacagttgtccccttttcc

SEQ ID NO: 563806 - DNA, 137 bp, Homo sapiens
ctgataagtcccattgacgcgcagagaaggaggtcggttacctggagtatcacatgggccccacagaagcccccgaggctggacgcaacagatccatccatgcccacagctaacctggaccggacctgcatgacctg

SEQ ID NO: 563807 - DNA, 867 bp, Homo sapiens
tgagcgtgcctaccaaaagcagccgacctatctttcaaaacaaaaaatgagggccctgctgggagaaactggcaaggtagaagctcccggggtactacaagaacatcggtctgggcttcaagacaccccaaggcaggctattggagtggcacctacattgtacaagaaatgcgcccttcgctggtaatgtgtccattcgagggcggatcctctctggcgtggtgaccagagatgaagatgcggaggaccattgccatccgccgagactatctgcactacatccgcaacgtagcaaccgacttcagagaggcgccatcaatgacacatgtctagtacacctgtcaccctctggcttcacgggacgtacagtatcggatgagattcgtgacagctcgggcgacgtgccgggctcggacgcaagacagttagcggctgtcaatcggtgctcaaggtcaccagatggctgcgcgggacgcaaagcaagtcagttccagaagttgctgaggctggacatcggactccgatccacacagaatgacacttagaggttcatattactcatttccgcaggcccatgcccgaatgcacacacaaacaaaggaaattggtcacaatctgcacccgcctcgacatcctaaacacaaaccacacacctaggtaaaatacggtcacctcaacatcccgtacactccgggactctgacaccatagaaacatggcggaacggttctcagccccttgaatcactgaaacggtatctcaattattaaatgctacccacacacattagcacattcaaaaataggggcgatctgacacatcccggacaccaaaagggccggccacacacgaatgccctagccaacct

SEQ ID NO: 563808 - DNA, 318 bp, Homo sapiens
ggtgacagagaacttctcccatcacattcgagtttccgatcatgagatgatccacatgcactaccatctgagtgcgacccatgggcccaactcagtcgggggtgggtgggcatcctctatgatgccctctgactgggcctgctatctgtcacccaacagcgtatgctggaccaacaaaaacattgcgatgccaggccgctcttggaccgtgctcaaggtgtttcgactggcatccccacctgcccctacgaccaacgacaaaagccggattggttggttccttgcttgcccttcaaccgtccgtgcggtcctcggaac

SEQ ID NO: 563809 - DNA, 675 bp, Homo sapiens
gctgggctcaggtgcgaggggtctggacctctctcccatggcggaagctcctgcgcctctccccgtccctcgtcccacgggctgcttctggtgggagtggggctgggcgcttagggagccaggagatggacaggagccttcctcacagaggggagaagccagcccctggcccgctcaccttctcttatccggtgttctgccagtcccagctgctccagtccccactcgccctaagaccgccttcacccagcttccccgtgctcttccttgttctggggtgcttggcccgctatggagggggctgcatacctcgtccttggagatcccgatgccttcaggtccggaagctcttgacgtatttggcgtcgctggtctgagacgtggcgctcggggtggactgcggcctggatgcatcagtgtgtcgtggctcatggcgagactgactgcattatggatggccttgaggactccttattagaggcggccgcatctcaccctgcccgcttttaccacggacggacacgcatcccctctggcgcctcgccagagaatgacctcaagaccagagacctaagcaagagctattgccgtcccctgggaacagccatgtctctccctggaaaaggaagtcccaaccgagattgtatcgtccctgaggaactgaacccggtttgc

SEQ ID NO: 563810 - DNA, 164 bp, Homo sapiens
gtaccttcatcacattccaatatgattgtcgatttccaaacatatttttttctgctagacagaaaactgcctaataattgggaatagtctgtatttcctagtttgtaccacagtgcctagcaggtaggggttattcaaaaaaagtgtgaataaactaaatgacc

SEQ ID NO: 563811 - DNA, 293 bp, Homo sapiens
tggggctgcgaccttagacagcggaccccacatttcagactcacatatctccaaatatcgcataactccatgttgagtacagattttcaggctaggaaaatacattttcctgttctgaattgttccaaccctaaccaaaatgtcatctctgacagaagctcagggttgcctcgttttactttctgtgggtatctgttgttttcagcgaagcaatcacgttccatctagtgaagtaacctttgtggcaacctcaattacttgcacgacgtgcagaggggtccggcgtgtcatga

SEQ ID NO: 563812 - DNA, 223 bp, Homo sapiens
atctggcagtttgcgagtgttcgcaagagcagggccgaatttagcacgacagtgtgtcctgcgccttttgagaatcttctgcaggtcaaagctcagtgttaactagatattttatgacctggtcgacagataaataggaaaacaccagtagaaaagaagaagcctaaaaagaaatcatgtctgcagctctaggcccatagtcagcagcagccctaagccaaga

SEQ ID NO: 563813 - DNA, 159 bp, Homo sapiens
gatcgatctagaggatcccggcgtttatcgatgccatcaagtagctaggatcacaggcgccactaccatacccgtctaattttggtatttggagcagaggcaggtttcaccacgtaggccaggctggtctcggacccctgacctcaagtgatccacccg

SEQ ID NO: 563814 - DNA, 321 bp, Homo sapiens
  misc_feature (109)..(109): n is a, c, g, or t
  misc_feature (179)..(179): n is a, c, g, or t
  misc_feature (191)..(191): n is a, c, g, or t
  misc_feature (294)..(294): n is a, c, g, or t
  misc_feature (299)..(299): n is a, c, g, or t
  misc_feature (319)..(319): n is a, c, g, or t
tgcctcctagagggaggtctgggttcccttctatggctgaccagtgcctgtgtggtgactgccaagcaccaggctccctccctccctgtgacatggcctgggctgacanacactccctctcctgggaccctccttgcctcaaggtgggtgttcaaaaaactgtgccttccccactcgtntgtgcagaaggntgggcctgaaggtttcaagtgtggagaagcagcagaagcacccaggaaagccacagttggcttcccgtttttccctgctcccctgtgtgtgttaaaaattttnaacanaaatcccactttcataatanaa

SEQ ID NO: 563815 - DNA, 325 bp, Homo sapiens
tgttacctcaaacagagtgctgtgtgtgcatgtgtgtgtcgtgtgtgtgctgtgcgtttgtgtgtgatgttgtgtgctcatctgtgtttagtgtgtagctagtgggtctgtgtgtgttctgtatgctcgtgtttagttgggagcacgctgtgtgtgctgtgttcatgcgtgtgctgtgtgttgtgtgtgtgtgctgtgtgtgcatgtgtgtgctgtgtctttgtgtgtgtgctgtgtgctcgtgtgctgtgtgtgcatgtgtgtgcgtgtgctgtgcgtttgtgtgctgtgtgctcgtgtgtgtgctgtttgtggaggtagcact

SEQ ID NO: 563816 - DNA, 103 bp, Homo sapiens
cccagcttatagtccccttctagcttcaagtattcttctaatttggttctggtctacgtaaacaccctcatgggtcaagctttaccttctaacttctgcacca

SEQ ID NO: 563817 - DNA, 133 bp, Homo sapiens
  misc_feature (83)..(83): n is a, c, g, or t
aacaggtcaaaagaaccctttattactttttatgattgccacttatgcttcttgccagatgccttggagcaggtgcttttggnctgaagcttttgcccctttgtgtctctccagccgtatagtagtagtaggc

SEQ ID NO: 563818 - DNA, 128 bp, Homo sapiens
ttatcctacagcgcactgacgctatgtagcggcgtgactgtattttggtggaaggctggtagtggctttggaggtgtgctatggaggtggacttggaggtggctatggaggtgcgcctatggaggtgg

SEQ ID NO: 563819 - DNA, 904 bp, Homo sapiens
  misc_feature (93)..(93): n is a, c, g, or t
  misc_feature (96)..(96): n is a, c, g, or t
  misc_feature (162)..(162): n is a, c, g, or t
  misc_feature (166)..(166): n is a, c, g, or t
  misc_feature (168)..(169): n is a, c, g, or t
  misc_feature (218)..(218): n is a, c, g, or t
  misc_feature (231)..(231): n is a, c, g, or t
  misc_feature (260)..(260): n is a, c, g, or t
  misc_feature (262)..(262): n is a, c, g, or t
  misc_feature (265)..(265): n is a, c, g, or t
  misc_feature (268)..(268): n is a, c, g, or t
  misc_feature (280)..(280): n is a, c, g, or t
  misc_feature (285)..(285): n is a, c, g, or t
  misc_feature (291)..(292): n is a, c, g, or t
  misc_feature (298)..(299): n is a, c, g, or t
  misc_feature (309)..(309): n is a, c, g, or t
  misc_feature (318)..(318): n is a, c, g, or t
  misc_feature (326)..(326): n is a, c, g, or t
  misc_feature (358)..(358): n is a, c, g, or t
  misc_feature (393)..(393): n is a, c, g, or t
  misc_feature (411)..(412): n is a, c, g, or t
  misc_feature (425)..(426): n is a, c, g, or t
  misc_feature (444)..(444): n is a, c, g, or t
  misc_feature (454)..(454): n is a, c, g, or t
  misc_feature (466)..(466): n is a, c, g, or t
  misc_feature (470)..(470): n is a, c, g, or t
  misc_feature (506)..(506): n is a, c, g, or t
  misc_feature (512)..(512): n is a, c, g, or t
  misc_feature (619)..(619): n is a, c, g, or t
  misc_feature (701)..(701): n is a, c, g, or t
  misc_feature (726)..(726): n is a, c, g, or t
  misc_feature (764)..(764): n is a, c, g, or t
  misc_feature (771)..(771): n is a, c, g, or t
  misc_feature (791)..(791): n is a, c, g, or t
  misc_feature (793)..(793): n is a, c, g, or t
  misc_feature (797)..(797): n is a, c, g, or t
  misc_feature (805)..(805): n is a, c, g, or t
  misc_feature (830)..(830): n is a, c, g, or t
  misc_feature (840)..(840): n is a, c, g, or t
  misc_feature (893)..(893): n is a, c, g, or t
gggtggaggccgtctgtggtggcgcgggcgaggtggaggcccaggactctgaccctgcccctgccttcagcaaggccccggaagcgcggatantangaactgccgtggtctttgcaagggaaggaaatgtgcccaacatcatcattgcgggcctccaggaancggnannaccacaagcattctgtgcttggcccgggccctgctgggcccagcactcnaagatgccatgtnggaactcaatgcttcaaatgacaggggcntngangtngtgaggaataanattanaatgtnngctcannaaaaagtcantcttcccanaggccganataagatcatgattctggatgaagcagaaagnatgaccgacggagcccagcaagccttgaggagaancatggaaatctactctannaccactcgcttcnnccttgcttgtaatgcttnggataagatnatcgagccattnagtnccgctgtgcagtcctccggtacacaaagctgacgangcccanatcctcacaggctgatgaatgttatcgagaaggagagggtaccctacactgatgacggcctagaagccatcatattcaaggcccagggagacatgaggcaggcgctngacaacctgcagtccaccttctcaggatttggcttcattaacagtgagaaagtgttcaaggtctgtgaagagacccacccantgctggtaaaggagatgatccaccnctgtgtgaatgccaacattgaggaagcctacaagattnttgctcncttgtggcatctgggctacncnccanaagatatnattggcaacatctttcgagtgtgtnaaatttccanatggcagaatacctgaaaatggagtttatcaaggcaattggatacaccccctnaaaatagcgga

SEQ ID NO: 563820 - DNA, 192 bp, Homo sapiens
  misc_feature (56)..(56): n is a, c, g, or t
actctagagatcccggcgcacatttacaggagtacaggtggaactacgggtcatgngaaagaaagagcgagtggattattttggagcaatgaggctctgcctagctgtgaaggattacattcgaacacaatcatcagcaagaaaattaacaccaaatttttccagggaagaaaatacagacgaaattaaagt

SEQ ID NO: 563821 - DNA, 980 bp, Homo sapiens
  misc_feature (93)..(93): n is a, c, g, or t
  misc_feature (96)..(96): n is a, c, g, or t
  misc_feature (238)..(238): n is a, c, g, or t
  misc_feature (242)..(242): n is a, c, g, or t
  misc_feature (244)..(245): n is a, c, g, or t
  misc_feature (294)..(294): n is a, c, g, or t
  misc_feature (307)..(307): n is a, c, g, or t
  misc_feature (336)..(336): n is a, c, g, or t
  misc_feature (338)..(338): n is a, c, g, or t
  misc_feature (341)..(341): n is a, c, g, or t
  misc_feature (344)..(344): n is a, c, g, or t
  misc_feature (356)..(356): n is a, c, g, or t
  misc_feature (361)..(361): n is a, c, g, or t
  misc_feature (367)..(368): n is a, c, g, or t
  misc_feature (374)..(375): n is a, c, g, or t
  misc_feature (385)..(385): n is a, c, g, or t
  misc_feature (394)..(394): n is a, c, g, or t
  misc_feature (402)..(402): n is a, c, g, or t
  misc_feature (434)..(434): n is a, c, g, or t
  misc_feature (469)..(469): n is a, c, g, or t
  misc_feature (487)..(488): n is a, c, g, or t
  misc_feature (501)..(502): n is a, c, g, or t
  misc_feature (520)..(520): n is a, c, g, or t
  misc_feature (530)..(530): n is a, c, g, or t
  misc_feature (542)..(542): n is a, c, g, or t
  misc_feature (546)..(546): n is a, c, g, or t
  misc_feature (582)..(582): n is a, c, g, or t
  misc_feature (588)..(588): n is a, c, g, or t
  misc_feature (695)..(695): n is a, c, g, or t
  misc_feature (777)..(777): n is a, c, g, or t
  misc_feature (802)..(802): n is a, c, g, or t
  misc_feature (840)..(840): n is a, c, g, or t
  misc_feature (847)..(847): n is a, c, g, or t
  misc_feature (867)..(867): n is a, c, g, or t
  misc_feature (869)..(869): n is a, c, g, or t
  misc_feature (873)..(873): n is a, c, g, or t
  misc_feature (881)..(881): n is a, c, g, or t
  misc_feature (906)..(906): n is a, c, g, or t
  misc_feature (916)..(916): n is a, c, g, or t
  misc_feature (969)..(969): n is a, c, g, or t
gggtggaggccgtctgtggtggcgcgggcgaggtggaggcccaggactctgaccctgcccctgccttcagcaaggccccggaagcgcggatantangaactgccgtgaggttgaaataatataggccatgtaaagctagaatgaaattgtcaggagaatgacgacaccgtgagcaggctagaggtctttgcaagggaaggaaatgtgcccaacatcatcattgcgggcctccaggaancggnannaccacaagcattctgtgcttggcccgggccctgctgggcccagcactcnaagatgccatgtnggaactcaatgcttcaaatgacaggggcntngangtngtgaggaataanattanaatgtnngctcannaaaaagtcantcttcccanaggccganataagatcatgattctggatgaagcagaaagnatgaccgacggagcccagcaagccttgaggagaancatggaaatctactctannaccactcgcttcnnccttgcttgtaatgcttnggataagatnatcgagccattnagtnccgctgtgcagtcctccggtacacaaagctgacgangcccanatcctcacaggctgatgaatgttatcgagaaggagagggtaccctacactgatgacggcctagaagccatcatattcaaggcccagggagacatgaggcaggcgctngacaacctgcagtccaccttctcaggatttggcttcattaacagtgagaaagtgttcaaggtctgtgaagagacccacccantgctggtaaaggagatgatccaccnctgtgtgaatgccaacattgaggaagcctacaagattnttgctcncttgtggcatctgggctacncnccanaagatatnattggcaacatctttcgagtgtgtnaaatttccanatggcagaatacctgaaaatggagtttatcaaggcaattggatacaccccctnaaaatagcgga

SEQ ID NO: 563822 - DNA, 874 bp, Homo sapiens
ggtgggcgggaccgcgggcctgtgacaccgcacgctgagctctgtgatgtagccgcttgcggaagaactgcaaggcagccggggcgccccggcctccctcttccgtgccgccgtgggaatggaaacatttgccccagtgccggaaggccaatgtgtgtgcgacaaacatgggcgccattccggggcctaccggggcaggatccctctaggtgtgtccctcgggaagacaaaggctcacgcgaatatggccggggtcccacgtccagagggcaaactttgggaggggcacacttgggagtcacgtggaacctgtgcgggaatttttggctaagggaagcacgccatgggtggggcgtaaagggtgttcacggggcaaggaattttcttggaccttttcagggcaagaaaagggtaattacggcggtggcaccccccaggctggtaccaattggggaagggtggtccactggagattggggtggcacaggggttatcacattattacccaggaaatgtgttggggaaaaggttgggggttggcaaaccaggctttggtggcgaacggcgggcaattttctctccctttcaaggttgtgcaaacccaataacggggttacctttccaaaggttggacgttgccaagcggaggtggggccggaacgggacctttgaaagcgaaaagcgccacaaggagcaacgcctggaagattcggtagagaagcatcaagaataccttacgggagcgtcaggagccaacgctcgaggagcgtggtgcccattgtggcgacacgacaagactggtcctacgatacctggggggacttcacggagaggcattccctgcctgggatgggctccctaaggaagatgactc

SEQ ID NO: 563823 - DNA, 162 bp, Homo sapiens
cgtgcagggtattatgcatgtaggttgcatagtagatatgggctgttaattgtcagttcagtgttttaatctgacgcaggcttatgcggaggagaatgtattcatgttacttatactaacattagttcttctatagggtgatcgatcggtcaacttgtctgg

SEQ ID NO: 563824 - DNA, 552 bp, Homo sapiens
aggaaacacctatacatggttcacgacaacacgatgtgttgaccggactgccgtttgatggactttggtcaccctgatctagacaccttctgtgctcatgtttgcaaagctgaatacgggaaggacagctgtgccctcctgggagctcttgtttcccaagagctgtgctaacttccctttacagctgtttacagacaaggcaggcctgaggcagatggccactgctcttgtgatgtttgctcagaggaatatgaacattttatttttgaaaagggatgatgtggttttctgccaggtgtctataattaatcctttaatattatggttattaacctcttaaacatgaatgaattcttgattgttttaacacagtacctaagactaatgccttctgtggacaccactgagctctgcctcaattccaccctctgcgaccggggactaatgcccctagtaactgctgtcggtgtggacgctgtgctggttctgttttctaaaggagcagaaggacaggtctctgagacaggatcgttgtccctacaggaggaacag

SEQ ID NO: 563825 - DNA, 428 bp, Homo sapiens
  misc_feature (413)..(413): n is a, c, g, or t
  misc_feature (418)..(418): n is a, c, g, or t
tatctggagagaggagggctcaggactgtgttcactttatttggtcagatgtattttatttgaaaaccatttgagccccaaaatacaagtgtacccttcccacttctggctcaagcacccgtgagccgactagacgtaatattaaaacttactgatgctgggcgcggtggctcacacctgtaattccagcactttgggaggctgaggcaggtggattacctgaggtcaggagttcgagaccagcctggccaacacggtgaaaccccgtctctactaaaaaattaaaacattaggcgggcgtggtggcgggcgcctgtggtcccagctactcgggaggctaaggtgtgaacctgggaggcggagcttgtagtgagccgagatcacgtcactgcactccagcctgggcaacagangcggntccgtctcaa

SEQ ID NO: 563826 - DNA, 322 bp, Homo sapiens
cagccggaccgtcagaagcatctgagtttggtctggtgctgtcacagcataagtgacagcaacttggtagctgaattatgtgcactaagccacagcaaggaagtggacgcccgctctgagacaggtacacgggctggctgtaggattaatataatgattgctaataaaacatattctgtaccaggcatgggagctcatgtctgcaatcccagtacttttggaggttgaggcaggttgatcactcgaggccaggagcttgagagcagccagccaggcatggtggtgacagcctgtggccccagcaactcaggatgcttcttga

SEQ ID NO: 563827 - DNA, 278 bp, Homo sapiens
  misc_feature (155)..(155): n is a, c, g, or t
  misc_feature (177)..(177): n is a, c, g, or t
  misc_feature (187)..(187): n is a, c, g, or t
  misc_feature (205)..(205): n is a, c, g, or t
  misc_feature (273)..(273): n is a, c, g, or t
ttgaagagcaagacaaatttttacttttaaatgattataagcacaccaaaaacatgtaacaagttaagtcctagcatctagtgatttggggttaggttacactaacagcagccggaacaagcatatcggattgactggcccaaattatccaggcnagagtaccccaaggctggctgnttcctcaaangagttaccaatagctacntccacctttttccatagggtaacggcccctgaccctgttaagaaagggggaaggggaccaggttactncccct

SEQ ID NO: 563828 - DNA, 910 bp, Homo sapiens
gcagaggtagatcgtagggttgtcaatggccccgggacatttcttcgcgggccctgcggagaggtgaggcaaggcgtcgtgtcatagatgcctgagttgctctctagggagacgatgcccgtggggtcgcgcctgctctgagcgaacgggaagagaaggtgcctacggcccttccgtcctcggattcatcgccattgtgctggggcgacgcaggatgcgcatggtggacccgaaagtgtgcccaagctagccccaaggggcgacgaggggacttttgagggaaagcaaacattgccttttttcttgtacgtttaaatgcgaaccctttttggaaggcctggggcattcgaacccggattctttcctcagacccgttgttgcccggtctcttctggtgacaagaggcataggtaatctcgtcaaggagaccaaccgtaaaggtaactcctgtgtctcgagggtgtccaatgttatccttaagtggcctgaatcaaaactttgattacttgcatgcaaaagagtgctggcctcgagcccagggtttttggtaaacagatcataaagttctcaggccacgttatgccttattctcacttggcaattctcagcacaatttcagttccacgtgtaaagtttggggaaaactaagtgaattactggaacccacaagtttcaagcctgtggaacccttgtttaaagggtgtcctgacgacatctaacttatcaagaggccatggtctagggctaggaaatgtgcgcgatgatttcaacccaagtttcatacctccagatataaacgtaaggtgtcaaaacatggcatggcccttctttgtactctgaattcgagcagttaacaaccagggtagttggaggaaacctaaagaatttacgtgccatgacttcaacacat

SEQ ID NO: 563829 - DNA, 140 bp, Homo sapiens
gaggatcccctatcaaaccctatcgaggccggaatagaggtccgacaaatcccattcctgaagatggccgaggtcggcgcgggaccggaggcgtccgcccgactggcggaggccgcgcgcacctacgagggtttcgatga

SEQ ID NO: 563830 - DNA, 175 bp, Homo sapiens
tgtgtctatactaatataaacaagggagaaaggacagcctatcgagtctagctagctagctatctgagacactctcttgctctgtcacccaggctggagtgcagtggcgcgatctgggctcactgcaagttccacctcccgggttcacaacattctccttcctcagacacaccga

SEQ ID NO: 563831 - DNA, 432 bp, Homo sapiens
caatagcttctctaacgtagaaacatatcaaatatagtatacaccggcagacacggagacagtcttacaagatacactaaactgcactgtaatatagataacataacagagtctcacagtgatataacatgcgaaatccacataaattgtcatttaaccaacagatactgcacgagcgaacatctcgatatatgaaaactgcatcatcaattcaacgtcacggtacttgcaaactgcatcataaaatgcaacattgtcatatgtgaaaacgacaccctaagtccttctttttaaaaatgacatttgcgtctagcttattgtcagaggttgcacttaagtactaagtacctatctttaagctcttcagtttatacttcatatcaaatgccttttgtctatacaataaccctatattaatcagtgcatgaaatt

SEQ ID NO: 563832 - DNA, 342 bp, Homo sapiens
tgcattcacgctatcattcatacagaagccagacaaatgacgacaatggtatctgcatactcatctaacaaataatctaccttatagaaaaatataaggctacaaaggtaaatgtaaagccctgcagagatgaaatccaacagtttttctgattattgaggcatcaaatgcctgacattgtatttagaggtatcttgatattgtgtcataggtttatcagcaattccacaggttcctactccaactttaccagtcacactctcaggtgaagcaaaaatactcctctttacctggccttttttgtttttagaataggctctgttgttgaattgttgccatttc

SEQ ID NO: 563833 - DNA, 171 bp, Homo sapiens
gggaactgggtggagaggcactttttgaattctaaagaatcatatctgtgtatatacatactgagtggggaaggatgggggttggcaggggttgagggaggctgggaccaaaccagtgaggtatgggaccaggccagtccaccccggagtttcgggagtccactcgggtca

SEQ ID NO: 563834 - DNA, 595 bp, Homo sapiens
gagcacgccattaaggctcggggccgctacgagagtacaaggtagtgggtctctgcctgcccaccccaaaatgccacacgccgcccatttacggcatgtggatctttgagcctaatcatgtcgtcgccaagtcccgcttgctggtactttgtatctcagttaaagaagatcaagaagtcttcaggggagattgtctactgtgggcaggtgtttgagaagtcccccccacgggtgaaaatcttcgggatctggctgttctatgactaccggagcggcacccccaacatgtaccgggaatacctggacctgaccaccgcaagctgtgtcacccagtgctacggaaacatgtgttgccggcacccgcgcccgagtccactccattcagatcatgaaggtggaggagatctcggccagcaagttccgccggccggctgtcaagcagttcctcgactccaagaaccagtttcctcttcccccccgggtcctgggccgtcagcccaagccacgtttccccaccaagagggccaacacctttttttaggtgcagggccctagtccgggtgtgccccaaataaacccaggaacgccccggtga

SEQ ID NO: 563835 - DNA, 393 bp, Homo sapiens
cctctagattgaggatggggggaagaacgtcaatggtgaagcttctctgggaaattctgcaggccttgtagttctctaagacccctctagcaacatgtgagatatgggctattgatattcatggagtccttggatgaggctgttgctgcagctctgtgagagagagagctcttacgatcaatagaacttgaagagcttcatgccagatatcaacctccagagaacaaaacacatatcccagaggccaacatagatagcgtgaacgtatctgaggaccacatgtgtcaaacgaagaaagttacagacccaatatccacactgcatatataaactccagagtgctatagcttcctgagagtcagatcaaatgacaatttctcagattgaaaggta

SEQ ID NO: 563836 - DNA, 976 bp, Homo sapiens
  misc_feature (68)..(68): n is a, c, g, or t
  misc_feature (939)..(939): n is a, c, g, or t
tatgcgcctgtgggtttgttggctttgtgccttggggagaagccccatgggggctggcgtcccggccngtgtgttgcctggcccagccttgggagcccaatggttcgcagtcggcccagcccctgggggccgggtgtggcccccctccagggctcttgggtgggcgtccgagcctgttttgcctcggccatgcagccccagggggtgacaggcgaagagagcttttcttgtgcagccgggggccaggtatcgcccccccgggtgtgttccagcggtgcgctcctctgcgcccgacgtgacaccgtttgggccgcccttgggggccctctggtcttgcctcttcccgcagttggattggttgtccacgcccttgtccctgggttcccttttgtcgtgaccgctctcgtggactatgcgtcgtttggactcgactttggaggaagacgttgagttgtatgagtggccggcatgttgggaggtgcccggaccttccctgtggtcggagttttcttggggcctctccttattgaatgtgggaatgagccccacttgacggctaccagatcgccgactcctgaatgttgtcccctcggctgggtctgacttcaagggtctggcaacccgggagacatgggccgacggggaagcacaaacagaccttttccctgctgcaggtttctggcaccacctgggactgacctcactggaggggtatcgtcaccccaagtagtatgttatgaaaacctaatctaatcgaaccactacattttcaatcctatttttccccaaacacagggccctctgcaacccctcctttccttccgtccttttgaaaaccacataaccccacggcctccagccccttacttcacgccccacctttttgggagaaatatgaatgcctgtgtttaacattaaaaaaacaaaaattaaaaatanactcgagcatcatgtcggtcgaaagttaatactctcc

SEQ ID NO: 563837 - DNA, 366 bp, Homo sapiens
  misc_feature (73)..(73): n is a, c, g, or t
  misc_feature (133)..(133): n is a, c, g, or t
  misc_feature (136)..(136): n is a, c, g, or t
  misc_feature (176)..(176): n is a, c, g, or t
  misc_feature (264)..(264): n is a, c, g, or t
ctctacttattttactgtggctgctaggtggtgcaatatcaaaagtcccacatgacacgtctgctggggagantctttggggtgtacctttatcttaaatcatataaatatgagttcattgacatttagaatnacnattattattaagcaatatgctctaagacaaaggatatggnaaaataaaaacttttattcagaacacaatgaatagatatgtttatacaatacatagtatgagttaaaagtcttgggtaagatatttgnaaaaaaataatcaagattcggaatatctgatcttgattaattttaatagcaagagaagctaaataataaggttctgtagaaagagtttgaagaagatactgg

SEQ ID NO: 563838 - DNA, 491 bp, Homo sapiens
cagattcggcacgaggctaattgaaaatcatgtcctcacaatgtcacgtgtgtgtgtgtgtgtgtcgctgtcgcatgcgcacggtggtggtggttgtgatgaaatggaggaagaatatttgagataaagctaatctttgataaaattcctcctgttcagtggtgaaccaggattggagacagagaccaggggagctgcttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggc

SEQ ID NO: 563839 - DNA, 402 bp, Homo sapiens
ggagtacgtcaacatagtgaaacctcatctctactacaaatacaagtacaaaaaaaaaaattagccagatgtagtggcacacgcctgaagtcccagctagaacctgggaggtggaggttgcattgagccaagatcgtgccactgcactccagcctaggcgacagagcaagactccatctcaaaaaaaaatgttatgtttacactatactgtagtctattaagtgtgtaataacattatgtctagtaaacaatgtacataccttaatcaaaaatactttattgctaaaacatgctaacaaccatcagacacttcagtgagttgtcatctttttccaagacccaccagcagggtcttgccttgatgtcgatggctgctaactgacaagggtggtgtttgctgaa

SEQ ID NO: 563840 - DNA, 669 bp, Homo sapiens
ggagaaaggagagttaaatgttgtgggaaggcagcaggatgctaagggtgcgggccccagcagggtgagacaccttgtgccctggtcttggcccagcaaacgcaaaaccagggagtgtgcagagcccggcaaacaggttttgttagcccagggcggcctcagaattgcgggtaattcatactttgtctcagtgagtggctgagtggttgcccatcgtgagtgtgcacaaagccgagggtctcggcactcataggaagtgtggccccgaggtgttggcccagcccgagtgtgccgcccgttcaccagcctctcgtgttccaccgtgtgtgcggtctctttctctcccggaaagtgtggggttgtgggattgttgtggccctcggcggaaaatcgaggcccccagcacccacaaccccggggccgtgggagctgatcggttcatttccaccagtttgcacaatgtgcgccttagagtgcccccgagttcaccttgcctcgtgcgggtgtgtcccggtggttgtgggtgcccacccagaccaccaaaatcttgggccggatgtgtgttccagtcccccattctccagccgccacagtacttgctggtgtgccggcaccaccatgtgccaaagttaacgtgcctgcggaggtgataagagctcgggccagatt

SEQ ID NO: 563841 - DNA, 366 bp, Homo sapiens
  misc_feature (98)..(98): n is a, c, g, or t
  misc_feature (167)..(167): n is a, c, g, or t
  misc_feature (188)..(188): n is a, c, g, or t
  misc_feature (207)..(207): n is a, c, g, or t
  misc_feature (308)..(308): n is a, c, g, or t
  misc_feature (332)..(332): n is a, c, g, or t
ttgactacctactactactaaaattcgcgggccgcgtctgacgtatttggttttgtttggtttctcaaaagtttttgggtatttatatttgtaagacnaacttgcccaaatttcaaagcctcaatttaccccctctgttttctttctgagaagtttttataagcttnttagttttttaagtttatttntatttcgatttttgaagtnttttttttgtattaaatgttttgagggttaaaaagggtcccaaacttttcatttctttttgcatttgtgggcttatcccttgttgtcttcaaccactattntgtagaaatattactgttctcttntctcattgaatttgctctgggaaactcttgtcaa

SEQ ID NO: 563842 - DNA, 300 bp, Homo sapiens
tcatatagtggctgtactagtaacaaaccgcaccaacaatgtgtacgtgtaccctatatctccagatcctccctagcacttctttatcgtctattttaattgtagacattttttctttccttttatattgagacaagagtctaagtcactcagactggagtgcagtggccatgatttcggctcactgcaacctccacctccgtgggttcaagtgattcttgtgccatcagactcccgagtagctggaattataggtgtgcaccaacaaaataggctaaattttcttatttttataaagat

SEQ ID NO: 563843 - DNA, 226 bp, Homo sapiens
taagcggcatttcttcacaatatttataaaatagttatgaagagaatgtcagtatactctacacacacacacacacacacacacacacacacacacacaaggtgttatctccagaggcatacatattctaaggtactgggagatagagcttcagcgtattaattcaacacaattctgctcataacggtagtggaaaactctttccataaggtttctcccagtatca

SEQ ID NO: 563844 - DNA, 943 bp, Homo sapiens
  misc_feature (4)..(4): n is a, c, g, or t
  misc_feature (6)..(6): n is a, c, g, or t
actncnctctataaatgtagagaaaacgaaaaaaaagagtccgccgattgacacatcattgtcagcctgcagtccctcttttatccacacaattgtcgtctgttattcaagctgtccctttgggtaaagcccccctggccctctcttaagttgacacctcctgtgctatggaaatccctttccttttgacgaaaatccgtcgtcttgttttagggtctgtgtctgcagttgagccttgcaattacagtccggtcaaatccccgccaatgtatggtcggtgacacactccgttcttccggcccccctggggccctcctttgttccgccccactggggggattttaaaaattgtgcaacccgaacggaatttacaaatgttttttaacatacagtatatactaaaatgtttgtgtacagtatacacaccccatacacgttcaattaattcttggtcttccttgtccaattaaagtctctccccccacaatggtagtatgctaagacgccacacgcacattatctttacgtaaacattcttgcggacaagcaaaaattcttcccaggagtgtgtgtgaatcctgcacccacctacacggtggctcaaagcagactccctaagctaagtatgagaagtacactaattcgcgcgccgaaacctccccggatcattgaggcagaaaagacatgactcagccatacaccagcgagaacaccgacacctcctcttttcattcaatacagaataacaaatgattgttcccaagacagagtcagccgcgcaggtttgaagaggacaaactctattccttatggaggggctaaaggagacgacgcgggaattattttgttatgaccaccagaatgacgacggttgcccctgggatgagtgaaggacacttacgccccccttcggaccaaaattattacccccgtccacatgaca

SEQ ID NO: 563845 - DNA, 199 bp, Homo sapiens
gggccgtactagcagcataaggaggttcccaggctaggggtcgaatcagagctgcagctgccagcctatgccacagccacagcaacgcaggatctgaaccatgtctgcaatctacaccacagctcatggcaacgccagatccttaacccactgagcaaggccagggattgaacctgagtcctcagggatactagttggg

SEQ ID NO: 563846 - DNA, 450 bp, Homo sapiens
tgtccctttgtctctaccaaaaatacattaaattagccagttgtggtgttgggcggctgtagtcccagctacttgggaggctgaggcaggacaatggcgtgaacttgaggtcaggagttcaagatcagcctagcccatatggtgaaacctcatctctactaaaaatacaaaccttagccactcatggatgctgtaatcccagttacatgggaggctgaggcagaattgcttaaacacgggaggtggagttggcatgaaaaagaaacagcacaaatgagagatacttgagagagaagtagcctgcacccttgagggagcagggtctctggagagatagtctgaatgtgatgaattttctgatgttccatacctgtataacttgtcactgaaaaataccaacaagtacatattcccacatatgtaactagacaaagggaaacaccggtaccg

SEQ ID NO: 563847 - DNA, 126 bp, Homo sapiens
gtgggccaccgcactcagccatgtttttattttaaaaataattattttcagaaaaaatagagggtaaccttatatttcctgcaaattttttttatttctggccttaatcaaggcaaatgggttctg

SEQ ID NO: 563848 - DNA, 1035 bp, Homo sapiens
  misc_feature (78)..(78): n is a, c, g, or t
  misc_feature (80)..(81): n is a, c, g, or t
  misc_feature (83)..(83): n is a, c, g, or t
  misc_feature (88)..(88): n is a, c, g, or t
  misc_feature (93)..(93): n is a, c, g, or t
  misc_feature (100)..(100): n is a, c, g, or t
  misc_feature (147)..(147): n is a, c, g, or t
  misc_feature (160)..(160): n is a, c, g, or t
  misc_feature (163)..(163): n is a, c, g, or t
  misc_feature (166)..(166): n is a, c, g, or t
  misc_feature (179)..(179): n is a, c, g, or t
  misc_feature (187)..(187): n is a, c, g, or t
  misc_feature (189)..(189): n is a, c, g, or t
  misc_feature (229)..(229): n is a, c, g, or t
  misc_feature (232)..(232): n is a, c, g, or t
  misc_feature (236)..(236): n is a, c, g, or t
  misc_feature (247)..(247): n is a, c, g, or t
  misc_feature (254)..(254): n is a, c, g, or t
  misc_feature (278)..(278): n is a, c, g, or t
  misc_feature (325)..(325): n is a, c, g, or t
  misc_feature (338)..(338): n is a, c, g, or t
  misc_feature (345)..(345): n is a, c, g, or t
  misc_feature (350)..(350): n is a, c, g, or t
  misc_feature (416)..(416): n is a, c, g, or t
  misc_feature (437)..(437): n is a, c, g, or t
  misc_feature (445)..(445): n is a, c, g, or t
  misc_feature (455)..(455): n is a, c, g, or t
  misc_feature (473)..(473): n is a, c, g, or t
  misc_feature (491)..(493): n is a, c, g, or t
  misc_feature (497)..(498): n is a, c, g, or t
  misc_feature (535)..(535): n is a, c, g, or t
  misc_feature (570)..(570): n is a, c, g, or t
  misc_feature (588)..(588): n is a, c, g, or t
  misc_feature (592)..(592): n is a, c, g, or t
  misc_feature (615)..(615): n is a, c, g, or t
  misc_feature (619)..(619): n is a, c, g, or t
  misc_feature (644)..(644): n is a, c, g, or t
  misc_feature (656)..(656): n is a, c, g, or t
  misc_feature (664)..(664): n is a, c, g, or t
  misc_feature (668)..(668): n is a, c, g, or t
  misc_feature (680)..(680): n is a, c, g, or t
  misc_feature (689)..(689): n is a, c, g, or t
  misc_feature (693)..(693): n is a, c, g, or t
  misc_feature (702)..(702): n is a, c, g, or t
  misc_feature (711)..(712): n is a, c, g, or t
  misc_feature (731)..(731): n is a, c, g, or t
  misc_feature (757)..(757): n is a, c, g, or t
  misc_feature (764)..(764): n is a, c, g, or t
  misc_feature (778)..(778): n is a, c, g, or t
  misc_feature (790)..(790): n is a, c, g, or t
  misc_feature (818)..(818): n is a, c, g, or t
  misc_feature (837)..(837): n is a, c, g, or t
  misc_feature (869)..(869): n is a, c, g, or t
  misc_feature (932)..(932): n is a, c, g, or t
  misc_feature (958)..(959): n is a, c, g, or t
  misc_feature (969)..(969): n is a, c, g, or t
  misc_feature (1025)..(1025): n is a, c, g, or t
tgtgcgggtgagaatccgagcctttccactgcctttcttgtactgtgttaaatcttctctcactcccttgggcttcgngnntntcctngtagntccgcantctccacacccgtcactgagagccgacctcggtcctcggcattgcgnggctcttgtcagnatngtnaagctgttcatcngaaacctncnccgggaggctacagagcaggagattcgctcactcttcgancantatnggaaggtgctngaatgtnacatcattaagaattacggctttntgcacatagaagacaagacggcagctgaggatgccatacgcaacctncacgcattacaancttcatngggtnaacatgcaacgtggaagcgcaggcaagaataagaggcaaaagcgctgcaagcaaagtttgcatttngggcaagcatgcagtcgccangctggcancagattaagngagcttgcgagggcaagntttggagagagatatggnnncggnncatcgaaatgtggacatgcgtggaacagatttattgncttgcgttacagcatgggaggcgggggcagcaggnatggcaggtgggagggcncatncaggggggcctctgaataaacancagnagttttcaaagggcaaagcgaaatngcacgctggcangtttgctncacncaggccgggctntagagactngcgncgcggggantggggaganncagaggcgggcttgctatncgggtggcggggaaaagaggggggcnctgggtncaaaagaggtgttncgatagattcgnttcagggccgcgctggcaggactttganccgaggcaatataaatgangcaatacggagcagttgcggtacgcccttagnaccatggagctatgggggatttcattgtattagcaacaacgccgtacgggagcgctccgatgnctactaacaagcgctggcggtgctgnncggtcctatngaggcagtggcagctgcagctgcttccgtgtataattacgcagagcagaccctgtnccagctggca

SEQ ID NO: 563849 - DNA, 225 bp, Homo sapiens
ctctagcggatgtttacctggtatcccaccctctgtaagagcgtacactttttctcagagacagggtttcaattccatcacccaggctagggtgcaatacgcgtgatcatagctcactgcatgcctcaaactcctgggttccagcaatcctcccacctcagcctcctgagtaacagactataggcacatgtcaccacaccccggctactatacaaaaattttttt

SEQ ID NO: 563850 - DNA, 302 bp, Homo sapiens
taaatagacagggtctcgatctgtggcccatagcttgttggatcctcaaactccttggcttaagcgatcctcccttctcagcctcctgagtagatggaactataagtgcaagccaccatgtctggttcctttttaaaaactttttgtagagataaggtctccctttgttgcctaggctggtctcaaattcctgggctcaagtgatcctcccacctgggcttctgaaagggctgggattataggcgtgagccactgcacccagacaaaattatttgtcgacgcggccgcgaatttattagtag

SEQ ID NO: 563851 - DNA, 100 bp, Homo sapiens
tttttatacctgtacacacacagacacacaagcagacacacacatatatacatacgcagttgtatatatatgctgagaaagttcacatagggtaccgagc

SEQ ID NO: 563852 - DNA, 359 bp, Homo sapiens
  misc_feature (9)..(10): n is a, c, g, or t
  misc_feature (24)..(24): n is a, c, g, or t
  misc_feature (200)..(200): n is a, c, g, or t
tcaggatcnnttagcacgaatgtnatgctcgccgagcaagctctgcgctatatacagttgctgtacgaaatcgaaagtgaaatccgcgatttggagcccgatgtacggcgacgaatacgacaagaaaaagccgtccccgtgatgaacatgctgcacacttggatgatcgcccagcgcgagctggtacacgagggtgtggncatcgccaaggccctggattacagcctgaaacgctggacggcgagtcacgtcactttatgacgggcggtgctattgctacaaccacatcgagcagcaaatccgggcatgggagctcggacgcaggaactggctctatgcagggtcgataacgcagaagg

SEQ ID NO: 563853 - DNA, 594 bp, Homo sapiens
atcccaacacttgggagactgaggtgggcaaatgagcccaggagttcgagaccagcctgaacaacacggtgaaaccctctctacaaagaatacaaaaattagctgagcatagtggtgtgtgcctgtaatcccagctactcaggtcaaaacgcgaggatcgcctgagaccaggaggccaaggctgcagtgagccatgatcacgccgctgcactccagcctgggtgacagagcgagaccctgtctcaaaaaaaaaaaaaggaaaaaaagaaagaagcggaggcttagaaagtcccggctctccatttggggtctaacggactcttctccaaaattttggttatcccaggcactccatctcaggaaactatcagaagatggtacaaggtggcttcacagaagtgtaacccaggaacaagaaagacttgggattgccaccacacgaataaggttacattagacttaaaggggtcctcagattcttggaaccggtgacatcccagggtgagagctttacaccagacccagagattgttcaggcttctggagccaggagcatacagactcagggaggatgtctgggcgaaacttagactc

SEQ ID NO: 563854 - DNA, 139 bp, Homo sapiens
  misc_feature (67)..(67): n is a, c, g, or t
  misc_feature (130)..(131): n is a, c, g, or t
gggagatctgactgttacaattagaacatacatatttttgggttcagtcattatctctggtccattnttgtcaaaattacgtatttaatagagaaggtgtttaaaacaaaaggagggtttgggtaccganngctcgaat

SEQ ID NO: 563855 - DNA, 621 bp, Homo sapiens
tgtggagacggggttcacactggtcacccaggtctgggagtacagtgggcataacctctgctcactggcagcctccaccggccaggctcaagcaattctcctgcctcagcctcccgagtagctgggattacaggtaagtgccaccacacccagctgattttggtgtttttggtagagacgaggtttcgccaggtttcccagacggttctcaaactcctgagctcaaagcagtccacccacctgggcctcccaaagggctgggattacaggtgtgagccacctggctcattctagtttaaacttgggagtggttggtgtctcctgatgggactcctgcaaatacagaatggatgctaggaagggtaccaggagatagacgcacacagatgggattggggaataggttgggttatccaaggagcagtgctgagctcctggctaaggggatatgggatgctggtgatttccagtaagtgacctcaaaattactcaggctaccatatagtgtggatggtgatgaattgccagttgaagcacctgtcctgcgagcttaggggtgtacaagttgacactgcagagtaaagatgatttgaagagggatgggaggatcttggaaggctt

SEQ ID NO: 563856 - DNA, 924 bp, Homo sapiens
  misc_feature (588)..(588): n is a, c, g, or t
  misc_feature (733)..(733): n is a, c, g, or t
  misc_feature (880)..(880): n is a, c, g, or t
  misc_feature (886)..(886): n is a, c, g, or t
  misc_feature (912)..(912): n is a, c, g, or t
agcggggtatgcagggtgggtcccctctggaggctgtcccaggcctctcccacatccagtgtcaccctcagccacatccctcgtgccaccgcctctgtctccacccggccgtctcctcccccatctccgcatcttctcttataaggaagccgggccttgattcaggtcccctagtcctgtttgttttttgttttttgttttttgtttttctgagacagggtctcgctctgttgcccaggctggagtgcagtggtgtgatctcggctcactgcaaccttcacctcccaggttgcagttctactgcctcagcctccctagtggctgggattgcaaggtgcccgccaccactcctggctggttttagtgtttttagtggagacggggtttcgccgcgttggccaggctggtctcgaactcctgacttcaggtgatccgcccgccttggtgtcccaaagtgccgagattgcagatgtgagccactgcacccggcctgcctaatcccatcttaactcatcttaactaacacatctgcaaagaccctctttccaagtaaggtcacgtcctgagattctgggtggatgtgagttnggaggacgtcattcaatccaatgtggcagccatcccacagtcacgggcgggaccctgtttccttgccgaggtaaagggtgttctgcgtgtctgtcaggggaaccacttcctgtaactccatcgcctgcccggccctcagcatttnactccgtcacccccatcacctgggaggcctccggtgactgttcccggaggcctgatccctcctgaagggacagaggctgcagctacctgggaggctgaggcaggaggaccacctgagccagaaggtcaaggctgactgcaccatgancgtgcnctgcactccagcctgggcgacagagnaaaaccttgtct

SEQ ID NO: 563857 - DNA, 182 bp, Homo sapiens
tgtgtgttcccagggtgtgtgtgtctgtgtgttggggggggtgcgtcgtgtgtgtctgtgtgtgtgcgcgcgcagtgcctgtctgtgtgcggacttctgtctctctctcacgtctctctctctctctctctctctctctctctctctctctctctctcccttctcgctctgtgcgggggggt

SEQ ID NO: 563858 - DNA, 185 bp, Homo sapiens
  misc_feature (185)..(185): n is a, c, g, or t
tcctgcattgaagaggcaggacaagcttccctctgtctgagtcccagactttgctctcttctgcccctgtgccagaggtgatgatgcccttccccgtgcctcttccagtgtttcgaaagccagtatgtgacgacggagaccctcaaaaagaaggggagccagggtccttttcgctgtagtcaaan

SEQ ID NO: 563859 - DNA, 204 bp, Homo sapiens
cgttggaaccatctaactagctggattatattctatctcctattgctggctatctccttttattttattattttacttttcagagacagcgttcttgctctgtcacccaggctggatagtgcagtggtgcaatcctagctcaccgtagcctcgaactcctgagctcaagtgatcttcctgctttagccacattagtagctggga

SEQ ID NO: 563860 - DNA, 132 bp, Homo sapiens
ggagaagagcagagatacacgtgccatgtgcagcacgaggggctcgcagagcctcaaccctgagatgggagccattttcccagcccaccatccccatgtgggcatcgttgtggcctggctgtcctggctgtc

SEQ ID NO: 563861 - DNA, 891 bp, Homo sapiens
ccgaacggccgggaccgggtcctttttcgtggccgaattttcccccgaggatatctgtcccaagggggaccaatgcctccaggaaggtgaagtggcgttcaactgttcttgggagggcgtgttgggaaaaccaatactctttaagccgttggagcacgtggggagttaccaccctacactcgggtttggtgaaaaccttttctgcacgttgtaattccggaggggccccaaaaaatgtgcgttttctactggcgcccgaggtgtgagatcccgtgtaacgccagagcattttaaatttagggggggcatccagcccacgtgatttatatataagaattctcccttttgccagaataaccagggatccacattctttggttatgataaccattttttaacaagaacccacatcggagaccattctcagaccgagggccatctgtgtgcaaccagcccgaggatagagttggatccagaaagtttttgggggagagatttattcccattgtagagaaaagaagaatggtcaatatggccacaaaactggggtatttctcacaagagggacattctgtatgctcgtgcgtggggcaccaagcgcctggacatctccccggaataacatggaacaatggcgctggataaaattttatgggtaaacttgataaattatattctcccagaggagtgagcccttaagaaacttttctcctccccgtttgccaaaatggtttttagaagatgacccctgatttttttttaacatgatttatgctgtgtttggttattttttaattggaccacactatggaggattcccggggtaatagtggaagtaattatagttgccccaaaaaaaaaaaaccctggaataaataaatgttagattga

SEQ ID NO: 563862 - DNA, 220 bp, Homo sapiens
gggtccaggcacattcctggtgttcccaggacaccagactgcaataactggaggcgcctccttccccctaccttcccaacaggctccggtgtgtgttctgcccctccgtgtccatgtgttctcattgttcagttcccacttatgagaacatgtggtgtttggtttcctgttcctgtgttaattggctgaagtttatggcttccagcttcatccatgtccc

SEQ ID NO: 563863 - DNA, 497 bp, Homo sapiens
ctagagctagaaagaggattctctccacagtctgagggagaatagcctgctaacaccttgattttagacttctagcctccgtaactgtgagaaaataaatttctgtttctgtaagacacatagtttgtggaactttgttaaagtaaccctaagaaatgaatgcaataatctttgccagtaatatactacatggaccagtctaactacagtcatgtgccatacaatgatgttttcaacaatgttcttataagattataatgaagctgaaaaattcccattggctagtgatgtcatagccatcctaatgttttagtgccatgtgtgactcatatgtttgtggtgatgctgatgtaaataaactggctgctctagcagttgtataaaagtctagcacatacaattatgtacggtacatcatacttgataaataaatgactgtattagtccgttctcatgctgctaataaagacgtacctgagtctgggtaatttaaaaaa

SEQ ID NO: 563864 - DNA, 129 bp, Homo sapiens
agattcccctccaagcaccactccccgtcgtccacacaccgagtgtgagcaccccgtgtcagggcctgcggccctcatgtgtgtctctagggagcagccctagacccggcgactagtgcatgctggcac

SEQ ID NO: 563865 - DNA, 228 bp, Homo sapiens
ggcgatgcgactctgtggtgcccacgaaggtgccgtgaaatctgcccagctgcttctgcaagtccagcatgtggcggtagcactgagcgtagtatgttgactgagacttgacgaactcgtggaggcagtgcaggtggatcacgtgagtgctactgattcccttcagcaagagacggggcacttctgcttgccgatcaaactctgtcttgcccacgcggagctcatgcg

SEQ ID NO: 563866 - DNA, 685 bp, Homo sapiens
  misc_feature (27)..(27): n is a, c, g, or t
  misc_feature (70)..(70): n is a, c, g, or t
  misc_feature (73)..(73): n is a, c, g, or t
  misc_feature (96)..(96): n is a, c, g, or t
  misc_feature (116)..(116): n is a, c, g, or t
  misc_feature (118)..(118): n is a, c, g, or t
  misc_feature (120)..(121): n is a, c, g, or t
  misc_feature (128)..(128): n is a, c, g, or t
  misc_feature (138)..(138): n is a, c, g, or t
  misc_feature (140)..(140): n is a, c, g, or t
  misc_feature (157)..(157): n is a, c, g, or t
  misc_feature (203)..(203): n is a, c, g, or t
  misc_feature (344)..(344): n is a, c, g, or t
  misc_feature (350)..(350): n is a, c, g, or t
  misc_feature (366)..(366): n is a, c, g, or t
  misc_feature (381)..(381): n is a, c, g, or t
  misc_feature (477)..(477): n is a, c, g, or t
  misc_feature (496)..(496): n is a, c, g, or t
  misc_feature (521)..(521): n is a, c, g, or t
  misc_feature (524)..(524): n is a, c, g, or t
  misc_feature (594)..(594): n is a, c, g, or t
  misc_feature (685)..(685): n is a, c, g, or t
agatgattggagagggagcacaggtcngcgtgggagagagggtcatggtggacatagggggggggtggtntcnccaactcctcacattatgcctanacgaacacagacacatgcangngnntttgaanaaaaaaagtnangaggttattcaagtcanaaagggaaggagcaggtaagagactcttgcctctcagtccctacanaaggcagctgtctcacactttacaagctgtgagagacacatcagagccctgggcactgttactggttgcagcctgagtgtaactccctccttttctatctttcaccccttctccacctgagctcttcctcctccacatcanggcagngaccacagctccagtnatcacagctccaagnagaaccaggccagccatgatgcccacgatggggatggtggcgctgcgcgaagacagctcccatctcagggtgagggggttggggagaccctcatgntggacatggcaggtgtatntctgctcctcttcagaaggcactancanagccgcccacttctggaaggttccatcccctgcaggcctggtctccacgagctccgtgtcctgggtctgntcctccccatcccgctgccaggtcagtgtgatctccgcaggctagaagcccagggcccagcacctcagggtggcctcatggtcagagatgn

SEQ ID NO: 563867 - DNA, 242 bp, Homo sapiens
  misc_feature (219)..(219): n is a, c, g, or t
taggagatgtggcgggtcaggagatgcggggtcagagatgtgggatcggaatgtgcggtctgtagatgtgcagagaaagaaagatgagctgatcgaatgccaggtccgggatccacgggtccggagagcgcgggtcggagatgcgtgggtccttgcagacttcgctccgccctgcacatctccggacctgcacatctcccatccacacattttcagatntgcacatctttggacccgcacat

SEQ ID NO: 563868 - DNA, 195 bp, Homo sapiens
tacataaattatgaaaatatatatatagttatacagttataaaagatacataggacataaaataccacattaaattaaaatgaccaccactattctgtaatgtcttattctacagttaatatctatgctcatttatttgttaaaaactgtgggaaaactggcatttatattggtacaatactaacgtttcttact

SEQ ID NO: 563869 - DNA, 384 bp, Homo sapiens
gagctcggtacccgtgagtagtccaagatccagtagggggagccattggatacttatgattgaggttctggtcgaggaaaattttcttgctggtgtaaggcagagtcatgagcaatgaaccagacggtgctaacgcagaataacgattagtctgctatttgggtgtgaagagccaatgtatatccgcattggatgaaagctgatggaaaggtggttgcaggaagcctactgaagcagcgaggtctatttcctattaaaacaactagtccagaggctgtctgcaacaaatagcttactatccatctctccatgagcgccaatttccacctctggaggctttaatattcttaacaagccagcaggagggaaagccattgcgacatc

SEQ ID NO: 563870 - DNA, 300 bp, Homo sapiens
gatcccccaggcaaacagctaaacagacagaaggattggctgccttttatacaggggctatggactaccagctatggtaagctagacactctagtagaagcagctgaaagaagcccaagtacagtatacctctccagacatttgcaattaggcataggaagacagccccgatttactaggctagctagaaaggtaggcagatcatataggaagtgaacatatatagaagtccttattaactctgaggaaggcattcaggctctggatgacgtcatagctgttacctaggggtaccgagct

SEQ ID NO: 563871 - DNA, 422 bp, Homo sapiens
  misc_feature (8)..(8): n is a, c, g, or t
  misc_feature (24)..(24): n is a, c, g, or t
  misc_feature (40)..(40): n is a, c, g, or t
  misc_feature (50)..(50): n is a, c, g, or t
  misc_feature (82)..(82): n is a, c, g, or t
  misc_feature (90)..(90): n is a, c, g, or t
ccccgacnggcctactaggccggnagcgccccctataccngggagagaanaccgtggtggatccaggcccacaggtgtatantttttaanctgaccccattaatttgggggagaaaaccccgccctttccacctcaaaaacatgaccccccaccttataactggggaatcaaagaaagcccctcgtttaattcctagctttgcaaacttactaatatctacttaggaaaacattatttttcaatttagactatgagttaaaatcactttgaaaatgaaaatgactgggtttttcactagatttactgaaaataaaaaataaactaggatctctgggtgggggctagctgagagggcttcaagttcatagagagacatataccaggaaacaacaaaacacagtaggttaccggtgctgcaata

SEQ ID NO: 563872 - DNA, 435 bp, Homo sapiens
aattgatcttatttttgatttcacttatcatagaacaaatatgtatcattatggcagtgtatctatgtaattatcaatttaatcatcaccaccggtgtttccatatttttcccaagtatttaataagctctcttatggtggggcctggtgatggggccgtctttttttactaccacatgaacaatcatatggtatttcaagggattttaagattcatcttttcagtttgatagtagcctagtaagggaagacctctttcattcctgccttcgggtaattcttctctgtagacaggtgttcatattaatgaccccattttttctcaccatggtagcagaattcatttttttcgtcaggatcaatgaatatgtgatttgctccagttcgttagaaaaaagaatgtgattgactacataatcaaccaaaaaaaaaaaa

SEQ ID NO: 563873 - DNA, 434 bp, Homo sapiens
  misc_feature (371)..(371): n is a, c, g, or t
gcgatgaacacacagtacgtgtgtctttttggtagaatgacttactttcccttgggtagcatacctagtaatgggattgctggctcaaatgttatttcaattcttaggaagacatggtgcatctataccatggaatactttgcacccattaaaaagaatgaaatcatgtcctttgcagcaatatagatgcaagaggaggccattctcctatgtgaattaacacagaaccaggaaactaaatatcagacgttctcacttcttactgtgaggtaaacatcaagtacagatggacataaagatgggaacaataaacactgagcaattcaatggggcaaggaagggatggggcaagggtttgaaaactattgagngctatgctgactacctgggtgacgggatccttgtgcttcaaaccttaacatcacacattatac

SEQ ID NO: 563874 - DNA, 705 bp, Homo sapiens
agcggataagatggcgtcctgatggcggtgcgacgacgcatgttccgcgtggggcatgtggtgctcagcggggcctggcacacggacccgtacctcttgtaatagattctcggggccgagggacaccgggcaaatccacgctggcgtagcagcataggccagacgggtcggcggtgacgatcgtcagcgctgactccatggcaggtctatgaaggccttagacatcatcaccaatcaaggtttctgaccaagagcagagaatctgccggcaccacatgatcagctttgtggactccgtcttgtgaccaaattacacagtggtggacttcagaacatagagcacactgctcgtgattgacacgcatactatttgcccgagacaaaagttcctattgttgtgggccggaaccaatatattaccattgaatctctgctctggaaagttcgttgtcaataccaaggagcttgcaagttttctgaagaaacaggaatctctcatagtgaatttactccatcgtcatcatacggaagaaggtggtggtcaccattggaggtcctctgaagtactcgtaacccttgcatcctttggcattcatgcttgaccagttctagatgagcgcattggataaaagggtggatagacaatgcttgctgatggggtcatggagtgaactaagagatttcacagacgctataatcagaaga

SEQ ID NO: 563875 - DNA, 127 bp, Homo sapiens
aaccaaggtctcatcactccttccaacatctcatgccccggcaagtgctgcgattattttgatagagatgaggtttcaccatgtggccaggctggtctggaactcctgacctcaagtgatctcccca

SEQ ID NO: 563876 - DNA, 538 bp, Homo sapiens
ctctcgaggatgcggcagctatccggttcaatgtaagagcacgggaagtatgaaaaagcaaggaaatataaaacctccaaagaaatataataatcccccaacatcggattccaatcaaaaagaattcaagaatttccagaaaaagatttcaaaagtatgatactaaaggaaagctcagtaagatacaagagaatcctgaaaaataatactacgaaataagaaaaagaattcaagatatgaacgagaaatttaccaaagagagaaatatagaaaagaaccaaagagaaatacagaaactgaagaattccttctatgaaatacaaaatacagtcaaaagcatcagtaatgaactagaccaagcagaagagacaatctcagaacttgaagaagggacttttaaaacatcccagtcagacaaaaataaagaaaaaagatatatgcaaataaactagaaaatctagaagaaatgggtaaattcttcgacacatacacccttccaagactaaaccaggaagaagttgaatctctgaatagacca

SEQ ID NO: 563877 - DNA, 811 bp, Homo sapiens
  misc_feature (8)..(8): n is a, c, g, or t
  misc_feature (15)..(15): n is a, c, g, or t
cggcacgngattgtnagcgcctgttttcctctgtccctgggtaattagggatctgttggtttccccaacagaacatatttaatggactgctactcagagaggtagaaataaataccaccaaggcagacagttctaccgtaattctctcagtcagttctccatgtcctgtaatccatttgacatttgaactccagttaataataaatccatttctttcgtttaaaatatggaaaaatatattcctgtaacatataatgtgcccgatgtagaatttttataggttgaataagaaaaatacgcgtgacccaaaaagtaacaaatcacagaaatatataaatgttaagctaaatggtaacatacaaatgttcgatctcactactaatgaaagacaattgatgcagggtttttttcggtgccgctttgccagctggagacctccgtggtcggcgatgcccctgcccaggcctctctcggcccaggttcgcccactaggcctgccgggccgcacctggcttgcgctttggcatatcccgtggcctcggtgactgtgctctcagcccccagcaggtgggttgtgcgagcaactgagtgtaggggtccgggggctgctccaaccgccagcataggagcaggctccacacggggcttgtagctggaccaggcgtgtggcaagtgactcccacagtggactcctgcgtccaggcgaggggaacaccgtggcgcccgaagagcaacgcccgcgaccccgaagcccgagaggggatgttacagcgtgcacacagctcttttcgacccgcatctgctgccggac

SEQ ID NO: 563878 - DNA, 360 bp, Homo sapiens
  misc_feature (38)..(38): n is a, c, g, or t
  misc_feature (92)..(92): n is a, c, g, or t
  misc_feature (127)..(127): n is a, c, g, or t
  misc_feature (134)..(134): n is a, c, g, or t
  misc_feature (166)..(166): n is a, c, g, or t
  misc_feature (200)..(200): n is a, c, g, or t
  misc_feature (278)..(278): n is a, c, g, or t
ctgtggtacctatttgttcttttgtcttttaatttaanccttggtggagccccttgtgatgaatattaaatccatacattttgggctgggtntggtgcctctagccctataatcccagcactttggnaggccgnggcaggcgaatcgtcaggtcaggagatcgagnccatcctgcctaacacggtgaaacctcgtctctnctaacaataccaaaaaattagccgggcgtggtggcgggtgcctatagtcccagctgctcgggaggctgaggcaggagnatggcatgaacccgggaggtggagcttgcagtgagctgagattgcaccactgcactccaggctgggcacagagcaagactcc

SEQ ID NO: 563879 - DNA, 814 bp, Homo sapiens
ggtagatgtgcggcggcggcggctgcagcgggctcggagtgcagcggttgggctcgcggcgagcggacgtgggtcgagtcaagtgcgttcgcgcgagttggaatcgaatgcctcttaaaatggcagatgacttggacttcgagacatggagatgcatgtgggcctcatgccaccttcccaatgcacgttgctcagcatttaccgtaagaagtggcttctgtgagtgctcaaatgtggccggccatgtaagatcgtcgagatgtctacttcgaagactggcaagcacggccatcgccaaggtccactctgagtttggtattcgatcatcgtttacgtgggaacgaaagtagtgaagatatctgcccgtgctaacctcatagatatggatgtcccacaaggatcgtacatatggaatgagcttccacgctgaatttgagatccaggacttggtgtaccgtatcacttgttccaggaacagcggtggaggtacgaagaggaccttcgttctccctgagggagaccttggcacaggatgattgagcaaaaagtactgactgtcggagaagacgagcctgatcacatgtgctggtctgtcaatgacataggacggcagcttgtggcaatcaatgtctattggcgatcattaacttggttcccaaggattggcgcgatggtgagcagtcgagttggtacctttggaaccttgcaacgagtgcgcttctacccgaagcctggtccttggtttgtcctggtcctagggcttggacttctaccaaccgagatatgacgcgggagaatctgggtatcgcagccg

SEQ ID NO: 563880 - DNA, 114 bp, Homo sapiens
gaggatccccggatgcggcgggggccaactcttggtagttcggcagctgggcgccccaagctcatacttccgctctcttgcgcggtggctgccggcgatcccccgcaagtactg

SEQ ID NO: 563881 - DNA, 542 bp, Homo sapiens
  misc_feature (14)..(14): n is a, c, g, or t
aacactttccttcntgttcgggtccgcggggcggcccggtgtctgggtgttgggcggggaattaaacaaccaccatggggaggaaaagggcgaagaccaagaccaccaagaaggggcctcaggggcgacatccaggggggttggcatggttggccaggcacagagtgaggaggtcaaagggggcttcaacatgaggggtcagaacaggggtgggttcatcggcaagggagatttggatgatatggttggttctctagggaagaatcccacgggtggataccttggtggcatggtgaatgaggggcccaggggcccatcaatttcaccatggtcctggccatggttggggaggaggtaaatgggacagatcctggagatggcatcagaaacgcctttggttggtttggtgaagaagcaacagggaccattcagggagattacctaagggaggtggtgagcaccatgggggatcggtttacaggtgaggaaggggatggcgtgacagggaacacctatgggcaggacaaggggacggaaggact

SEQ ID NO: 563882 - DNA, 488 bp, Homo sapiens
gcaggaagtaggtgatcatcgcgggagatgcaaaaacagggcatacaagtaaaatcagcatcccttcagtaaaaaaccatcaataaactaggtatgatggaacatacctcaaaataataaaagccattcatgacaaacccacagccaacatcatactgaatgagcaaaagctggaagcattccccttgaaaacaaacataagacaaagatgccctctctcaccacttcttttcaacacagtattggaaattgtggccagggcaatcaggcaagaaaatgaaaggttattcaaataggaaaacaggaagtcaaactgtctctgtttacagatgacatgatcctatatctagaaaaccccactgtctcagcccaaaagctccttaagctgataagcaacttcagcaaagtctcaggatacaaaatcaatgtgcaaaaatcacaagcattcctatacaccaaaaatagacaagcagagagccaaatcatga

SEQ ID NO: 563883 - DNA, 958 bp, Homo sapiens
  misc_feature (111)..(111): n is a, c, g, or t
tatcacttgccagaattttaatgattgatttgagagtgaataagttaatgttattaagcagttaagtaagtttatatgtatggcatataagtatagaatatgagattcatnataagttaacaaaggaatttggtttaactacagaagttggagacatggagaaatacatcttttagtgttcacttgaatttgggctagtagcgtaccgtgatgtattgtggacatattctgaggaggatttcgagatgttattctattgaagcgccacgatatacgagtctaccgttctagtcttatagtgatcggtaggtgcgttcatgtcagacttcttgctggtcagtgtttatatgtttcaccctttattcttgtgccacgcaagtgtcaaacagttatacggatataggaaatataaattgagatatttggtgattggcagcctcgtgaagatgttagattaagtttgatctagttctaaagtgctgtagtcatatatgaatttaagacctagtaccatccaaaagcaatgtaatggattggaagaatctgtaaggcgcttcttaggctttatacatgtcccgtacctgatatttgactgtccttcatgatcctgttcttgaaaacttcagtgtgaattcgagaatcctgtaaatctccttccaattggtaaactccctgaagtaatattaaaggaagtatttaagtggaagtttacggagtttaaaacattctttagaacttaatacagatagttagctattatctatgaaaaataaagtaacgtaaaaaaacgtgaccacttttacataatttcatattgtgtcattatagtctggaggtattacaaggttgataggttataaccacgggaatggagaacctttaaaagggtagtaagcatttggtccagttcaattagaacatttgttaacgaacggaatggaatgtgctaaggtaatat

SEQ ID NO: 563884 - DNA, 111 bp, Homo sapiens
ccacctcagacccccaagtagctgggactacaggcacgcatcaccacatctggctaattttttggtaaagacaggacttcgctatgttgcccagactggtcctcgaattcc

SEQ ID NO: 563885 - DNA, 431 bp, Homo sapiens
catgataaaaactcttcagaatctaagaattaaagtaacatacctccaaataataagagccatttatggccaacctgtagtgaacatccctctgaaagggcaaaaactggaagcattttcctggagatttagaacaagacaaggatgccccctttccctgctcatattcagcatggtagtggaagtgctagccagagccatcagaccaaagaatggagtgaaaggccacccaattagataaaaagtaggtaagctgtctcccttcccggatgatataattttatactcaaaaagccctaaagactccccccaaaagctcctggaactgataaataacttcagtaaagtttcagaatacaaaatcagtagccttttttaacatttgagagtccaaccaagaaccccatccccttttccatagcttaaactga

SEQ ID NO: 563886 - DNA, 298 bp, Homo sapiens
aacaaaatgcattatatccatgtaatgtaatattattcagccataaaaatgaatgaaatgatacttgttacaacatggatgaacttaaaagcattatgttaaatgaaagaagccaaacacagaaaggccatttatgtgtatgattccattaatatggaatgtccagaacagacaggaagatgattagtggttgcacagaggggggtaatgacaatgttctggacttagataatggtggtagttgcacacacattgtgaatacaccaaaaaccactgaattatatgattgtgttgtgtt

SEQ ID NO: 563887 - DNA, 902 bp, Homo sapiens
  misc_feature (38)..(38): n is a, c, g, or t
  misc_feature (529)..(529): n is a, c, g, or t
  misc_feature (558)..(558): n is a, c, g, or t
tagtccgtcccaatggatcagctgcatgatgcgatgantcggtgcggtgaatgcaaagaagataacgcttccgaccaaatcaaccctactggaatcgatggtgtctccggtgtgaaagaacaccaacaggggtgttaccactaccgcaggaaaaggaggacgtgtggcgagacagcgacgaagtatcaccgacataatctgcgaaaactgcaaataccttccaacgaaacgcaccagaaataaacccaagccaatcccaaaagaatctgacgtaaaaaccttcaactacacggctcacctgtgggatatccggtggctaagacgtcgtgcgaggaaaacaaggtgattgaccaaaatcgaagttacgaccaagaaagcgtcgagcgagctttaacgtgcgctaactgcggtcagaagctgcatgtgctggaagttcacgtgtgtgagcactgctgcgcagaactgatgagcgatccgaatagctcgatgcacgaggaagaagatgatggctaaaccagcgcgaagacgntgtaaaaacgatgaatgccgggaatggtntcaccctgcattcgctaatcagtggtggtgctctccagagtgtggaacaagatagcctcgaacgacgaagtaaagaacgcgaaaaagcggaaaaagcagcagagaagaaacgacgacgagaggagcagaaacagaaagataaacttaagattcgaaaactcgccttaaagccccgcagttactggattaaacaagcccaacaagccgtaaacgccttcatcagagaaagagaccgcgacttaccatgtatctcgtgcggaacgctcacgtctgctcagtgggatgccggacattaccggacaactgctgcggcacctcaactccgatttaatgaacgcaatatt

SEQ ID NO: 563888 - DNA, 244 bp, Homo sapiens
taggtctggacactccatccttgccaaacctctgcccaaaagtggccttaagcgccggaatgccaattaactagagaccctccagcccccaaggggaggatttgggcagaacctgaggttttgccatcctcgatccctcgtgcagggcctggctcacaaaaagaatgcaacagatggttttattccatagatgcggcattgctcggtgagttgagggcgaaaatgaaaaagtcccgcgtttcga

SEQ ID NO: 563889 - DNA, 401 bp, Homo sapiens
ttggccattctttcccctcccccaccccttttcttttgagggacttttaatgtttgctgctttaggtggatggagagtcccccagtccccctcaatggtgctctaactctacccccccccccctaattaggggtgctaataaaacctgctgaggtttagataaagacggggcataaggggaaaattccttccataaagctgaaatttggttttcaaggcctctgtggctttcttttgaacttacccccagccctggctggaaagtagattgtgtttttagtaatgtgtactgtgagctgttttctgtataatgtattttgtaatgtatttttttcctctccccaaggatgaaaccaataaaatttttttaatagtttggctctaataaaatttttttaaga

SEQ ID NO: 563890 - DNA, 462 bp, Homo sapiens
cgcaacatgtgggcctcagcgcatgggggtgctcggggaggaagcacctatgtttccaaaccagacacctgggctgagagaaaccgatgacctggaagagagaaggttccaccacttggcacaggaacgatgacacacgtgtattgggcgccttcaatatgagcggtccatgcttcccactggtacacgggctggtcgggaacccaatatcgaccggagccgactttccaaatcggcaccctacactggttgtctaggaaacctaccctatgatgttgccgaagagtccattcaggaattctttcgagggttaaatatcagtgcagggcgtttaccacgtgaacccagcaatccagagagggtggagcttggctatgctgaatttgagagacctggattccctgttcaatggcctgagtgtcaacgaagagtctctaggttacacgagttctagtggccttg

SEQ ID NO: 563891 - DNA, 388 bp, Homo sapiens
tggcccggtgagagtctggtggctggtgacaaggggggtaatactacttgaccccaggagcaaaactgactggaaaaaagaatcagaaaaaaaaaagggggaggagagatgaataaggtcctcccctcattggcaatagctagcaagaatggggagaaagggacaatctgggcctggggagaaatggatcttcagaaaagaagagaggctatctcttaaaaagggtccttaggtggttagatcccaaggtgtctagggagaagtggtagtggctccaatttaacttaagaaatactcggtaactgagggtctgaagcaagatttctttaaagagggtgcctggtactactataccctttaggttttagtagcacagggtagagccgag

SEQ ID NO: 563892 - DNA, 256 bp, Homo sapiens
tggaaatgaatccgaagtattacgcgttgagagtataaagcgttgaggaagtataaagcgttgagaagtatcaagcgttgagaaggtataaagcgttgagaagtataaagcgttgagcacagtatacagcgttgaggaagtataaagcgttgagcaagtataaagcgttgagaagtataaagcgttgaggaagtctaaagcgttcagaagtataacgcgttaccaagtatcaaagcgtggacaagtatcaagcgtt

SEQ ID NO: 563893 - DNA, 848 bp, Homo sapiens
  misc_feature (494)..(494): n is a, c, g, or t
ggcagcacagcgtccgcgagaatccgcagcaggagcagcaagctgagccgaaacaccgggggtattttgagcatttcgagaagacccttggggctaacagcatgatgccgcaaaacacagggggggacacaaaatgccccgcccacaaatgtgggccccccagcagcttcccacataaaagcgggcaataattggcccgaacagtgtcccgagaaatatggagcggcgcccgcaattacaaagaagtatccgacgggcccccatcattatatagcggagccatggataattgccgaaacggggttctctgaggaagtttatgctacggtactttctgtactttctgccgattttgtatcctctccccggaggggtcaaaattcgtcgcagaacaatgacgaggggcctgcgccaagaattcctctgtcaggcaggacccccgtgcggggcgaaattccatccctgcgtgcccaactactactctagggccatcnccacatagcatattactgtgcgaagtgacgccctctgtgcaataatttcatatactggagtagtggtccaccgcgagggacccactctgataatctagtgtgagataggttttctttatagaggcccctggagaccccccctggttaaacacagagacaacaagcgctgaaaaactggtgcgagctgaataaattttgttgagggtccctcatgacgtcactgttgttggcgaggttatactttccgtcagtttatgggttgatatgaagtctctgacagtcttgcgcgggaaactataccccacgggtccttggagcagctcagaaaagccggtttttcttggacggcaacaa

SEQ ID NO: 563894 - DNA, 475 bp, Homo sapiens
ctccacatcttcaccagcatttgttgttgcctgtttttggatataagctcttttaaccggggtgagatgatatctcattgtagttttgatttgcatttctctgatgatcagtgatgttgagcactttttcatatgcctgtttgttatttgcatatcttcttctgagagatgtctatttaaatcttttgcccatttttaatcggattattagatttttttcctatagagttgtttgagctccttatatattctggttattaattccttgtcagatgagtagtttgcaaatattttctctcattctgtaggttgtctcttcactttgttgattgttttctttgctgtgcagaagtttttagcttgatatgatcccatttgtccatttttactttggttgcttgtgtttgggaggtattactcaataaatttttgccctgaccactgtcctaaaaaatttccccagtgatttcttaaa

SEQ ID NO: 563895 - DNA, 935 bp, Homo sapiens
  misc_feature (327)..(327): n is a, c, g, or t
gttcttccgccgctccgccgtcgcgtttctctgccggtcgccatggcagaagagatcgccgtgctggtcagttgacaatggctccggcctgtgctacggctggttttgctggggacgacgctccccgagccgtgtttccttccatcgtcgggcgccccagacaccagggcgtcatggtgaggcatggagccacgaacggactcctacagtgggcgacgtacgtgccctagagcaagcgtgcgtcatcctgacccttatagtaccccattgatgcatgcgcatcttcaccaatgtggtgactgacattggctgaacgcatctggcacncacactcgtgtctatcagatcgagcgctgcttgcgtaggcccgcgagaggacgcacgcctatgtcgcttgctgatcctgatggaccccctcgtgagaccccgagatgggccaatcgagaggacgaacgtatgacgtcgagacttatggttctgatgagccttcaatcgaccccaggctcgatgtatcgatgtgctcatccatggcccgatgtcgtgtcaccatctacgctcgtctgggtcgcatccaactggcacttcgtcgatggagcttctggatgagcggggtcgaccgcacgacgggtgcccattctagcgaggggctatcgccactcaccccagcgcctatctctgcgattctggagcctgtgcttgtgccggtgcacctgagccagacctaccgtcactgaaggatccgtcacttgagtccgaggcgtacagtcgttgcaccgacgcacgagccgtagcgcggtacaatcgctgccgcgacagtctaaggcagaaagctagtgcctaccgatcgccctgggactctcgaggcacggagcattggccaccatgtcgcatccgtccttcgttctctgtgacgaagagctacgaagcttggccga

SEQ ID NO: 563896 - DNA, 94 bp, Homo sapiens
  misc_feature (59)..(59): n is a, c, g, or t
gtagaaggggaggccctgttgggccaaatgcccaaaaattgtaacttttgggatttttncggcatcaaaggcaaaaaaattttttggcccctta

SEQ ID NO: 563897 - DNA, 335 bp, Homo sapiens
cgagtgcagctgatgttgtggtgactctagaggaccccactgcgcactctcttccgggctgtcgcagccagcttcctcgcatcttcaccagcatcggagaggactatgatgagcgctgtgctgccgtccatcacaactgagaatcctcatgtcagtgcgtggctcgctgttgatgctaggagaactaatcacccacgagagagctggtctccaggaaggtgagcgacgatcttacagagcgagccgccacctttgggctcatcctggactacttgtccttcacacctctgaccttcgagaaggagttcacagaagcggtggaagccaaccaggtg

SEQ ID NO: 563898 - DNA, 306 bp, Homo sapiens
  misc_feature (306)..(306): n is a, c, g, or t
aacagcgtgaggaggacagaagcacccaacaggacttctcaagccacctgcgaacacttctgctaccatgcccaagagaaagggcaaaagggggattctaaagggttattaaggcaaagggttaagggttggccccaaagggggattaaactttggttttttttctaaaacgacttctttcaaaaacacgggccccgggccctaaaagggccctttgaaaaggggggggaaaaaggtttccccaaggggggaagggggaaagcgttttctgaaaggggggggaccacacccctacaaaacccccgn

SEQ ID NO: 563899 - DNA, 681 bp, Homo sapiens
caagaccctgcactgacatgtccccacgtgagggacctgtgtgtgtgtgatgtctaaatgggggatggaggggacgggctgtgcactgtgcaatctgctgtgcctcgcggcctccagcggggtccccctattctgcatggagcagtctgcggctgtgcgccccctgcccgtctattcaagctccctgttctcttgtcatctgtgttccctctaatgtgatgtcctacatgttttgtggcatgaatctggatgtgtgcatgctgaggctctgcttgagtgacctgatgaacactgacttgtgtgtcccttctctgttggtgactttgaatgtacactgcaccaagctatcctgctaactgtgtgacgatgactcgaatgcaacgtgacttgcatgtgtgcctatgtatatttgccttcatctgacatgcttcccaggggagactcggacgctcactctggcggaccttgatcccaagttgttgtcggcactgcgtgatttccatcccaggacggagcgctccctactcctggccctggactcggccccatcttccggggatttcggcttgatgcgccgttgtgtgcatctgagtcctttacgattcagttctgtgctggcttgtccgctgccggtcttgtttgtgcacgctatcatgatggggtttggtggtcgtgttgttg

SEQ ID NO: 563900 - DNA, 120 bp, Homo sapiens
cgctcagggtggaagtggccgggcgcgtcgaatgtgccgagctggtgcgagtgggcgagcagagcgccttgagggttgagcatcttctggatccagcagaggcctcccaggaggggagcc

SEQ ID NO: 563901 - DNA, 100 bp, Homo sapiens
  misc_feature (81)..(81): n is a, c, g, or t
  misc_feature (85)..(85): n is a, c, g, or t
ctcacaaaagagaagcccagctcttatggtgtcttgtaatcgcttgtgggtggggacaggaaatggtgtcattatctccancccnttgacagaaacaaat

SEQ ID NO: 563902 - DNA, 346 bp, Homo sapiens
tggagaaggagtctcgctctgtcacccaggctagagtgcagtggcgcgatctccactcactgcaacctccgcctcccgggttcaagcaattctcctgcctcagcctctcgagtagctgggactacaggtgcatgccgccacacctggctacttttttgtattttagtagagacagggtttcaccgtgttgctcaggctagtctcgaactcctgagctcaggcagtctggctgccttggcctcccaaagtgctaggattacaggggaaagccaccgtggcccagccctgggtatcttcttttatcttaggctctagactctgattcacaggctgaaccctatctcag

SEQ ID NO: 563903 - DNA, 358 bp, Homo sapiens
atcttgaggatcctcgaaatcatagcatgggagcattgaataggtggcaggactgtgaagaaagcccttgttttggatgatgtgacatgttctgactggctgagcaagccctgatgaatggtggtcaggaaaggctgagtgatgaagagctacctggtagtgtctggggcacaaggctgtcttgggggtaggaacagcagagacaaaggccgggaggcaggaacggctggaaggcatgtgttccctagatgggaggcagcagtcacgggggacagggctttgtgggcctcagggaagagttgtggatttttgttctatgccctatgagaagctgctgaagggtgccgatgaatagcga

SEQ ID NO: 563904 - DNA, 881 bp, Homo sapiens
  misc_feature (630)..(630): n is a, c, g, or t
agcaactccttgaattctcagttttgctggaggccgataagcaggtcctcgggccgcgcaccatgtatcgaaatcagtatgacaatgatgtcactgtatgtgagccgcccaggcctggatttcatcgaatctgagactatgcgatggcacgctgttaaacaaaggttcagtcacagttggtctgtatatcaaaaatgtcatgcagtttggggctctgtcattgtacaaagggcgcatatcagagctgtgcagactcatcaggaataatagaattctccatgttgactagcatatagttatctcaatggcgtggctaactgctgtatgctagactgtatgtagatcttatgcgtcaggagtgttgggattccagattcgtatgcgatagaccacggtctgtgtctcgtctggtatctctaattggacagcaaggaccagatatacaactaggatgatgtggacggaggaccactgatggtgttggtctccttaatgtggtcatgatgatctgggtgccttcccatttggccaaagctgtccatctgtgactattttgagtgagagccatgttcatagaagcctgtcccagtcaggtctgacttacttggagcgaccatatgtctgagttantggggttgtcactcacttgaactagttgagcatggtgtgggtggctagagaaagttctgtagaaaagacagataggaggagtcccatggaatgttggtacgacttgaggtagaagctgggagagaatgttccacactggggttgtaaagcaagagggactgtccctgtatacttaaagggtgcaggaaaggacgaatttaaatgagagggaggaaaatttaggaaggataataaagaacaaaatatgaaac

SEQ ID NO: 563905 - DNA, 1084 bp, Homo sapiens
  misc_feature (348)..(348): n is a, c, g, or t
  misc_feature (351)..(351): n is a, c, g, or t
  misc_feature (378)..(378): n is a, c, g, or t
  misc_feature (390)..(390): n is a, c, g, or t
  misc_feature (392)..(392): n is a, c, g, or t
  misc_feature (402)..(402): n is a, c, g, or t
  misc_feature (410)..(410): n is a, c, g, or t
  misc_feature (424)..(424): n is a, c, g, or t
  misc_feature (437)..(437): n is a, c, g, or t
  misc_feature (451)..(451): n is a, c, g, or t
  misc_feature (454)..(454): n is a, c, g, or t
  misc_feature (479)..(479): n is a, c, g, or t
  misc_feature (781)..(781): n is a, c, g, or t
gtctaatgactatttcatttaatccttcctgtgtctaaagcaatggtactggcattacaagatgttaatatggaacaccttgagaatctaaagaagcggttaaataaataattaaactaaaatagtattcaggaacaattaaaaacaagaaggaaatatttagaattggttcacaattttacttatgatacttgtgtgtaacaaagggaaaaatgaaatttcatagcttatttcagtttaattttaaagtgtttaatcatgttggttatatgtggagcttttgaaaataagttaatcttttttttttgttttgtaaagtggtgcagggtatggctctgtggcccaggntanagtgcaggggcatgatcataggttatnggcatcaacctntngagctcaagngatcctcnggccttagcctctngagtggcggggantataggcttgtacnacnatgcccagtaatttataatactatnatggttgtagggacagagttttggctatgtggcccagatgggtctcaaactccgggcctctcactctctgccgtcatggcctccaaagtcatacttttttctaaaagtaacggtcagatggaggaatatggtgacccactatggtggagaaccttggtttcccactgtggtcacgtcacttaagatgttggctaaacacttatggtacccgggtccggggggagctcatattctgaaagttactacttataaataggtaattcccttctaatatgtgcactgtctatggcatacacctgaanatgcctgatttgtcataaattgtgagtaccccaaagattggttcattttggtcaatcttcggggacaacatttacatcccggtgattcgaacatcggttccgataccaatggttacggggtaataggcgataataacttgcgacatcaggatcaggtcaagaaaggctccaagtattgggggtaacttttccgggcgttttaagggttggaaccatttaaccggggcattgggaaaggatattttggaggcccagaagagtaaactgtgaacgttaacacagcccggcgcaaggagatctaag

SEQ ID NO: 563906 - DNA, 186 bp, Homo sapiens
gtctcaaactctgactcaaatgacctcaaatgacctcaaatgatctggcctgcttggcctcccaaagagctgaaattataggcatgagccatccgcacctgcccacaagtgggttttttgttttttgtttcttggtttttttttttttttcttgagagggattctcgagcctccatctcaaaaaaa

SEQ ID NO: 563907 - DNA, 273 bp, Homo sapiens
tttccccccaaccccccccctttttttaaaaaaaagccccccgggggggttaaaaaccaaaaaaaaaaacccaggggtttggggggggagcccccgggggcccctaaaaaccccccgaggtttttttttggagggaaaccaaaatccggcttaatgggggccccgcccttttttaaaaaccaaggttttttgggacaaaaattaaataacccaatccggggggacccaaagggggaagaacccccccaaaaccctttttttttttttttttta

SEQ ID NO: 563908 - DNA, 181 bp, Homo sapiens
ctttaccataaaaagacgggtttgagggtttgccttttaaagtttgcaacttcaaaaaaaaaaatcgaccctgtggattgactttcccggtccctatataaagcaaataaacttaaaaccctttgtaaccatgtatttactttgccaggggcctatattccaataaaatgttcatccttga

SEQ ID NO: 563909 - DNA, 312 bp, Homo sapiens
  misc_feature (45)..(45): n is a, c, g, or t
  misc_feature (80)..(80): n is a, c, g, or t
  misc_feature (113)..(113): n is a, c, g, or t
  misc_feature (131)..(131): n is a, c, g, or t
  misc_feature (280)..(280): n is a, c, g, or t
aaattatctgcttccctgactattcctggaccatagccgcatctnattgatgcccttcttcccaatccaaagcctctttngcgtcctcctcttgtattcccccatcttaaccnacaagtataagatacctntactccctccttggcgaccgatcatgcaccccttaccatctcattaaaacctaatcacccttacctggctcaatgccaatatcccatcccacagcatgctttgaaaggattaaagccttgtttaacacttgccttcactttaggacttnaccctggacacccatttaggctcagcaaaatt

SEQ ID NO: 563910 - DNA, 435 bp, Homo sapiens
  misc_feature (18)..(18): n is a, c, g, or t
  misc_feature (69)..(69): n is a, c, g, or t
  misc_feature (76)..(80): n is a, c, g, or t
  misc_feature (82)..(85): n is a, c, g, or t
  misc_feature (88)..(90): n is a, c, g, or t
  misc_feature (164)..(166): n is a, c, g, or t
  misc_feature (169)..(171): n is a, c, g, or t
  misc_feature (174)..(175): n is a, c, g, or t
  misc_feature (178)..(178): n is a, c, g, or t
  misc_feature (182)..(182): n is a, c, g, or t
  misc_feature (187)..(190): n is a, c, g, or t
  misc_feature (247)..(247): n is a, c, g, or t
  misc_feature (282)..(282): n is a, c, g, or t
  misc_feature (284)..(284): n is a, c, g, or t
  misc_feature (293)..(293): n is a, c, g, or t
  misc_feature (298)..(298): n is a, c, g, or t
  misc_feature (327)..(327): n is a, c, g, or t
  misc_feature (345)..(345): n is a, c, g, or t
  misc_feature (357)..(357): n is a, c, g, or t
  misc_feature (361)..(361): n is a, c, g, or t
  misc_feature (375)..(375): n is a, c, g, or t
  misc_feature (416)..(416): n is a, c, g, or t
cccggcggcggccatcanccccctcggcctcggctcgaggggcggggagctgcgcgcgcccctcggtcngaccgannnnngnnnntgnnngcccgtccgcgcgccccgcggcccgcgcccgcagtccgccccgcgcgctccttgccgaggagccgagcccgcgnnnggnnngcnnggncggngctgnnnnggccctcccggcccgcgtgaggccgcccgcgcccgccgccgccgcatcccggccgcnccccgccgccgccgccgccgccatgggctgcctcngnaacagtaanatgcnaggaccagcgcaacgaggagaaggcgcangtgaggccaacaaaagancgataagcagcngcanaaggacaagcaggnctaccgggccacgcaccgcctgctgctgctgggtgctgganaatctggtaaaaccaccat

SEQ ID NO: 563911 - DNA, 253 bp, Homo sapiens
cacccgatgtcggttgttacgtgtcccggatcgagcccacgtgttcgtccaggtccataaacaggggttataaccggggcggcccaggtcgcgcatatcgtggctatccaggcattgaaaggttgcgccaggaggaccgctgcacaccataggggccccatacgcatcaccagccatgcgtaggcccccgggcgtttcgcatgggtacgcgaaagcgtgggtcgaggggaaaatgcaaaccgttgcccatcat

SEQ ID NO: 563912 - DNA, 584 bp, Homo sapiens
gggcatctcgatacaagtcatatatatatagatatacagacacacatatatgcatatcagtaagtcctcacttaacattatgacaggttctgggaaactctgactttaagtgaaaaaacatatgaggaaaccaatttggccacagactaattgatataaacaagagttaagctccttgggcgtatttctggtcacaaaaacattatgaaacatctaaataaagacctaaacacttgcaatattaaacactaaaataaatctgagctatacatacatttaagaaagattaataaaaacaagataattatttatccaatttctagtgagtgacaatggttgtggtagtgagttaaggaataaatgtttgcaaagaaaaaaatggtcagaagcacctcctgcccccatgcagttcaaaaacaatcaactccaaggccaggcatggtggctcatgcctataatcccagcacttaagaggccaaggcagatggatcactcaggtgacctcagggtcaggagttcaagaccagcctggccaacacggcaaaaccccgtatctaccaaaaacacaaaaaattagccgtgtg

SEQ ID NO: 563913 - DNA, 330 bp, Homo sapiens
cccaccaagcaaccacactaacccattttaattagtgtaaaagtatcgcccgggcgcggtggctcacgcctgtaatcccagcactttggaagcccaagccggccggttcacaaggtcaggagatcgagcccatcccggttaaaccggtgaaacccggtctctactaaaaatccaaaaaattagctgggcgtagtggcgggcgcctgtagtcccagctacttgggaggttgagcgcaggagaatggcttgaacccggagaggcgaagcttccagtgagccgagatcccgcctgtgcactccagcgtgggcgacagagcaagactctgtctc

SEQ ID NO: 563914 - DNA, 145 bp, Homo sapiens
tgtccatcccccttcttgttgagctggccctttattacaatgaatggatggttttaggaaattacaaaaactgttccggtcatgctatccttgctctttatctttccacataacgtttttccatcttcgtcttattatctctact

SEQ ID NO: 563915 - DNA, 1054 bp, Homo sapiens
atgtgtcctcctcccctacgcgttgtcggtgtgattcgggccctttttaataccgcttcctccttatctcggactttttcccggcattttgcctgctttttgccccaggctggtgcacgaagcgtttgccgtttctttccgggttttgtcacccccggttcccaatctgggcgttccccgggatcttggctatggtctgatacttttgacctttagtccccggttttgccatttgtgaagattctcaagctttcgttcacgtgtaagagccaatcagcactgagtaattcccggtaattccccgtcacaacatgggaagagaaggtaccgaggccaggaggattcccgcaaggccttcgcgcagctagaacgggactgaggctgcctcacgtgttgcacagaaccattttgagcccttgttaaccaagccctttttcttcacataaagtagttgattacgagggagtccaattttctttttaaaaaggagcttccatgatttgtaactgaaatatccggttctagaagaaactggcgctttaacccaatcgcactggatttctcttttcagtgacgcttcacagtgttttctcaccggatggaaattctaagtcaagctgcacaggcgggaaaccacaggcgggtggaagcccactgggaagcacaagggcgaagtggcccggtcccccctgtgccaaggtgggcaaggcacaggagccacaaggccttcgagggagggaacgggccgctccccgccacgccgccttccccacgcacgccccacggtggtgccacgccacctccaccacgaggcccgcaggggatgagtttatgcctgagttcctgcgtgtccgaaagaacttaacgtttttaaggtgattgtcaagtaactgtgtggggttttaatgccacgtttcctaattccactctcacctggagatgtttaaagttggcctctatcctaatgactccaaacttggtttttaactaccctgattgcttttgagggcccggaattataaatatatattatattttaattgtttgagattta

SEQ ID NO: 563916 - DNA, 544 bp, Homo sapiens
tgttaatagagtgtgcattcaggatgctagggcctgacctgatgagaaagtgggctagtagctcaagtagtgcatgaattactgaatattttactgtgctttcttcatgaagggtacatgctttgtactcttcacgtgaaagctgaaaacatttctggtaaccctcttaggtgccttttaatttagccaaccgtgtttatagaaaggacattactaatgacatttggcagattaaaaacattcatttgaacacagtagtcccctagaaaagacaactctacaaaaatttagcagccttattcattataattttaataaaattaacacaaaatcagtcaagaaggaaacatgtatattagtgaagtgttaaaggagactgtttgaatgagaccaaatgtggttctagttgacttcttttcacttgggcttatatcaactcttgagagttaatgtgatcatgatatagcaaacaactataaatggtctctaggccttacttagtgattatacgttatctctggctagaaaaaaaatcatggtagta

SEQ ID NO: 563917 - DNA, 267 bp, Homo sapiens
ctaaaacaaaaccaccacaactctgactcgattagttacgacaaaaccttacaaagcagacacctacataccagtctgacaatcactagatcattagtcagatgaacaacaaaggtttaaacttgccatttcaaacaactatctttccctatctgatacatggagctatgaaaatagaatcttgaaagctgtgctgcatttctcctccacttatcaatgaagaaaacgtgctctccagaaactacctgcggtagccactccaacagg

SEQ ID NO: 563918 - DNA, 784 bp, Homo sapiens
cgggtatgttctctctaattcgccattgctcccgctgttgctggtcttcctatcgatcttgagtgtgtcctcgttggttatttcctggggtgccccgcaatatgttctctcttatttgtttgtgccctctggtgcactttagtctgtggggtgtttgcctcctgtgcttgtgccatgtgtgcgggttggtcccccttcccctgtgggtccgttcatgtcatgtggcagtctgctcatataatccgggtgtctcgtgctctggcgatgtgtctttgcgatgttgttctggccaccgagggcgcggtccgccgacgcgttggtgcccgcttggtttatgtttgagtgtccctggtgtaggggaggccctggtctcccggcggtggtccccgcgtggtcgctccgtgcgccgtgctcgcgtgcaacagcaactgcgccctgtttcggcccctgccctggtgccccctcctgctggtgtctgcgtgctgcgcccatgctgggtgtctgggaacctgtgttggcacagtggatacgccatgatgtctccgtggttcttggtgatatgaccacccgctgcttgtagccttgtggttgttgtgttaatggtgagagaacaccagattgctgttgataccctgttcgtgaatgatttacgcccaaacccccagctctgccgatctgctgtgcttgctgccctcgtggcaccctgcgctgggtgccccgtccccgtcaccccgcccgttactgaaatgtataatctgacttcactgtaccaaaaataaaaata

SEQ ID NO: 563919 - DNA, 213 bp, Homo sapiens
tatggtcgttacctggaatgatagctagtttggcgtagatgttggccaactagatgacattctctacaaaccacaaagacattggaacactataactattattctgcgcatggctgttgagtcctgggcacagcatctaaacctccttattcgacgccgagctggcccagccaggcgaccttctaggttaacgaccacatctacaacgttatc

SEQ ID NO: 563920 - DNA, 221 bp, Homo sapiens
cgagtatcacaggtggtctagtgtaggagtccttcaggaggaggtctctgggtgtccctgatctggtctctgacttgagtcctctacatctggtatggtgacaagtcacgtcttcgtcagttcacatcattatctgtgcatctgcgctgcagctccagcagccagcaaggcacccacatgcgcagccaggaccagcagcccccacgacattcgcctggggg

SEQ ID NO: 563921 - DNA, 572 bp, Homo sapiens
aagccaagatggcgcataggggtctccaggctgcaatgttggctgccttatcagtatctaagcggagttgttttggaaggacgtaaacggggctgttggaaaacgccctctccgcctgtcatggcccggggcatcggaatgttcgagggctataacgtacgatgaaagatttctgcgacgcgattcgattggactccctcctaaaggggtgggccaatggtccttgggtaaggaatggggaattcggattcaatttggtaaattatccaggccgtgttccaaacatggctttgcctcaaaggtctaaacattctagtttccaacgtgggtggttgaccaaaaaccctttaccgtgtatgggagccttggttgggccactgaattagtgacttattgaacacgactctggacagaagcaattctttcccaaatttctggttttcaaaaacccaattcaagccttcaagggtgggacatcttgggatcaaaggacctccgtacattagaattcccattgccctttgattcacccttttgaaggaaggagggtcactgtgggagaattggctggc

SEQ ID NO: 563922 - DNA, 743 bp, Homo sapiens
accagtaatacatggtctctaactgatgataagggcctggatttgattgaaagtgttgcagttcctcttccgtagaatacagagtggatgaaaatgtttcaatgcacagaacaggatgaatcctttttctttatttagcgatttacactttagttactctattatatattcagttagtgtctgataagattttcttgcttaaggagaacggacattgccttggtatgtttttttttttttttccctccattttgggagcttatcaggtaaaaatctcaagccacttgattggttaacacctctgtggggaaaagccttggtgagtttgtaatgtactgggtcttggttttggttattcatccgtggtgtcctcccttcttcccgagtgtgcttgtttaacctaggagtaagtcggctttcggaggatctttatagagagaggctgtgaagtgctgaatcacctttaagtgatacagcacttctgccatctcagcatctacttaggacttacatagacttccggaatgtgtcttctccagatactaaagtacagtgggatcatttctatatctccttttctaaagcagaaacttggcgggtactcccctttgaaagccagaagttaaccattggggaatcttacttgtagacttgcgtaaagggaattgcctttatgtaagatctgcgagtacttaaaaagaaaggcctcagtgtgtgtgaacgtgcattgtcaacaccgtgtg

SEQ ID NO: 563923 - DNA, 522 bp, Homo sapiens
  misc_feature (114)..(114): n is a, c, g, or t
tgtctatgactagttgcttgttattctctacactaataaagcaacgcgccggtcggactaaaccgacgcgttcctgaatcaaactccaagatggaagttcatgaggttcattanctggaatcttatcaagcagtgagtccaagtcgagctcgtatatcaacattacgtccccgatcctgtaatttaactatttatattatcctaactactaccgaattcctactactcaacttaaactccagacaacaagacacctactactatctcgcaccatgaaacaagctaacatgactaacacccttaattccatccacacctcactctcccataggaggccatgaccaccgataagacggacttatttgcccaaatgggccattatcgaagaattcacaaaaaacaatagcctcatcatccccaccatcatagccagcatcaacctccttaagctctaattctagctacgcctaatctaatccagctcaatcacactactccccatatctaacaacgtaaaaatcc

SEQ ID NO: 563924 - DNA, 427 bp, Homo sapiens
cactcatcaaaaaaaaaaaaaaatgacaaagtgattggattcagggatttttggatttggaagggttttccaggatccaaaaaggaagggtttaaaaatttaccatcctcagcttggccagaaggatggctctattcccgtggttttctccttgtgtgtttgggtggtactctctatcgccaaactcttcccaccctcagaaaacttcacctgagttttttgtcagggttcacactggtggcaagaagtttctcctttatttgaataagagttggctgggcaaagtttgcagaaagaggagcccgtgcttgtctgcattcgtgccaggtttgcaggggaagcatactgaagtgtaggccaccccttagggaggaggaagagcacggaaaagcaaggattcagcctggagactgattccccaggagac

SEQ ID NO: 563925 - DNA, 166 bp, Homo sapiens
cacagagcaagacgccatctcaaaaaaaaaaaaaaaaactgagtttattttttggtcacacattacagggaagttctaggcagcccacagctctcatagcaacttcacagtgactttagaggctcaggatattctctttctgtcccaccttccccagtgcttcaaa

SEQ ID NO: 563926 - DNA, 526 bp, Homo sapiens
cgtaatcagtgtcgactagctgtgtctgggtcttaacatctggcctccctaatctgttcaccttccccaccctgccacaggagaaactattccttctctagttttcctttcctatcttttctattactcagggtgaccatcttgcccagagaccacgtgttgaaactcttaagtcggagtttggattaaagatgatggggcccatctggggacaaatttaagccttgccagtttgatattgggtgctaagcagagtggctaatgtctctgtttttatcacatggactttgctctggacagaacgaaaaaaaaaattttcctttatgatgcagctgggcccccatggatatggtgccacaagctggatcactagggctgctcagggaaagggaacccagaagcctggcatgccggcaaaagagtaagaatttcttaccagtcagatttcaggcttctctctctctctgtgcaaacggttgacctgaatggttgacaaaacaatcagtgttaatctcctctgtaaaat

SEQ ID NO: 563927 - DNA, 250 bp, Homo sapiens
gactctagcagatcccgagcccagatcagtagcacatgctgcctggtgcagtatgaacagatgttaccatatgctctgcactgagaacatttaacccccagtctttacatgtgccggtgattcatgagatattgacccatattacttcggtgaatataattactgctagaagcccactgacaatagttcttcatattttattcttacatataattaagcaaacattgaagaaagagactactgatcgggg

SEQ ID NO: 563928 - DNA, 1165 bp, Homo sapiens
  misc_feature (600)..(600): n is a, c, g, or t
  misc_feature (856)..(856): n is a, c, g, or t
agcgggtttcccggaacttgccagcgcggatgaaagggagtgaaaaaaagccactcctgccggtccgggtgccggcatctggtagacctgccgtctgtccgctcggcgcgaacactggctggcctggtcttgggatgtctctccccgacgctgcgcaccagactgtcctgccgtgcccagcctggaggactcagaggcgtgtcgtgtgtacggcccgagcgcgtctgcgggagtacgctagtggtctgcacgcgcatggcgctgttgtccgcggccgtccgtctgactggtagtgtggccccggtggcggcggcgtggagcaagcatgtaacagccgaatggagcgggcacatggagtttctgggcctgtgagcacctaccgatcaagattcaaggcacccgccgatgatagattagggcagcagtaactgtttgaatgagtgtaacattgcttgtcctcaatactggtgcccatgagaagttcaagcccaatgacctttgcctgtgcttgatgaatcgcagaaggtgccaggagagaaacaatcaacggacttgaggggtgatgtccccctttgtgagattcccatgacaatcttcacntgagagtggctggtcgtatccttctttgagtgacaccgtgaatacttgtcgtctgtggcgcccttgacacgaacagtaagcagagccttgtcgaaggcacctcctgcgacgaaggttcccgaaaaggctgctttcccattgtgggatacctcattttgctaggctttgacacaggtcaccgacgcccccccagagtcgcactctgactctaattggggcgcaggtcattgggccctcacaatgcggtttgagaacnccttgaattgttgtcccagacattggggctgtcgccattatgtggcggagagggcattgtggcggttgtcctctcccctaagacccccttttccacgtggatcatcctggcagccctctcccctcgagattgtgggggcgcccccccgctgggggccccagacctcattgcgtttgtaattggcccgaaagttttcagcgaccttaccctggagagagggccattctcccgtttggtcattcccccagggtctctcccattctcctcgcaccttggggcaggcccccttaggaaacgcccggttcctcg

SEQ ID NO: 563929 - DNA, 275 bp, Homo sapiens
gcaacctgtgcctcctggggtcaagcgattcccctgcctcactcagcctaccaagtagttgggattataggtgtgtgccaacatgcccagctaatttttataattttgctagagacagggtttcaccatcttggctgggatagtctcgaacccctgacctcaggtgattcgcctgcctcagcctcccaaagtgttgcaattgcaggcgtgcgacttgtgcctggcctattgattcttcttcactgaaacttacctatgagtcattattatttata

SEQ ID NO: 563930 - DNA, 168 bp, Homo sapiens
tgctgccagtggctccggaagttcctggtcacaacgtctaggagctgtgaaatgctgctgatttgcaacaaatcttacggtgccgactaatagcgaggtggcgataaataggcgaggtggcgatgaatagcgaggtgccgataaatagcgagggtgccgatgagagcg

SEQ ID NO: 563931 - DNA, 223 bp, Homo sapiens
gtgaatggcgcccaggtgtctgacgattacaggcatgtgccaccagacccagctaatttttgtattttcagtagagacgggatttcaccatgttgatcatgctggtctcaaactcctgacctcaggtgatcgacccgccttggcctcccaaagtgctggaattgcaggtgggagccaccatgcccggccactagtgaacttttaagaatctctgtttttgagg

SEQ ID NO: 563932 - DNA, 181 bp, Homo sapiens
  misc_feature (105)..(105): n is a, c, g, or t
gtgcgagcgagatcagcagaaaccaatgatatgcggcaagtcgtgtaggtgtgtagacgttcgtcaccgcgtgtcgtgtgagcaaataccgggttgattagctgntcaaggtgcaaagcacagtcgacatggtttgatctactcgccattttactacagacagtcggtacagcagtctata

SEQ ID NO: 563933 - DNA, 366 bp, Homo sapiens
tggtgtgtctggtacatacagcatcctaactaatacgaggctaaagcggtcagtagtagtatgcgtacggcacgatatctatcttaggagctagggaaagggagtggataaccaggtgactctaaaactttcttttaaaaaatgtgctgttaagttttgtatcagctaaaacttaaagtggtacagaaaccttttggtatgctagtgcagccagcctttgttagggcatgagcttattaactatttgtttctgggaaatgtcataagaattgatgacgatttggaaagaaggaacaaattcaagttctctacagaaattaattgctgttaaaaatgtgtcacatgctgggcataatagctcacacc

SEQ ID NO: 563934 - DNA, 87 bp, Homo sapiens
tcttagaaacaagtaagaatcacaatttgtggttgattataacattcatacataaaaaccaactactttattatacaggcagtgaga

SEQ ID NO: 563935 - DNA, 88 bp, Homo sapiens
ggatttgctggtgcagtacaactaggcttaatagggacatgccgttgtactccaacctgggcgacagaactagactgcatctccaaaa

SEQ ID NO: 563936 - DNA, 243 bp, Homo sapiens
gagacaggtgccctcttcccatttcacagctggtaacacggaggccctggctagtaagtgggcctggaaccgagcctccctcttgtcattatgtcctgctctttccagtgtctttccccagcaccctctcctccctgcagcatcatctctgctcacccttgcacccacaccgtgtgctgactggcccaaccttcccttctttggcttcagcaagggagagctgggtaggtatgatgaaggacg

SEQ ID NO: 563937 - DNA, 141 bp, Homo sapiens
ctctagagtatccaccctcaaacgcgccctggcacactgaacaggtagcgtggcacgagcccagactgcgcccaacctgggcagagcggccctcacgcaggcgcagcgtttccaacgccagggcccgggcaggacggcctg

SEQ ID NO: 563938 - DNA, 85 bp, Homo sapiens
ccttccaataacaacatgtcctggctctatgaaaaaactgatctgtgaagctgcagattgaggactgattgctttgagaatactg

SEQ ID NO: 563939 - DNA, 969 bp, Homo sapiens
ctgggggacagctgcagtagtgggcagcagcaatagcacatgacatgctgggatctgcctgggggagcccagctctgagccccagcacatggcccacctggtgagcaacaggtggggagcaacatgcatgggtgccatggatgacatgtggcatttgacttagttcaaaactctgagtggcctggtgctggggacacacagtggtggctcggccttgggccaccacatgtcccccggagcctgagtgtgcctggggaagaagacccagctgctgtggcattccagggttacctgagtgcagaccagatgtgctgaacgagaaggcaaccaagacatggctgcctggcaggaagaatctgcccttgaccagatggccttggccccaaattcgggaggatgcctggttgcatgaggcaggcttgcatccaccagccctggccaagggctactttgaaacacggatcctctagcaaatgactctggacttcctcatggggccccaacgggacagcggaaccatgcccactgaggaatggtcactcctgtccttgagcatcctgcacgtgacctgggaatatctagactggagctttgcccatgaccttgcccctctaggctgtgtggcagccccaggtggtctcatggtgcagctttaactcagacctggtcacccctgccccctcactctcttatccctgccgctcacatgctgatttgacttcgtggcttgccgacgctgcttttgactttaacggcattatcctatgcttccctttcttgccctgtgaactctatgcgaattgatctggtgcccccttgtcgtctcttgtaccagtttatgatctcgtatgtggctcttttgtgcgccactcttttctcttgtcaatgcttacactcctgtttgttccttgtccccccagtccaattggcccttttcgcacgtgtcttgtctccattggtctctctctt

SEQ ID NO: 563940 - DNA, 339 bp, Homo sapiens
tgctccccccctcccagtggtactgcttatatatcattgcttatatacctacattgccatttacatgggataaaggttgtttacccttaaagatattgtgtgtgtgtctttccttctcctttcaccccgcagcacataacaatcttacaaaaacaaaagcctgaggccagttgtcctggctcacacctgtaatcctagcactttgggaggccgaggcgggcggatcagctgaggtcaagcgatcgagaccatcctggccaacacggtgaaaccctgtctctactaaaaatacaaaattagctggacatggtagtgcacacctgtggtcccagctacttg

SEQ ID NO: 563941 - DNA, 399 bp, Homo sapiens
  misc_feature (77)..(77): n is a, c, g, or t
gaattccgtcagttggtaacacacttagttaataaaataagccaggctttgcaactaagtatctaactttaccaggnccccactcacatttgaggcaaggggctattgagtatgtggagagatgtagtgatttaaaattcagattatttaagttggatcagctgaaagtgtgttttagaccccaaaaccaatctgacccccttcgtttttgcctcagaggaagtaaaatgttcaccttaaaatgaaaattgaaaaacgccaatgtggcacccacaaaaagagctctctgtactttccccaatgctgcctcaaaaagttctgtgagtttcgggggtcagtgtcccacccttcactgttatactcgtgatgatactgaaacatatcataggatacaacacg

SEQ ID NO: 563942 - DNA, 587 bp, Homo sapiens
cgcttatctgaataaaaaaacaaagcactgggagagttccataaaaacccacatgggttaccagaggcgggaatagaaggactggggagatattagtcaaaggatataaaatttcagttagatagaaggaataaattcaagggatctacggtccaacagggtgactacaattaataacaatgtatcatatatttaaaaatggcagagagcagataatatgtgtactcactacaaagaatgatgtgtatatcaaatagctggatttagcccttccacaaggtatacatatcaaacaaatcatcatgtggtataccatagatttatacaatttggctggttcattcaaacatgaagaaacaaaaaacacaaactcctgagtcctcacggtgatatacttaatcagaatttccaaggtagacatctagtgatctgggtatttaacaaacacatctaggtgcttcatatcatggcgaacactggacccccagttctgaaacaattaattcctggagcatgacccagtatcattgggggctcagtttccttccgcatcaatgtaggtctggatatatcccttatggactcgt

SEQ ID NO: 563943 - DNA, 343 bp, Homo sapiens
  misc_feature (16)..(16): n is a, c, g, or t
  misc_feature (31)..(31): n is a, c, g, or t
  misc_feature (223)..(223): n is a, c, g, or t
  misc_feature (274)..(274): n is a, c, g, or t
  misc_feature (300)..(300): n is a, c, g, or t
  misc_feature (335)..(336): n is a, c, g, or t
  misc_feature (338)..(338): n is a, c, g, or t
gagagtctcaggcccnatttgacagcgagtncgttccttctgagcgaaattcagatctcttattaatttctctccgtcgcttctaaatttcgaagcgacgagctaactgggaaagggaacaagtactaaagaggtctggaggacctctgcccctatctgaggaaggtatgtttattactgggtttcatgacgctatttgcgattttcctccgtattgtttgtnggttttgtgttccataggtatgtgttatcttatggtattacgtggtattcnctttttgtgatatatcctttgttctnggcgatgggataattttgtttctgtcgcacgaaannanggaaa

SEQ ID NO: 563944 - DNA, 606 bp, Homo sapiens
tagcctacaggaattcaggacaggtacatggaaagccatttttccccccaaaataaagaaccggctcatgctcccgagtggtaaatcgtaaatttccagaccccaacaaagggcaagcttgggctggccaaccatttttccattcaaagattccctggccaagggctcctggtgccgaaatcggcaccagaaaaaacaactctccctttgttaggtcgttataccaacgccaaggcaatcaaaaaagcaacttaaacatgataaggatgtttctcatcctttgtagacagtacagcaaggcttcctattacgagacctgtttgccgacggagggtaacacacttgttagtgcaaagcaaactgctttaggcttataacttgacttttgaaagcatctccggtcaccttgataataagataaagcatatcaagatccaaagattcatcatctgagtctttgttcagtgggtgtaaagccagctgcgtgtctaagaaccataagtttctgtcatctgagtacctcgtttctctgcgcatcatgcagtaaaaaatggagaccctctacagtccctcaaaaataacaactcgggactagttctcttgggc

SEQ ID NO: 563945 - DNA, 434 bp, Homo sapiens
accctactatgctgcctggacactactgagaatagtcatagtccttactctaactagaaaatagcagcaacatttactgccggttagaatggcttcttcctctgaaagggaaatctgccactgagtcaccacgcctggctgccactgtcctatctatttaacgaatgattccttcatattcgtttcttacactcgacccttatacattccctccattaataagtctccttcgtgtagcccatcatatcacctcaaatccggcacttacttacagtgtctaattctttaaattattctgaaagagagtgcttgcttccctctcacctacacacgactccctggagctggttcgtatcatgcattaacaattcaaattacgtctttacacttacttggctgttgctctactttgggataacacgttcgcgaggggt

SEQ ID NO: 563946 - DNA, 840 bp, Homo sapiens
aaataccttgtgcaaggagaaccaaagctaagaccccgaaaccagagagctacctaagaacagctaaaagagcacacgccgtctatgtagcaaaatagtgggaagatctatcggtagaggcgacaaacctaccgagcctgggtgatagctggtgtgtccaagatagaatcttagtgcaacttctaaattggcccaggagaaccctctaaatcccctgtgtaaattttacccgggttagtccacaagaggaaccagctcttgggacactcggaaaaaaacttgtagagagcgtacaaaaatttaacacccatagtaggcctaaaggcagccaccaattaagaaagcgtcaagctcaaacccagttacctaaaaaaatcccaaacatataagtgaatcctcacacccaattgggaccaatctatcaccctatagacagaactaatgtaagtataagtacccctgaaaacattctcctccgataagcctggtcagcttaaaacccactgacactgacccattaccagccaaatatctaaattcaaccaacaagtcattattaccctcaatgtcaaccaacacagggatgtccatcaggaacggtcacacacaagtaacaaggactcggcaacatcttaccccgcctgtttccaacaaaattaacttagcatcaccagtattagaggcacggctgcccagggcccactgtttacgggcggggaacttaacgtgaaaggagctatcatgtccttactaggcctggttaggtccagaggtcacggtgccttcattaccggaatgcggcggacggggcttcacgaaagacacctagggtcattaacg

SEQ ID NO: 563947 - DNA, 377 bp, Homo sapiens
gtcgaagaacaacggcagatatcagtaatgaggatgtccagtccgtgggccacttatgagaatgactgcgccggttaagcttcagggggtttggatgagaatggctgttactactagggctatgtggctgattgaagagtttgcaatgagcgattttaggtctgtttgtcgtaggcagatcgagcttgttataattatgcctcatagggatagtacaaggaaggggatggctatgtgttttgtcagggggttgataatgagtgtgaggcgtattataccatatccgccttaattttaagagtactgcggtaagttctattgacccacgatgggggccttcgacatgggctttagggagtcattagtggatgtcgtca

SEQ ID NO: 563948 - DNA, 355 bp, Homo sapiens
acgaacacagaagaataggattgtccagtgtttattaccaataggcagtttagagtgtgagtgccctaagtagaacactgggtgctgggggagtacctaggatgacgagaagccccagaccccaatatggaaggggagggcaggatgaattctggtgatgcgagctggataggggtaccctagctccctgtgtggagggctgggggaatcctggagaggagagctggagagggggcaccctagcttcgtgtgtggggggctgggggaatcctggagaggagcaccctagcttcatgcatgaaccagcagcacaagtcccaggctcactacgagctcttattgcccaggccggagt

SEQ ID NO: 563949 - DNA, 534 bp, Homo sapiens
  misc_feature (10)..(10): n is a, c, g, or t
  misc_feature (37)..(37): n is a, c, g, or t
ccaaaccagngccccgtcccctgtttcccctttgagncacatggattcactagctgatagagaggtgcctgttttaagcactcagtgacatttgatgagtccctagttactttttgaagccggggagggttcagacatggtctgcaaattgctgagaagtcctggatcatttttaaaacgtagaaaatgagatcctgctgcatatattaggttgtcttagatcaacctggctgagctatagtgacactgctgttcatgaagacttatacgtccttctatcggatgattgtcttgttgtgccaaaagtgttattacactgtgtgtgaaaccaacctgcttcagggggaaaaattaaatcgcctgattgagaggtcactggtgaatagtaacacaagatctattaccgttattagagactctggaggacattcacccttttatggtctttcaactgctggaatgaaatattttagcggtaaatgacaccttccgggaaatccttctgaagattcattctttgctgcttgcatgtag

SEQ ID NO: 563950 - DNA, 893 bp, Homo sapiens
  misc_feature (154)..(154): n is a, c, g, or t
cagcacatacaagaaacatacagtgtacctcaaaaggggcccttgaaatgtcatcaaagggtaataacctagtgagtgagttgtgatgtcatctggaacataggaaatggggctcttagcgtattcggtacgaaggaagccaggctggtcctgncaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaaaaaataaataaataaaacgtctgggtatagacttttgagccttgagcagggcctcctacctggcagtggggaactgcagtcttcctcctggcaataaacctaaagcaataatgatggccccttctctgtaagacttcccaggtaactgtaaataaacctcagcttgatcctcacagtgtctaaagttgcaggggcttgggaggttagggtcacagtctcacttgtctggccctctcgccccctaacattagaaatctgctagcattagctttctctccattgctcattcaccttggtgacccaggcatcgggctcctagtcactgttctcatcaaggaccaagacaccagataccccaggccccagttttcttccttcagctaccacattccttagaacccagaaatctggcttcataattttgttcctcctctttctatgaaagacttagctatctgcctttatttgtttgtatttaaagtaatattagcctta

SEQ ID NO: 563951 - DNA, 116 bp, Homo sapiens
ggttcgtgctcactccgggtggctctggctcggcactggagctggtgatctcctcaggtcggcggcagattttttccccactcctgatgatgttgttgtaggattccgtactcccc

SEQ ID NO: 563952 - DNA, 150 bp, Homo sapiens
atatagcaaacttaacccctcataccttctgcataaagaatgaaactaggaagatcaaccaggtcaagaggagcacacacacacacacgacacatcaacgcacacacacacacacacacacacacacgagacgagggcgtaaaccctaag

SEQ ID NO: 563953 - DNA, 509 bp, Homo sapiens
ctgcagcttgattgttctggcttccctttcacaagcttataagtcggacgtgtccatgacaagctgaagactgatgcaataacttacgaatgccttcactgtgacatcgacaacgccataggtatgttaggatgtaagattgcaacagtgcgtgtgttccattgacgacgccatgccccaaccagacctccacaggggtggaggttaacacaagttgactgatctcttgtacgttgttctcccgtaagaaacggtactgcgaccaggtggccagtgacgatacgagtacatgatcgagccctccttcattaaaccgtgcgacgtaaagagcaaccgatatgacaggcatagattgaccatttatgcgacatcttatccgagatacccttccatgacaagacgaaaggcggtacaccgaacacgaaacgaaccatctaatgattcaccgttcttgttaccgcagggtccgaggtgtccagcctgtatcctttgtgatttttaaccgtttc

SEQ ID NO: 563954 - DNA, 439 bp, Homo sapiens
tacttttccacaggatgctgcaagacgatgaagcatgttggaagacgagcagatgctggaagccctgtgagatgcttggaagacctggagatataggcagacatggattcgttgcaacgacgtagcttagttggaagacatatgttttctggaacacgtggatttgctggaatacatggcttggttgaacagacctcgatttcctgaacatacgtacctctgttggcctacatacctttgttggaagacgtacctttgttggaagacgtacctttgttggaagacacaagtaggctggaagacattaatttgatggaagacatggctttgttggaagacgtggatttgctggaagacacggatttcctggaagacctggatttttcggaagctatggatttgagggaagacaaggattttctggaagacatggatagtc

SEQ ID NO: 563955 - DNA, 189 bp, Homo sapiens
tttttttttaaaaggggggggggggggggtccccccccccccctaaaaaacggggggggcccccccaaaaatgggggggggggtcccttggggggggggcccccccccccgggttttccccccggggggtttggggggtcccccccttcccccccccgggggttcccctttttttttttttttttggga

SEQ ID NO: 563956 - DNA, 692 bp, Homo sapiens
  misc_feature (58)..(58): n is a, c, g, or t
  misc_feature (88)..(88): n is a, c, g, or t
  misc_feature (270)..(270): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (311)..(311): n is a, c, g, or t
  misc_feature (317)..(317): n is a, c, g, or t
  misc_feature (319)..(319): n is a, c, g, or t
  misc_feature (337)..(337): n is a, c, g, or t
  misc_feature (369)..(369): n is a, c, g, or t
  misc_feature (499)..(499): n is a, c, g, or t
  misc_feature (672)..(672): n is a, c, g, or t
actcacagaacatgcatggacatttttacaggctttcaggagattctttgtgtagcanggttgagctacactacatctgagcctaggnccctgggaagaactcagagaaggcagcagtagaggctgggaaggagattgttatgaggtaggaggaatagcaagtaacgggggtgtttcaagaaccagagctgagtgctgctgagaagtcaaagtccttgttgcttttgttttggagaataaggttggtgactctaataaaagccacataangccctcccnccncccccngccantnaanccccgggcgactngcggtnanacagtggaaatgaaagtnatcaacaactcttttgaacagtttttgctgtnaagaggaacagagaaacagaggtggccgaagaggaatgtgaggtcaagggaaggtttaaaatgtgaaattacagagcatgtttgcctgtggctggaaaacctgctggtaggatgaatgggcgcaggacanagtggggacagctcaattttccaagctctgaggtgaaaggagccgggatcagagcacagctggggacagacactgtttctactgtaggggtaggaagaagacagatggatgccagtacacttgcagatacggtgggagagcctgacctgtttccccaatatgcctgtgaagangacattgggtggggatagat

SEQ ID NO: 563957 - DNA, 116 bp, Homo sapiens
ttcttaacacagttcagtcttctgctcgccctttcctcactgatgtctgcactcggttgagtactcctggagcctcacaggtctgactgttctccactcttcactgcattcaggcc

SEQ ID NO: 563958 - DNA, 207 bp, Homo sapiens
cgactcgataggaggactgatgtcaggaaataacttgacactgggtcaaggcatccatacggtaaataatcattttactcttcattagtagtaattggaggggagatacttggagactatgtcaatctctggtccctcatcaaacattaatccattgctttaaaaatccatggaggggtctggctttaatcagtttattactatgag

SEQ ID NO: 563959 - DNA, 137 bp, Homo sapiens
  misc_feature (1)..(1): n is a, c, g, or t
ngtcctacagtacaaaatgactggttgtttaaatagaaggctgtttaggacaagtcagacaagtacaagcatgtgtagatggtctatggaagttatgaaaggattaatgacaagaaatttatgcaccacaagtgaaa

SEQ ID NO: 563960 - DNA, 954 bp, Homo sapiens
  misc_feature (11)..(14): n is a, c, g, or t
  misc_feature (17)..(17): n is a, c, g, or t
  misc_feature (430)..(430): n is a, c, g, or t
tgacgaggaannnnacnaacttaggctaggtacggaggctggtggttgaactcgtggcctagctgacgataggcctgagaaactccacgtggagctcacggaaactgtctggacatgatggctcgatacgtgttctccaacttcacggctgtcccgaagaggtctcctgtgggcgagttcctcctagcgggtggcaggaccaaaacctggctggttgggaacaagcttgtcagtgtgacgagcagcgtgggaaccgggacgccggtcgttgactaggcctggagcctcgggggagtctgtcggtccggcgccggagtgcgagtctccagccccggggtgcaatgtgtagacagaccatgggaggctgccgggctaggctggtagtcccagcgctgggccagccaggtgtcccgtggtggcccgggatcgnggtccgttccgatgtcgtggggggcgccatgggctcttcgaggtttggcgccctggagcgtgcctgggctcctcccagttcgctgtggcatgtgctagcttctccaggaccactggactgcaccagtgcgcgaaatctgagaaggcctcagctgggacccgggttcctgtgcaggagaagacgaatctggtgggctatgtgcccctgctgacccggggctgggcggggatcctggtccgggagggccctgggaacgccatggtgtgtgatgagccttggatgaaaccgctcagccctttgtcctcggacatctaacaaattggccctgcaggagcctgcttaagcctcatgggggctgagcgcttcaagggggcggggaacaggctgttcagtcactgtcgtgcgggagcagggggcaaggcctcctcttggtcggtccaaagatcggcgggctggggggacggggggagccttttgttgggggcccccggttggggggtttggggctttagggccggggtaca

SEQ ID NO: 563961 - DNA, 141 bp, Homo sapiens
ggttttttccccccccccccccccgggggggttagggggggggggtcccgggggggggggttttccccccccccccgggggtcggggccttttcccggggctcttttaccccccctttaatttttttttgggttttcggga

SEQ ID NO: 563962 - DNA, 161 bp, Homo sapiens
ttgttccttttttaaaaacccaaaagccctgaatcaaaaaaattgagtttttactttttgttttttttaatgggtcagtattttacattgctaaatgtacaaactttatacaaaagcccacccttatcatttttaaataaaaacagggaaatggtttacca

SEQ ID NO: 563963 - DNA, 178 bp, Homo sapiens
cgggagtgcgcccagagcatgccccggccgtcagggaggactcccgggctcactcgaaggaggtgccaccattccacctttggcagccttccttcttcatttaaattttctaaagcccattaactgtctttgatgtttcttttgtgatgacaataaaatatcctttttaagtcttgta

SEQ ID NO: 563964 - DNA, 114 bp, Homo sapiens
gtgggaggacacaaatgtttgagactggagtgagctgtgatcaagccattgcactccagcctgggtgacgagtaagaccctgtctttctcgctcccctaccccaaaaaaaaaaa

SEQ ID NO: 563965 - DNA, 1493 bp, Homo sapiens
  misc_feature (1)..(1): n is a, c, g, or t
ngcttgattatttttataggggggggggggggctctcccaataaatagagatacttctttttgtgtgagaggatagaggaggggggaaccacctctatcctggggggagttgtagatgggttgagatatattagtgaagcagagattgtctcgggggggggggtaatgttgacccacaacctcgtggagggaaggttttgtatctcccaaaaggggagtgtgcatttgtatataaagagagaggctcttttgaaggggaagaatgatgaacatagggattggtcccacatggagaacccaagtgccccccccactatttggtcccgcagggggaagtaggaaccattcgtttgaagtacgccaacacccacaattaatgtgtgggggcgctttcattaaggaaaaaattgtcgtgttagttggctcgccccacgcgtgtgaatggttgttggctggtgtgtaagacctcttaaggagggcggcgcccttttgtgtttcgtcagaagggatgtcgcagcaagaagtgtgtgtggtgtgtccagacccccagcgaaggtgcccctgcgcttgcgccccccgtcttcaggtgaattgtcttgttctcgaggggcaccaccacgaggggccgtcccacacctcgggtgttgcgtcccgcgccggacacacgctctgggggccgtttgtccccacagggtgttcacatttagaaatgtgtcacaaagttggggcccccgcgcgcctcttatggtggcccccacgcgtgtgtgcacactgtggccctcttttgacacgcgctctctctcagagtgagagatttgtgtgtgttataagttgtcgtctatgaccccctccgtgataatatttttggactcttttaaaatttttagaataaccaccctctctctctatataacgactctataccccacatctatatacaatagagagattgtatttggtgtttatatatccacacacttgtgtctctccacacaaatatattctctctctgtgtgtaattgccacagggagagtaccacgtgttctcttgtgcacagtcacaacacactataagtgtccacgtgagaggtgtggcgtcttccgctcataactcgcacaaagcgcacattctccacatcttatagttgagagtatagctctcttcggaaagcaccgctcttgagagttatagagaagtataagtgtggttaacacccctccaccacattatagtggtggctgttgtggggcacagttcacaacaccacacaatgtaaccacacatgtatattttttgtgggaaatatgagagttggcactgtcacaaatgcactccttctatgaaaaaataaattagtgttatagttcttaagaatttgtttttctataagttgaataactgtgggttaatttttgtgaacacacgcctgaatgtttgggacccttttttcctccaaataaaccagtccttattataacccggaatttggaga

SEQ ID NO: 563966 - DNA, 929 bp, Homo sapiens
ggcctctttttccggctggaaccatggcatgggtgtagaagagaagaagaaggaggtttcctgctgtgccaaggaaatcccttaatgaaaaagctgaaggaatttcgcagagctgaatggatcaagctcctgagaacgacgttttgcccacaagatgcttcgcaaaggcaaggagtgaatgcttatctatgaaaaagcgaagcactatcacaaggaatatatggcatgatgtacagaactgaagattcgaatggcgcaggatgcgcacgaacaagctggcgacttctatgtacctgtagaacccaaattggcgttcgtcatcacgaactcaggatgggtatcattggagtgagcccaaaggttcgaaaggtgttgcagcttcttcgcgttcgtcaaatcttcaatggaccctttgtgacaggctctaaccaagggttacgattaactatgctgagggattgtggcagccatatatgcatgggggtatcccaaatctgaatgtcagtgaagatgagactatatctacaagcgtggttatggggaaaatcaataagaaggcgaacttgctttgacagataaacgctttggattgctcgatctcgttggttaatacgggcatcatctgcctggaggactcgattcatgagatctatactgtggtaaacgctcccagagcatctaccttctgcgggccctcaatgtcttccaccgagggaatgagaagcgacacattgttacgtgcgctctggcactggagactgatcacagtttggagaccgttcctcacgcctttatacctgcggtaaacggcagtctaatcgaaaaacaaaacaccggggccgaaataaccggggcgcgaataaacttgcagtaatgtcaccacggctgaacaggatgcgtgaacaccagaaaagaagccacaagaagag

SEQ ID NO: 563967 - DNA, 733 bp, Homo sapiens
  misc_feature (7)..(7): n is a, c, g, or t
  misc_feature (65)..(65): n is a, c, g, or t
  misc_feature (81)..(81): n is a, c, g, or t
  misc_feature (115)..(116): n is a, c, g, or t
  misc_feature (141)..(141): n is a, c, g, or t
  misc_feature (143)..(143): n is a, c, g, or t
  misc_feature (157)..(157): n is a, c, g, or t
  misc_feature (176)..(176): n is a, c, g, or t
  misc_feature (244)..(244): n is a, c, g, or t
  misc_feature (247)..(247): n is a, c, g, or t
  misc_feature (258)..(258): n is a, c, g, or t
  misc_feature (271)..(271): n is a, c, g, or t
  misc_feature (390)..(390): n is a, c, g, or t
  misc_feature (400)..(400): n is a, c, g, or t
  misc_feature (407)..(407): n is a, c, g, or t
  misc_feature (416)..(418): n is a, c, g, or t
  misc_feature (430)..(430): n is a, c, g, or t
  misc_feature (432)..(432): n is a, c, g, or t
  misc_feature (434)..(434): n is a, c, g, or t
  misc_feature (525)..(525): n is a, c, g, or t
  misc_feature (528)..(528): n is a, c, g, or t
  misc_feature (536)..(537): n is a, c, g, or t
  misc_feature (540)..(540): n is a, c, g, or t
  misc_feature (591)..(591): n is a, c, g, or t
  misc_feature (634)..(634): n is a, c, g, or t
  misc_feature (703)..(703): n is a, c, g, or t
cctcaancccagctgcaaccagtctggggccatacaaccagggacagagcccacagagcccatanacctgtctcccaccancggggccctcctggcagggatagggaaggaggannccgggcacccccctcagggcctgantnacgtactgtagttngcactggacgcccgaggcnctcacctgtacccaaagcccccttgaggggaactgtggctgctgaggggccaataaagctgatgtaanttnatcgatgggtntggctgggcgcangttctgaggggatgtggggtctgggaggtgtctcgaggtgagagctccaagtcacaggaagtttaagtcagacctcagtttccacatccataaaatgggacgacttccttacccacagntacacgtgtnttttaantttttaaannncccattaccaanananagggtcttgctttgttgcccaggctggagtgcagtgttgcaatcatatatatctgtagcctcaaactcatgggcttaagtgatcttccttnccnagcctccnnaanagctgggaatacaggcatgtgtcaccacattttgtagagatggagtctcgntaagttgcccacgctggtctccaattcctgggctcaagtgatnctttcacctcggcctcccaaagtgctgggattacaggcgtgcctggccacagatgagaggatctctgcngcagatagtacttgtgggtgcgagacctgt

SEQ ID NO: 563968 - DNA, 452 bp, Homo sapiens
  misc_feature (385)..(385): n is a, c, g, or t
  misc_feature (417)..(417): n is a, c, g, or t
aagacagtaagcatccctgctccatctctggccaggcaggaactgaccccaggcagtaaagttgcctcccccatggcccagcccctaccgtggccacaaagctctcagagggccatgggctcctgcccacacctgtgacatcgagcccccagcctggtccttgactcccagccccactcagggtgttgcctgcattagagcaactgggcccccaactcccagccagagccagccgaccccacctccgtggaccgtggcactgtgggggccacacacagagcacagcactcacacggacagggctgagactggacaggcctcactgctgggctgacatttctcagtagctgggattacaggcgcacatcagctctcattttttaanataagtgttataccaaatattgcgtcatacanagacctaggtacattcactaaggtggaccccagat

SEQ ID NO: 563969 - DNA, 890 bp, Homo sapiens
cccgggtgatgccgctgcttttgaggaggtgtgccgcgtgtcgtcgtgatccacacgggggcgttcaaggaggtttcgaagtggcgacgagccccccctgggggtaaggtcgttaccacaaccacatgggcggggcgcgttcctcttctgggcgcggtataccgcggacccccctggagttttctttgtgccattcacgccggtactcttcattcagcgtgaatgggcgacaccagcgctgttatcctgtggcaccgagagccctccgttggtacccccccgcttaagccctccgtggcggccggcagatttcacggccccgctcttcgggggggccctcctagttctgataaaggccggtccttccacgagcgcgacgtcttgcctcttctctccccccctgcctggctactatgggccagcttcccccgtactgaacctagtctcgggtccgcccgctgctttcacgcatgcggtgcggtagtcttgcgtcgctgcgcctcaccacgtgtccgcccggagccgctgttattccgcctcgatgggcgtgtggggacaccccgccccgcataagactgcgtgttccgccgtgtggggcccggcggacatttatacaaaaacccatcgtgttttggcggggggctcccccaactcccctgcaccctacgagccgtccccctgtaatacgggccattgtggcgtatcacccaccacctgtctcgttactgtttccggtgcgccaatattcctgttcctaaagagagcgcgcccctcctcacactcgattgttatgaaacttgtcatgctcgacgtatgttgagccacccatgcatgctgtcggtctaccgtcacgatgctccaaacaaatccgtttcccgccaacaaggtca

SEQ ID NO: 563970 - DNA, 205 bp, Homo sapiens
tcagacgctgaactatgttgggggtcacacattaggaaagcatgaggggaagagagggaaaaagggaacgaaagaaaagaagcaggatttgggcacaggaataacggcctcacagctgcaccattatgaccaaaatcaatggttgcctacgtacttacctgtcttcctaaatacatcattgcagggcacatagttcagcgtctga

SEQ ID NO: 563971 - DNA, 711 bp, Homo sapiens
ggcattcatggataccaaagggaaaatggtagagacggtgttcaccgtgttatccaggatgtcttgatctcctggcctcgagatctgcctgccctcggctcccaaagtgctgggattacaggcgtgagcccacgcgaccgtggccagggcaccacgtgttctcaccgttgacaggttggctgtgggacgctagtacccatgggctttgctgacttagccaaagaacgagttacgaagaaaatacacacaagttatacagagtgtccctagtttcctaagactttatctggcatattgtgcgataaaattagctgtgcaatgtgtggcttcttcattaaggatgctttcaatgtggtcttcacagatgtgtcagggatctgtcaaccagaagcaagggagcacaaacacaggccagttccttggaaatcacattcttaggcaaaaccttacactctctttgaaacaataaggaaaccaattttgcaggaattgtggagagtggatccttttcctaaaatgtggtaagaaacgcattagagattgttgtgcgtatttataggaagtggggatcaccgaggaaacaagagcacgggacaacgtgattttttttcccacaagattctggtagatgttatttcccattttaataaagcggactttaacaattgacacaaccttttattctggatatcaaaaggcaaataaaaaacc

SEQ ID NO: 563972 - DNA, 248 bp, Homo sapiens
tctctaggatcttggtcgctcggacacccgcatcaggctcggcaggaagttgctggctgatgagcacctcccggagcggtggggcggggcctcctcttctccagttccagcgacgctcatcagtcgtcctcctgctgatttctcttcagcttaaggaagtctattagcttgtgagcgtcctccccagataggagaggtcatacgaacggtccttgggatagccggataactcacaatagggagctggg

SEQ ID NO: 563973 - DNA, 344 bp, Homo sapiens
tagcaggcataagaggacttccgcctacaatggaagcacttccatctgatctcagcattgctgaaggcaccgttctaacagtagacctgtgcttacacgggtgagcctaccccagaagtaacatggtcctgtggtggaagaaaaatccacagtcaagaacaggggcggtaccacattgaaaacacagcatgacctgccaaccctgatcatcatggacgtacagcaacacgcagcatggtggactttatacccatgagtccaggcaatgaatatggatctgactctgccacatgtgaatatacatattcagatccatttaagagggcctgtgcccttatacatcg

SEQ ID NO: 563974 - DNA, 323 bp, Homo sapiens
  misc_feature (244)..(244): n is a, c, g, or t
  misc_feature (300)..(301): n is a, c, g, or t
ctttaaaaagaaaaccttttaaaaatgaaaagtaggtccaggcatggtggctcgtgcctgtaatcccagcactttgggaggctgaggtgggtggatcgcctgaggttgggagttcgagactagcctggccaacatggtgaaaccccgtctctactaaaaatacaaaaaattagccgggcgtggtggcgcatgcctgtaatcctagctacttgggaggctgaggcaggagaattgcttgaacctnggaggcggaggttgcggtgagccaagattgcgccactgcactccagcctgggcaannagagtgatactccacctggagg

SEQ ID NO: 563975 - DNA, 320 bp, Homo sapiens
ggcagtgaatcgaggtcgagagccctgactatcatcagggaggtgaggcttcgtacaaagtgttagacaggttaggaattgatgggcctgcgatagcaaaatgctctatgagaaaaatggtctcaccctccatcatgcataaaaacagattgtctcagtttacctagctttgaaaatgccatacccttgggagagaagaaggatgtgtataaggcgggtgagcaagtgacttacacttgtgcaacatattacaaaatggatggagccagtaatgtaacatgcattaatagcagatggacaggaaggccaacatgcagaga

SEQ ID NO: 563976 - DNA, 143 bp, Homo sapiens
  misc_feature (2)..(2): n is a, c, g, or t
angccatccccaacacatggaaaaagtacccaggctgacgaatttcttctcattattaaaacataaagatctgcattagtcagtgagtgttgtaaaacccacacaaattctacctttgggaaaggtgttgggcgataacatca

SEQ ID NO: 563977 - DNA, 122 bp, Homo sapiens
ggaagaggcagaaaatggaagagacgcccctcctaacgggaatgctaataaggaaaatggggagcaggaggctgacaataaggtagacgaggaggaggagaggttgggagaagagagaagaa

SEQ ID NO: 563978 - DNA, 110 bp, Homo sapiens
tcctccctcagttccttcatatttctctcaaatttaccttttacaacaattatgtgttctcattattctctcagccaattaaggcgagtggttgtgatctccacatgtgc

SEQ ID NO: 563979 - DNA, 505 bp, Homo sapiens
  misc_feature (197)..(197): n is a, c, g, or t
  misc_feature (388)..(388): n is a, c, g, or t
  misc_feature (457)..(457): n is a, c, g, or t
  misc_feature (459)..(459): n is a, c, g, or t
tttttttagatggagtcttgctctgtcaccaggctagagtgcagtggcgtgatctgggctcactgcaacctccgtctcacaggttcaagcgattctcccgcctcagcctctccagtagctgggactacaggcatgcaccaccacgcccagctaatttttgtatttatttatttatttatttatttatttattttganatggtgtttcactcttgctgcccaggctggagtgcaatggtgccatctcggttcactggaacctccgcctcccaggttcaagcaattctctgcctcagcctcccgagtagctgggattacagggcgcctgccaccacgcccggctaatttttgtattttcagtaaaaaacgggtttcaccatcttggccangctggtcttcaactcctgaactcgtgatccgcctgcctccgcctcccaaagtgctgggatcacggtgtnanccattctgcaaaggcatttcatattccgtgggtaggttctgaaata

SEQ ID NO: 563980 - DNA, 218 bp, Homo sapiens
ttcacatatgtcactagatcattagctaagtatgtgagcgggaagctcaatttttgggcgatgtgtggaacattaagagtaacattgcgcaagttaagaggattggcatttgtaggaatagtactgtgagcagcgggggaaatatgcaaacctgcgccattgccgacgtgcacttgctccgttgccgtggtagcgctcgcgagatgtgaaggcggtcg

SEQ ID NO: 563981 - DNA, 176 bp, Homo sapiens
taggctcagaccgcgtcagactgggatagtgatgggtcggaaaggcgacgaaggctggattctgaagggctatgctctgggcaggcagcctggccggtcagaatgattgctccctgtgaccggtcatctggccgacgactgacagcaacttgtgggcgtctccacatcccggtcga

SEQ ID NO: 563982 - DNA, 103 bp, Homo sapiens
ctgggaattccattattttgttccgttttatggctgagtagtattccaaaaaacctatccacataccaaacaccacctgttccataaaaactactgaaataat

SEQ ID NO: 563983 - DNA, 275 bp, Homo sapiens
tggttgaatgagtaggctgatggttatgataaataactagtatggggacgcggaggttgcagtgacccaggatcaccctagcctgggtgacagtgtgagactcaaaaaaaaaagaagaaaatgaacttttacctctgagagctccaggaagcggtgtgcattggtcatgatccaatgcaccccgcttccaaggctataacacaagcagagccccgaggaggcggaatatgctaatggattttatgtgtgtgtgagtatggagggaactggagagc

SEQ ID NO: 563984 - DNA, 370 bp, Homo sapiens
  misc_feature (5)..(5): n is a, c, g, or t
  misc_feature (18)..(18): n is a, c, g, or t
  misc_feature (65)..(65): n is a, c, g, or t
  misc_feature (83)..(83): n is a, c, g, or t
ccgtnaacccccaggccnggtatgccggtggtgtgaaccgtagcctcactgcagtcctcgaaacnccccgggttcaaagcgancccttcccaccttcagccctccccaagtagcctggtacctacaggtgtgtgcccacgacacccggcctaagtttttgaaatttattttttgtagagacaggattttcctatgttgcccaggctggtttcaaactccctggccgtaagcgatttttccggcctcccaaaacgttgcgattataagtgtgagccactgcacctggccccacattttctttatccatttgtacattgatggacacttaagatgattccatatctttgctattgtgaatagtgcttcaata

SEQ ID NO: 563985 - DNA, 199 bp, Homo sapiens
gcagtgtggtcaatcagaactgtaaacaccagtctacaccacagccacagacactcgtatcttagccgcgttgtacctacgccacagctcacagcaatgcagatccttaacccactgagcagagccggggattgaacccacctcctcatggatgagcatacggagttcccaggctaggggtccaatcagaactgcattg

SEQ ID NO: 563986 - DNA, 628 bp, Homo sapiens
cacgagctgtgctcattcttagagactgcgtctctcaaacatatcgcgttagccatgagggagtcggagccctgtgtccgaatggacccgcctgcggtctgcatcagcctctgtgaaaccacagcagtgatgccagctgggcacgtgaggaccttcccacacacccacacgatgccacaggtcaaggggctgtgcctgactagggagcccttccatatggcttcctgggccgggatagaagaggggaggtaagtctgggggctatgaagccgggcccccacaccctgtgtgaagtcagcttgacctaagtcttgagccttatacagcaagggacttgacagagccaagggtccctggaacgtaaggaggggctgtgggtcacttcagaccgggcctcccagaacaccaggcccgtgtgggtggcaccctgaggtcaggggatactaagggtgtgcttccagagacggtgtgttcagagggaggaacggccccgcttccagatacccggccccggctgtgactggcctgtgtcacccctggtgtgtgccataccccgtgtgtgcactaactgtaccgcacacggcatttaaagatgaaggcacaccgctgtgaaaatcctggccgccgt

SEQ ID NO: 563987 - DNA, 111 bp, Homo sapiens
ggtgaagcttctcccctgtgcttacttctaagaattttatagttagaggtcttagatccattttgaattaatttgggtatgtagtgttaggaaagagtccaacttcattct

SEQ ID NO: 563988 - DNA, 143 bp, Homo sapiens
cctttacagcttaaagttcatatagtaccagacaatgctgcatctgagaatttccatatgcatgaagcctattccacatgctgtaccagagtgcgggaggcatgccaggaggaatgcctgggggatttgctggtggaagggag

SEQ ID NO: 563989 - DNA, 1202 bp, Homo sapiens
tgggtaaatgcatgacttgtgtgtgatgagagaatgggagacagagtccctgggctcctctactggtttaacaacatgggctttcttattttggtttggaattggttaattcacagaatagcacaaactacaattaaaactaagcacaaagccattcttaagctcattgtggggaaacggggttgacacttcaggtgtggattgaggaagacagaattagaggtgattaggaagcgttcgtggcagattacctcctttgtgccacgtgcttggtgttgattagacaggcccaggtgagccgcggggcacattgcgtggccgcttccttcccttcagaaaaaaggcaggtggcctaaactcctttttataaattgactttggcctcgaatgcgtggtgggggacgtggcgtgggcgtgcgtgcgaggcccgtgtgttgttcgtgttcgagcccaacctttcacattcttgttcacgtttctccacagcgggggagaagacgcagttccggccccaggggtcccccggtttcctttgtggaggcagcagttcccccgcaggggcgtgacagtctggcagtacagagtgaatgggatctgtgatctcgcccttacttccccgtggtcatagaaggctgcagggggtgggacttggttcacaaggcttcgcttggaaaaaccttctggagaggtccatctacggactggtatccctggagaacataaaaaaggcctggtcattttccaaaaccacctggctttgtgggaccccttaactggggtttctcccaacacattatttggtccaggtttttaccatccggtcgtaccattaagcttggccaaacaggcattttgcccagaaaaaggccgacagtagagagagattgaagccgtcccgtggcagaaaacaccaagttgggtcttctgagggggctttgcccaaagccaagaaaacccagaaaccgtttgtgactaacaccggggacccatctccgggggaaaacacactgtacaatgtggcgctctgacaccacctttttttattgccccacttgagttgtggcggcagagataaaatttcccccctaaagggagggaaatcacacggagttatgtgagcgaaaaaagaatatcaacacaagatgatcctaagaggagtagaacaatataagagaaaacagtaagacaatcatcatatagag

SEQ ID NO: 563990 - DNA, 234 bp, Homo sapiens
gtgtgtgtataacttgccctcgtttgggctccgtttcacttgtgctctcagttctggtcctcaccatcatgacatgtacatcatacacaggacagatgtacatatgcttcaggcaacaaccagagtttggggcgctattgcgttgacacccgtgccaccgtgtgtgttccttcagtactagtactgtgtcggcgagcctcgcctataatatatgatttcaggcccaataggggg

SEQ ID NO: 563991 - DNA, 133 bp, Homo sapiens
gcaagagatgcggaccacccagcttggccctggcgcttccaaatgaccaaggagggagtctcgacgaatgccgtaatgtaaaacgtggtaactcaggacggacgctcggagtggaattgggcctggggataaa

SEQ ID NO: 563992 - DNA, 1490 bp, Homo sapiens
ggagtggggtcttagctgcagtcggagcctggtggagacagatgcatcactgtaaggcgataccgctccacctggaaccatgacccgtacctgacgctaccgatggaagaggagtgaggtcctacaggcgggaacatgaagggagactgcgatacccgatcgccgaagggaggccatcccccaaggaagatctcggtacccagagagccatgaccggctgagcctaccagaggaggtaccgggagcgccgagacggtcgatagcatagccggatgtgaagcagcggagcccaatccgttaggagaggactagctatggagccttcaggtgctcgctgatgcgatcggagagtcgcgggaaagggggccgataaccggacccgacaccgcatgcccaccagctgccacaaagcgccgagagcaggatcatgtagcaggcgcactccatcggagagaggccaatcagacgcggtacaagcgcagcgaggcccggcacgatgtggcacagcctagcacgacaggcgacggggtcaagcactaggggtggtaacacgagcatacgggacgaatatggacttccaagagacggacgactagctggagaactaggtgggagggaaaccatgggggatgaaaaggcaaacaatcagggagccacaccgctgagacggaagatggctatggaacacagggcgccaagcaagacgcgcaacgatccaacacgggacttcggccgcgcgtggacaatgcattgagtagcggatacaacgtagtgcgtgccaaatgaggtcaccccgcgcgaaaggggcactggcacagcggggacgacagagaacagcgtcctaggcggactggcagtaggaacagaaccaaggtcagcgggacaagacagggggtacacagcagcacacgatgacaacggagtaccagtggaaggtgggagtcttggaaaggaacacggaccgagacgaaaccagaaagaaggcaaacagagatgcgccaacacatagatgacacacatcgacacacaatagggcagccataccggtggggcgagaaggaccacacaccagaaaatggaaaggagatagctgagtgacaagcgcaacacacatgaacagacgacccaaagcagagtcaaccagccactagcacagacacggacgacgcggacaccgaaagtggcagcatgacagcagacgatgaagacgccagcggcaccacatagagaaaatagcaagggacaatgaaccaaacgacaagaaggagaccacgcaaaagcagaaactgggacagccacagccacagacaaaccacagacagggacaaactagcaggaggagagggacagacagccaaagacagaagagacaaacagagcagacgagaagaagacaggaagaggaaaggaacacagcagaggcacacgaggaggcatagcacaacgaagagaggaggaaaagaaagcgggacagagcacaggaccacaca

SEQ ID NO: 563993 - DNA, 189 bp, Homo sapiens
gaatattagtccacgatccccatgtgtcatgggagggacccaatgagagataattgaatcatggtggaggttacccccattcttttctcatgatcgtgaacgagttcccacaagatctgatggttttataatgggctttccccctttgctcagcacttttctttcctgctaccctagcgacagcaggca

SEQ ID NO: 563994 - DNA, 89 bp, Homo sapiens
aaacggggtggagggcagtcccagccccctgcccctttgaggtcctggggtaaagtaattttcctttttcagcccccatgactttttca

SEQ ID NO: 563995 - DNA, 893 bp, Homo sapiens
tgtatatgtaggtggttttgacggcacccggggcaacagttcccaaaaggcctgagccgccagaaccaaacatcaaacagaaactagcagggacattctggtactgggtcctactatgaaattcaaacatgatttcaaatctgtcacaatatttgaactggctatgagctgcttcagggtaacctgggggcaatatgcccttttcagttcaccactggcttagctttgggcaaagatgttggaaaccatatgttacagaagaataagctgtagtcactaagttcttactctactatctggcgttcaaaatggccctaacgggcaagactggctggtggtgggatctgggatttcagaaatgggcgaatctgggcacttaaaatacataaatcaagagagtattcagtcaaagtgcaacaagtacaccgatggaagaacgggggacagatttttacaaagttcagagaggctgagatgccctttcattcggggtcatcagaagataatctggcaacgatggaatgccagaagtgtgggcttaaatttttcttcataagcatgtgctagaaatgagtcaaaagcagatgctaggattaacagttgagctctctaactcatttagaattctaaggaagtggtgaaaattccagttcagaacagctgcatttgcttggagtgacttctgacaacccttttacaacaggcaaaactaacaggcaggttcatcctaggcatggaatctaaccaaaaaagggtccgatggactccagggcgggaggttttacaagtcccatttgtaggccctagcaaaaaggtctgggctttggaccccgcaacaatcgatagcgcgacttcatttccagttggaacttgggtgaaacgtgactataatg

SEQ ID NO: 563996 - DNA, 509 bp, Homo sapiens
  misc_feature (105)..(105): n is a, c, g, or t
ccaaaccttttataataccgtttgctaaccatggagtgtccagttatttcagctgagcccagggacttgtttaccacccagatcactttggctaaaccattccanggagcttacccatatggagtgatttaaaattgctgttggccagaggacgcttaaaatcattttaacaggattttaaaacttgtttgttgagaatgctactgtggacactcttgtcttttaaaatgttttagcccttcctgtggagtggttggatccccttcaggtagggtcccagtctttacaaatagagcctgtgaaggccagtagtgaaaattactgtgtttgggctggggagatggctcagcagtttacactgactgctcttccgaaggtcctgagttcaaatcccagcaaccacatggtggctcacaaccatccctaatgaaatctgactccctcttctggtgtgtctgaagacagctacagtgtacttacatataataataaatgaatcttgaggccgg

SEQ ID NO: 563997 - DNA, 375 bp, Homo sapiens
ttatgcacgtgtcagtgctgccacgtacacactgtggggatggtgtgggtaatataacaaggatcacttccccttggtcacttactgcctcaatggcaagggtgtccacttgcgtaggacaggaccgcctatactcacgccccagacaatccacaagagctgcttctacaggcagtgtgaaacggaggtgcactaacacttccaagattcgtcagatccaagcgggacagcacactgcgtgtgcaccttcccactgtttagcatccataaaacctacgcttccttgaccaacacactgctctggcatggaactgttctcagcaaatggaacacccaagcaaaccctacaatactggttcttcatccacaggtggt

SEQ ID NO: 563998 - DNA, 1363 bp, Homo sapiens
  misc_feature (409)..(409): n is a, c, g, or t
gggcagcgtgggtgagcgcgggtggcaccgtgacccagtccatctggggcctccaccacttggagataccgagctcaggaggccagatggtcaggggtcgctgacctacctctgagccgcagatgtcacgagtagcggcataggtctgtcgtggatggagagtgttcagtgatgacagactcagactcagcactcaccgagacatcaacactcttgcgctaggctcgaatacggcgaggcaccgcatgtcttctcatgtccctcgcaaacacgactagcaccgctcccgagggtgtgccccttgccctattgctccgtgaccactatattgaggggcttgtggctcgtgaggggtggagggacgaggagagggaaaagtcgacctatgggaggttggaaatgcgacgtnagagagagtgagaacgtgttttggtccgtattgtatataatctaacaagagtggcgcaaagggaatgtgattcactaaggccccgaatgggagagagaatgagagaataaaaatgatagaaaagaaattagaatagaaaatatcaataatgagaaacacaatttggagagatgcgtggtgggcgcagaagcgaaagagattggaggacacaatggtgaaggttcaaaagggaatagtgagagaaatacacaagggaaggacaaacaagatggtcatataccaaagagaagtagagatacagtgtagtagatagagtacaatagaaagagtagcgatatacctttatacagacggagaagaaataattgaggaatgaggaaacaagcacggaactatacggacgacgagacgcagttggaccgctggagactgtgtatgaattatggagacaaccctcaggtgtgcagtgaatatctagtgggggaaccacaacatttcaggaaagaaacattgagtgtagttgcgataccaaccactatgaaaaggaagaagttataaagaagagcacctcttctatgaaaccttatcccgtatggaatacagtaagaaactatcacaaacctatccatgtgtgtgggttcagaaaacaacaataaaacactatgaagaagaaaaaaagaacaaaaacagaaaagagaccccacacacaaaaacgagggatcaaacacaataacataacacaccacaaaaatagagacaagagcggagaaaaccacacgacgaacgaatgaacaaaacacaccaacgcaacggaccaccaacaacaacaacagaaccgaacaagaaccaaacccaatgggagacatcaaaaagaacacaagatacagagacacaacgagaaaaaagcacagacaaaaacaaccaagcagagagaaagctagaaaaaaaagcaca

SEQ ID NO: 563999 - DNA, 407 bp, Homo sapiens
tgtcacttctccaagcagtgttgtgtgatgaggttctattgttgggttggtagcatcatcggggcccaatatacacatctccagatatcggtgtaaatgaagcttgtccaccctttagggataggtaggggaaggtagggctccggggtccaatttgaagtccaaatataaggtgggggggcgagtgtaaagctgggactttatacccagggcttctccagaaatgacagcaagggtcacaccatccttacggggtgcagggacttccttcacttatcagtgcctgggtactgaggctccaccatcttctctgagctcctcaaatcaccccacagtggtaggccaggggctgggctcctctgaagcaggcatctcagtgtgcagaatgcccgggcccgaagtcatcc

SEQ ID NO: 564000 - DNA, 135 bp, Homo sapiens
cttggctttcattattttttgtagtacacccgatattgttcaattagaaattcttttgcatttaatgttgatactgtaagggatgtttcgttccctttaaatgatcacacttgcactctgtcagagttgttgttg

SEQ ID NO: 564001 - DNA, 275 bp, Homo sapiens
agcatgccgagagtctcgttcgttatcggaataagcagacaaatcgctcttggtcgctgtatcagggggcagtggtgtggaatgagagggaggtggagactgctgaggaagcgagtagggaaaaggcatgggaggaggcaaagaagaaggtgggggtgggagcaaggccaggtgctccccgaagtctgaggtctgcctatggcttccctggaatgaatgattcatctctgcccagtcctcaatccacgggtcagggggatagccacgcttgggca

SEQ ID NO: 564002 - DNA, 293 bp, Homo sapiens
gtaaattatgtggattgcgtcacagatttcttaaaatcactggttatcaaagctggaagatatcgtccataaggaaaccaagctgtgcagagattaaatgtttccatgttagttgcgttatagacctggaatccaagtgttttctgactagtagtccatcaagaaaaaaaaaatttaagagggatttttttttaatctaaaatcgctgatagaggttctttagtcatctattttatggaaaattgatttgatttgctaagtcgcaaaattagatattagaaaaccaaaaaaag

SEQ ID NO: 564003 - DNA, 126 bp, Homo sapiens
gcttacagaatcatgggactttagaagagggaggacagaggccttttcgcactaacgcttttgtggggttctgggcttttgtatctctgtaaacaaatatccccctaagggctctctggctgtgga

SEQ ID NO: 564004 - DNA, 484 bp, Homo sapiens
tggagggcccgcccggcgccgatcaccggatggccatggaacggtaagctgacggagctgatccgccaggccggtggggtcatacccgaggagcggggcggcgacccgactccgtcgcccttcgtcccgcaccatgacgccacggctcagccgactccgtctcagcccactgtcatcaacgatgacacggttcccatcgatgacatcgaggatccgctggggagcatcgatgtctagggatgagatagaccagcaggtggccgccgagggccatttcatgcagtcggtgtattccctcctggtccgaatgggggtggatccccacggtctggtgggcggctacgatgatgaggagacgggcgggcacgtgtccctcgccatcccctcatctcaggtggggatatccgtggagggtgatcgtccccagcccctcatcgatgccggatggtacatcgtgccgatgcagataggccaactggaggca

SEQ ID NO: 564005 - DNA, 1016 bp, Homo sapiens
gcgtgtgggtgtgtgtggtcccgggggtgtcgactgggtgtgttgatgtggtcagtgggtgggagtgggtgccagggtgggatttggggctgggtgtccacgtgcgcggttacgcggttggctgttgtgatgtcccggctgtggccggggggtgtatcagttgggagggcggggtgtgtggcggccagtggggctgggtggttcggtcggggcggggggcccggactgttgggccaagggggtcgaccgcattgttggcccagaatggggaaagtttgacactttggttgtgagaggcccacggttaggaccgtgttagtacagggtgatgagtgcctaaggcagtggttgatgagcaggagggagagagcaccccgagtaggaggggcacaaaagggggtagtgcccgggtggggcagaggttggcaaagcgggggggggagacgtgtgggagggtaaagccacgggggtgtggccagggagaattggggggtgtaggcgttgaagagtggtgtaagagggtgggtttgcgggaaggggaactttgcggttgttaagaaggtgtttggctgtgtatgagacgagatgcttgtgccaagcgtacgcgcgctggaaaaatgttggcctggaagaaggcactggtgacttggtaacacggtgtcagacgagtccgcttggcatgcgtcacttgcttgccatagctgttacgtcttcccacgcttgagacgcacgggttaagcgttgagaaggtggtatggaaaaggcctgcactgccgtgttcacatttttttgtttgcttctgcctgtccgccctaccgccctagcctgcgctgtgcccgctcaggctcctcccgctcgcttcggtcgctcaacctcttttgttcagtatgtgtaacttgaagctaagtttgtagctaccgtggatatctgactggaggccaccagatacagaatgctgctagttggtttcttaactgaagagcaccacgccactggagcagtgtaaccactgtata

SEQ ID NO: 564006 - DNA, 930 bp, Homo sapiens
  misc_feature (133)..(133): n is a, c, g, or t
  misc_feature (354)..(354): n is a, c, g, or t
  misc_feature (397)..(397): n is a, c, g, or t
  misc_feature (426)..(426): n is a, c, g, or t
  misc_feature (458)..(458): n is a, c, g, or t
  misc_feature (468)..(468): n is a, c, g, or t
  misc_feature (490)..(490): n is a, c, g, or t
  misc_feature (640)..(640): n is a, c, g, or t
  misc_feature (644)..(644): n is a, c, g, or t
  misc_feature (666)..(666): n is a, c, g, or t
  misc_feature (695)..(695): n is a, c, g, or t
  misc_feature (736)..(736): n is a, c, g, or t
  misc_feature (747)..(747): n is a, c, g, or t
  misc_feature (806)..(806): n is a, c, g, or t
  misc_feature (860)..(860): n is a, c, g, or t
  misc_feature (867)..(867): n is a, c, g, or t
  misc_feature (926)..(926): n is a, c, g, or t
gataggggggatggtgtgaggaggacaccccacccatggcgggggggaggacgcagagttccaggagtcacagggcagaaacacgcggggtgggtgggggcgtggccggagtggggaggggctgtgcccccancacctggggagtgggctcccacggcaccaggtggggctagagcgacgaacagtatgtacaggacgagcaatgctcctggagcctcggtgcggggcctggctggggccccattgctagacggcagggcgagctctggaggcacacgaggtctgagtcccgatcttgggcgctgcagggaccggcgagggcgctgtccagggcgaggctggacagcggggggnctttatctgggcccatcaggtggatgagaacggacactgcganccgctcaccacctgggccagggctaggcntatgcgggcaggggccgtccccacactgaatnctgcggtgcngcagaactgcaaggccggcgancctagggcagtgggaacgccccgcaggctgggcttgggtggcctgcgggcacgtgagcgaggtggggcccgtgtcctgataaacggacaggaacaaagaggagacgcaaggtctgggacgcgcacgcgctctggggagcacgcgccaccncagngctgtgctcctagcaagagaanatggggaatcgcaagatgcatctgcaatngtgcagtgaacgagactgcgaggggacgcccggcggcgcanccgccggacangacgaacgtggggcagggcgccctgaagctgcggggtgccgtggggccctggcccaggncgggcacagccctggtccctagttcctgaggggattgtctccacagggcctggncactggnctggccacctccccggctgccctgatccagcagccacactcgtggtgaacacagggcancccc

SEQ ID NO: 564007 - DNA, 980 bp, Homo sapiens
  misc_feature (477)..(477): n is a, c, g, or t
  misc_feature (488)..(488): n is a, c, g, or t
acagaagaaccaccggagtatataggtggattcatgctcatggatggtcatgtgtagaaggcaaggaaagcacctgatggttgtgtagcgactcaagtttaacgtctagatgtggggtgtttgataaattcgggagtacgactattcttttaacagtgggtatgagattgtcgtagttaccatggggaactgcttttcaatcgtgttcatgcatctttggtgtaggtgtgtggtcataggtcttagaatggctttacacgaaacaagtaatgttttggccatccatgaatagtaaggcatactattcattaggactcgactggatcgtaacttattggaaaaggaccgtcatcactactcttatgaggactcgttttaccattgcaaaatcatagggcggtataagagtataagattacgcaagccaagctatgaacaaatgtgtaggaagggcctctcttgcattgcaacactcgngctacactganttatacaatcttttttcgagtccgtctgtaacatagtcctctctgtttaatttcatgaccgtgggaaaatatttgcggttctagagagttcctatggcaaacagtaggcaatcataatttggtacgcatgaactatgaggaccagtgttaaatgtctcctggctaaagggagaatagttttaatggtcgaattcgtatggcaacattgctgtaaaatcagtcattctactttttagacaagagtcggcaagagttgacgtagataggtgtatctatagcatagattgtccataacacttgtaagttagagtttcatggtgaggccgagtgtgatattatctcatttcattaagtctaactgtagttgtaatgtgtgtttcactagcataatgtgctgtacgtgttcaatccgtattggtttaaggtgtgattttattcacatgccagcggaatggcttttgagaactataaggggcggtgagagtagaagta

SEQ ID NO: 564008 - DNA, 665 bp, Homo sapiens
ggtcgctcgctcgctcgctcggctcgctgactcgccggagcgctctgtggcggtcggcggcaggtccggtcgcgagagcgggctctgtgtgaagggggcgaggctatgtctgcggtgtgcagcccggatgggccggcaggggccgggagtaacgggacgtcgccgcggagcttcttcccccggatacagtgcggccgagcggaggccggggcctgccctcctgatcttgaaggatgtcctgctgctgctgcggagccctgccccctgcctgcgcaccggcacctgacgctggagcgaccagcccatgccagaccctggcccgtgcgcgggctgatctaacccagccatggcaaggcgaaatactagcccctctggagcacggagctccttccccaaaagacatgaatgctattggagaactcggagctttgaaagccatcaactcacagctgacttgtggagaccggagatgcccacatcattgtgcaggattgagagctactcattgtaagatgtcagtgagacagacaaacacatgtacaagcatgttctgccagggaggccatccccacgttgctggaggcactttctccaccccagacttccaggactgagccccagcagaactcaggcaaaagccaaggctgctgagggaggagggcccc

SEQ ID NO: 564009 - DNA, 1179 bp, Homo sapiens
ggttatgtcccgggtacactctctggagcggcgtctggcacagctcttgcttgctgcacattttcctcccaactggcagcaaggcaggcccatgcggctggaacgtctggcagctgctggcacaggggctcctggcccagggaggtggtggtggcctgcagccacgcaggcacaccctgtgcgctgctggaggggctcagtgcagccgccggtgcaagcgtgccactgcaaggcaggcatttccgcacagggcacaaactgcatgctcgacatcccaggcaagcaactgtctgcccgtgcagcagcagcagccatccagccacagcactccagcacagcaccatcttcgacagcacagcatctggtccgggcccctaccccagagcagtaccgcaggcatcgccatcccagccagactgcaagtccagacagtgggcacacaagccactgaccccagagagatccattccacggacgacgcatctgatgcaaggagcatgacggcgagctggaggaaccaagacgtggacacgagactgcaggacaggacgcgtggcaggctctggcacgtgacagcagaacgctcgcgtgagcggaacgacgtagggacctagcatgcacccgagacagcatccaggaccgatgcgaggacgacggtgggcactctcagaatcccgggactggatcaagctcagtatccttgcaccgagggtggaaggggggaccagagatgggggctcacttcagacgacgaggagatgacaagctcagcttgggaacagctggagagacaagactcatcaacccatgatggcagagaatgcaggggacacagtcgggacacgggaagcccgcggaccatccctgagccaggacagctggcgaacaggaaggagtgactcggaggtgaacacaaggcagcaggcggaaccacgacgggacgcaggcccggacgaggcaaaaggaagaccgacactgggcgtgcagacgcgcccagagaccagaagaggccagggaaaaaagaaacgaaagagagtgaagaacaagagagcaggaagggaagcataaacaaaagagaaacaagatgaacaaacacgatcgacaggaaccccagcgagagacacacacagcgggcaacgggagacaagaagcggagccaacgagagaacacgaaagaaa

SEQ ID NO: 564010 - DNA, 407 bp, Homo sapiens
  misc_feature (323)..(323): n is a, c, g, or t
tcagcgatccctttctacgtctcatcactggtcatcagagaaatgcaatcaaaaccactatgagatattatctcacaccagttagaatggcaatcattaaaaagtcaggaaacaacaggtgctggagaggatgtggagaaataggaacacttttacactgttcggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtntattgcggcattattcacaaatagcaaagacttggaaccaaaccaaatgtccaacagtgatgagacgtaaaagggggtaccgag

SEQ ID NO: 564011 - DNA, 253 bp, Homo sapiens
gcggatccttaggtgaatgttgaaatcccacaaaacatattagataggcagaaataacaccatatcattatttcataacagaaataatagaccaaagaaaatacaaaattttgataaatacaggacaagaagaaaattacataacaagagagttagtattagaagaagaaattataaaaaaggacacatatgctctggattaccttgtgggatagtaaacataaatgaagaaacaaacattcaagccgtctag

SEQ ID NO: 564012 - DNA, 110 bp, Homo sapiens
ccttctctggcactcaaattcaggtgactcacatcgacatcacagtacgattactgccgtaactacggtgtagcatacgacatcggtgacctggactgactgtcctgcca

SEQ ID NO: 564013 - DNA, 363 bp, Homo sapiens
ttagatggatggtcggagacagagaatcaggtttgaacagtcataccctcccattagcggcgaactatcatcccaccctgtagcctccgtacacctaaccatcttctccttatcacctagcgggtgtcgtcctctatcttggtgggcatcgatttcatcacgacaattatcaattataaaaccccactgccatatacccaataccaaacgccccatctttcgtctgatccgttcctaatcacagcagtcctacttctccttatctctcccagtcctagctgtttgctttgttatagtattaacagaccgcaacctcaacaccaccttcttcgaccccgccggaggaggagaccccattctata

SEQ ID NO: 564014 - DNA, 86 bp, Homo sapiens
acggccgtgtattactgtgcgagagttctgacgggcacgatagggcttgcctactggggccagggaaccctggtcaccgtctcctc

SEQ ID NO: 564015 - DNA, 107 bp, Homo sapiens
ctccagtactcaagggaacggtgagaactcaacagaggcgaaagcagtagattctaacaatcagtcgaagtccccattggagaaatttatggtcaaactgtgtactc

SEQ ID NO: 564016 - DNA, 504 bp, Homo sapiens
ctctcaaattatactctcaactcttactgatacttcaaatcaacacttcttcaaactttatatgcacaaagtaatcagctggggatcttattaaaatgcagggtctgttttggtacgtcttgactgggaccagcctatcgggatttctactaaactcttaggtgatgctcaagcacactgtccatgaatcatattttgagtagcaaagttttattttattttgttttatttattctatttttcgagacagagtctcactctattgcccaggctggagtgcacgtggcatgatcttggctcactgcaactctgcctcctgggttcaagtgattctcctgcctcagcctcctgagtagctgggattacatgcatgtacaaccatgcctggctaatttttctgtatttttagtagagatggggttttgccatttggccaggctggtcttggactcctgacctcaggtgattcacctgcctcagcctcgcaaagtgctgggattacag

SEQ ID NO: 564017 - DNA, 637 bp, Homo sapiens
  misc_feature (236)..(237): n is a, c, g, or t
  misc_feature (243)..(244): n is a, c, g, or t
  misc_feature (249)..(249): n is a, c, g, or t
  misc_feature (256)..(256): n is a, c, g, or t
  misc_feature (444)..(444): n is a, c, g, or t
  misc_feature (494)..(495): n is a, c, g, or t
  misc_feature (498)..(498): n is a, c, g, or t
  misc_feature (500)..(500): n is a, c, g, or t
  misc_feature (504)..(504): n is a, c, g, or t
  misc_feature (508)..(508): n is a, c, g, or t
  misc_feature (547)..(547): n is a, c, g, or t
  misc_feature (549)..(549): n is a, c, g, or t
  misc_feature (564)..(564): n is a, c, g, or t
  misc_feature (574)..(574): n is a, c, g, or t
  misc_feature (579)..(579): n is a, c, g, or t
  misc_feature (582)..(583): n is a, c, g, or t
  misc_feature (585)..(585): n is a, c, g, or t
  misc_feature (590)..(591): n is a, c, g, or t
  misc_feature (602)..(602): n is a, c, g, or t
gcacgaggagaaaccttaccagcaaacacgatgggcagcaacgttaccaacacgacagatcctcgctccatgaactcccgtgtattcattgggaatctcaacactcttgaggtcaagaaatctgatgtacggctcctcttttgacttggactatgactttcaacgggactattatgataagatgtacagttacccatcacgtgtacctccttcttctactattgctcgggctgtanngccctnnaaacntcagcgngtatcaggaaacacttcacgaaggggcaaaagtggcttcaattctaagagtggacagcggggatcttccaagtctggaaagttgaaaggagatgaccttcaggccattaagaaggagctgacccagattaaacaaaaagtggattctctcctggaaaacctggaaaaaattgtaaaggaacagagcanacaagcagtagagatgaagaatgataagtcagaagaggagcagagcagcnnctncntgangaangatgagactaatgtgaagatggagtctgaggggggtgcngntgactctgctgaggngggggacctnctggntgnngntgatnntgaagatcggngggatgaacacctggagtttatcaaggatgatgac

SEQ ID NO: 564018 - DNA, 1017 bp, Homo sapiens
gcactaaagcaagccctacaggagtccctggtgcaggattctgcagccaccagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgccaggggccgtggagcatactgcgtacacacacccggcgtttgagtgccctacaccctccagaagaaagcatggtggccgaccaatggtgcagtccgtcctgtgaccaagggcgtatggcaaggaatgctgctggcattgccatgtaagccatcagctttctgcacgtaaccaatggctttgacagtggtgctgggtgagacacggcaggccgatgcaaggacaaatgcgcctctgatgactgtccctgggccaaactcattactgtcaatacactctgatgtgggggctgacgtaggagaagccttaagtatgcaatgaagccgtggaccagtggtccagttcaacagagccttggtgacatttctatggctcagacacctcggctcattgatggcattgtacttaccagatttgataccattgatgacaagtaaacgtgagactggagggtggatggggtctgcaagacctgaagctgacggccgcaggaaaacctgggtccatcgactacctggtccgagaggttgacttgaacagcgggctctgtggaagacggccacctatccaaaaagtgggacgcactcgatgaggaacatccagcaagccaaccatatgggggaccgccgaacactgtactgccccaagcaggtgtgggccacaagagcatacagctccacacaatggtcacaacctcgtcgtaacagtcaaggcaccctcaataaaggtgaggcacaccagccgcgggaaaaaccacataggcaacaagcgacacacccacacttgcgca

SEQ ID NO: 564019 - DNA, 670 bp, Homo sapiens
agcattgcagttccccaagccacgcttctggcagagatgccggggtgccaatgcccagcactgcagagcccagctcgagcccccaggaccctcccaatgcctgttgctgcgcacatgtgaaatgcatgcagccacaaatgggcaaatgagcctgccacctgacggagtgcagacaagcccaatggcatgaaactggtccccctcagccactgggcagagttctttcctgatccactggccctccctggaaaagtctctgagctgctcctccagcttccctgaaaccagtggcctggagttagatgtgtgcctcttgcatgccagcagctgacacctcttctgccaatggcctgcctggggtgcatgcttggagcttccagcccccagcaacagggaccatatggaaggctcatgccttgcctgtgggaatgggccgaacccacatgacaaagagttgactccctgccctccttccgggtctccaccctgcctctggagtcacaccacccctgacccaaacaccaatgggcggggccagccacctgtggacagtgctctctcggtgacttgccacctgtaggggaaaccaaagggaaggaccctgccccagcccagcctccccagctaggacacagaacgtgggcagagactttaccaagccatccccagc

SEQ ID NO: 564020 - DNA, 419 bp, Homo sapiens
ctggtgtcctccagctatcatccctcttactctccagatctacacttgccctgggatcactaaccttttcactgtcaccatatttttgccttttccataatatcacatagatggaatcatacacagccttttcaaattcacttctttcacttaccaattgacatctaagttttctccatttctatgtggcttggtacctcatttctttatatctctgaataatacctcatcatatggatgtaccacagtttatctatccattcacttattgaaagacatctcggctatttggaaattaaaaataaagctgctgtggacatttgtgtacgggtttttgcgtggacctacatttccaattcatttaggtaaatatcaaaaaacgcattttaaaaatttaataacaaagttaacacttgatt

SEQ ID NO: 564021 - DNA, 138 bp, Homo sapiens
ctgttacgcgctaacgcagctgacctaaggcgagatcagggagtacagacacctagcgtggcgcaaaatggcagaagctcgcttgatcttgattttcagtacgaatacagacacgtgaaagcgtgtgcctcacgatcc

SEQ ID NO: 564022 - DNA, 481 bp, Homo sapiens
  misc_feature (1)..(1): n is a, c, g, or t
  misc_feature (11)..(11): n is a, c, g, or t
natatagttantccttttgtaagagtgacctataaactgttttgaaactggcttttttaaacataacaatatatgtgagcacattttcccacatcccccaaatatttttgaaaaatatttccttttaaaatatcctgccataagtttttgtaccccattataatttggctctggaagaagttccaagatatgcccaaatagtcttggcacaatggctcacacctgtaattctgacacttttgggggccgaggtaggaggatcacttgaggccaggagttcgagaccagcttggtcaacctagcaagagctatttccacaaaaaagtgaaaaaactacccgggcgtggtaacactcccatagtcctagctacttaggaggctgaggtcaaaggattgcttgagcccaggagtttgaggctgcagtgagctatggtcgcaccactgcactccagcctgggtgacagagcaagaccttgtctct

SEQ ID NO: 564023 - DNA, 1411 bp, Homo sapiens
  misc_feature (352)..(352): n is a, c, g, or t
  misc_feature (359)..(359): n is a, c, g, or t
  misc_feature (371)..(371): n is a, c, g, or t
  misc_feature (384)..(385): n is a, c, g, or t
  misc_feature (393)..(393): n is a, c, g, or t
  misc_feature (411)..(411): n is a, c, g, or t
  misc_feature (418)..(418): n is a, c, g, or t
  misc_feature (554)..(554): n is a, c, g, or t
  misc_feature (556)..(556): n is a, c, g, or t
  misc_feature (558)..(558): n is a, c, g, or t
  misc_feature (609)..(609): n is a, c, g, or t
  misc_feature (641)..(641): n is a, c, g, or t
  misc_feature (715)..(715): n is a, c, g, or t
  misc_feature (736)..(736): n is a, c, g, or t
  misc_feature (802)..(802): n is a, c, g, or t
  misc_feature (1034)..(1034): n is a, c, g, or t
  misc_feature (1047)..(1047): n is a, c, g, or t
  misc_feature (1101)..(1101): n is a, c, g, or t
gcatgatcacccccgaaatactaggatggtagcccgcatacgatgaatcgtaaatcgactttctcgagctctgataggtcagatatatatgctgagtgcactaggaagtgtaggactcatgtattcatgctaggttccacgggaagatacaggtggtaattgcagacgatatgcctcccggcagagtctcatcgcctagtcctagacagcattggtagtagcatatgcattgatccatagtcaacctcggagtgaacatatccagggctatgtgatgcgtgtataatttcaatgccaaggtctttcgagtcatgtgcagaaaacctatcagaagaacagtgcaaggaacgtnatccacntgtcttctaggnttccgagtggatnnttcgcaantcactctatgctcagaantcgagcnttggatggcacagcaggttcttcagtctctttgtactttgcttgtgagtgtgcagttaactcctaggctactctaacttgcccttccacggaccacgggtggaatccctaggtattatacatattcgagaaggagnananatacattccacatgcgttccattgcacacgtagcactgcacatacgatatncaaatagtacgtaaccaaaactatgcgtctanagacacccaactaatcctcaattctatgcgaatacataacttaatacttctgacgtaacaagggtttctcattntcatactcggactacgcggcnttactctattgttgtcccaaggacgtatgcgtccctttaagatggttgttcataccttcacttatntagtaagattccaaataggccataagagaggtggttcaagcaacgtgttcattcccggtgctttaataaacaaattgatacattataccaggaaccattccctgtggacgtaataaccaatgtcacaaaccaatcacgggggctatgtaaagtcactaaacttctcgaacgtgggggggaggccctcgagaaagccccatattaacgtgggcccgcaataaaggagaggacncggggtgtcacanaggtcacacggtagcgacgcggacaggaatatggcgaactcgttccgtagaacntggggtgactacgccacgtggcggtttgtcgccaaacgataatgtacgtccgctgggtatgtctaagtcccccctttttggctggggtgagagcaaacaatgctatgccctaacagaacgacgctatccacgtagaagcgcgcacccaacgcgactgtgagcaaatcacaccgtgcataatagaggaacaggcgtcacatatgaacccggcgttgtgaaccaagagcgcgggggacacacatacaaggaaccgacgtgtagtgcgtgcacgctataccgacgcggagcacgtgcgtacccatggggttcc

SEQ ID NO: 564024 - DNA, 405 bp, Homo sapiens
  misc_feature (11)..(11): n is a, c, g, or t
  misc_feature (34)..(34): n is a, c, g, or t
  misc_feature (41)..(41): n is a, c, g, or t
  misc_feature (61)..(61): n is a, c, g, or t
  misc_feature (215)..(215): n is a, c, g, or t
  misc_feature (257)..(257): n is a, c, g, or t
ggggcaacgcnacaaggccaacgcgtacaagtancctcagnttgtcccaggggcacctggncggacggagagtacaataaattttattcttttaaaatccaggcctttctgtgaccctgaagcagcccctcctcggccccaggcttccccaaacctcttagctgcctccatgggccctgccaacgctgggtgctgctggtgcccagagaggcttnacccccaagaaggtagcgggttgaggacccggggggcctcangcctcgtgtgggtgtggatcagggcagcctgcctggaggaggaggcctcaaaagctgttaggggggtgttgctggaagaggcaaaggctggccagaatcctccctcccatggtgatgaccatgtctgccaacgtctggccctggttgg

SEQ ID NO: 564025 - DNA, 365 bp, Homo sapiens
gatctgagagccatctcatgtagtcttccatgaccctgcaattgtttggtctgcctcagcactctccaatttccaggtccgatctagagctgctgctcgatcactcaggcatactaatggactcatttagactgggtccacgctgcagtccatgaccaataacagactaccccagatactgcagtctcacgcagtgcttagtaaatgagacctctggaactaagttatcccttacctgaggcttcttcagaaagtcttcttttctgaccagttgatgtgaaagagggagcatgtgacacagccagtatggtggagtgctcgggtcatcctgtttccaataaaccgcctgaatttcaaaaaaaaaa

SEQ ID NO: 564026 - DNA, 378 bp, Homo sapiens
actgctaattacagaaggaactccttgtcacatagaacatcatttgagtctgatcccaaacatttgaagagacgagttatagcctgtattgcttaagaaacttcattacagttatgtttatctggtcttgtgcgtgtgtgtggtctgatcacaggtttgctgtagcgcggttcagctggctgaagccagagggtcgtcgctggtttagtaggcacgtgcactataacactgggccgaaaattgaagaacaggttgcctgggccctgacaaaatttccttgccttcagcttcagccccaggtaggagtaatttcatttttctctgtgtaataagataaatcacagaaactgaagcactgtggtaatcagggtgttaacg

SEQ ID NO: 564027 - DNA, 837 bp, Homo sapiens
gagtagatcccgctgtatagacaggagaacgaaaagaactatcttcatctgagagaggctagaatgttttcagctaggaacaaatcttcctggtcgaaagttagtaggatatgcctgctctttggcctgatgaccaattttaacttagagctttgtcttttaaatttggtctgccccaagtttggggaaattttcatatttcaattccaagcttatttgggcagagataggacaggtcatttccatgtatgcgtaataatcctgcaaagtacaggtacttggtctaagaaacatgggcaagcaggttacacggttcggtaaacttggaaatatatggtctaacggtttaagcagaatgggacaaagactaacgatcggttaacaaattaacaacttttccttctttatacctatcaggaccattggacagtgtgggggagttgggtcatagggtcactcggagctctactggatcacaaggttcgaaattaatggagggacaaccatttgtgacaggcacctacagctctaagagtgtacacactcacccttaaacaacgttaacctccataaaaaggggtgttacccgagtgtgaaccatcgtgtcacagcagcgcgctaaacaaacctgcgaacgcttctcgtgcgcaccccctggatagtgctcattcaacgggaagcaaacttgagggcacaccttgtggaacactgttccgcagttattcaccagggtataccctcttctacccttgggcaatcacacaacacacaaaggacatttgttaccacgtgggagaccacagaggtgggccaccttgtaattaacccagaacgtat

SEQ ID NO: 564028 - DNA, 224 bp, Homo sapiens
gaaagcgagtgggaggaggagaaggactgagccagggcaggtataggtgtgcctgtgccatcccctctgatccccatgggctcatagtcagcaaggggtggagagcagcttctctttcctcactcaggctggcagaggacataaaattgtccgctacaatttttgcaggatgccagaaggtgggactccctgcagcctcctaggattacctagaaggataatct

SEQ ID NO: 564029 - DNA, 408 bp, Homo sapiens
cacgaggcctcgtgccgaagcccttccagtagggctcgcgcagctcgcgcttcagcaccttgccggcgcccgagagcggcagcggcgtgtcgcggaagtcgatgctgcgcggacacttgtaccccgcgatctggctgcggcagtgctccatgacggcatcggccgtgagcgagacgccgcgcttgggcacgatgatggcgtgcacgcgctcgccccagcgttcgtcgggcacgccgatcacggcgacctcgctcacgccggccagcagcgagatcgcgttctcgacctcggccgagtagacgttctcgccgcccgagatgatcatgtccttcagccggtcgacgatgtagacgaacccttcgtcgtccatgtaggcgccgtcgcccgagtagtaccagccgtccttca

SEQ ID NO: 564030 - DNA, 508 bp, Homo sapiens
  misc_feature (1)..(1): n is a, c, g, or t
ngcacgagccaaacttaagtgtagagggaagggattgattcagaacctgaacgtaagcgtcaaatttttcgaatagtaatgactgttttaggtttaactctagccacagcttttcaaaatttgatttcgacataggcaatgaagagttcgtcaacaccgaccgcgagactatcttttcaaagtgcattattggttttcatattgattatatcgaaaatggccaacgacaaaacaacaatgacacacactccccatatcgctacaggagtacggtggcaatgacggggatgattcggaatctaatgttgctgtacctacaccaaacacgagtggtaacgggtattgccatgttgataaacaccataaaagtgtcgacatcttattatctcaagtatgcatgagaaaattgattgtagcgttcataagcacatcagcgacatagagtacgaatttatgacagtatgtcaaaaatgaaagggaaaataatagtattattatgtagaattat

SEQ ID NO: 564031 - DNA, 560 bp, Homo sapiens
agcgggtggaagggccagccacggccagacgcgtgagtcgcccgagccgggcccgatacagccccggcgaccgcccgtctgcccgtctcgccgcagatggtagcgctgggtgggtgcgcgtggacccgggcgtctcgagccgtcgcggctggggcgctgctcggctgtggtgcgctacagtactacccacgagcaggactgtggccttgggatgctgcgttaatttcgcattgccactttgctcgtctgtttggtttgcgttcgagtgctcgcgagtgacggatgcgcaggtcatctcacctctcagagaacgctagaggcagaggattcacagctaccaacggcgggacgtttgcagcacgagtgccacacctcgtcctgagagtgcgaccatagcagagaccactgctggcgcagagacgtagctgtttttcgcagcccgtccccgaaactgcagttcttcaggctatcacctacttgacgtttgatgttgagattcaccaactgacgatacgggacgtcccagcgtctagggtagagggaagcgcgaagaagtgggg

SEQ ID NO: 564032 - DNA, 291 bp, Homo sapiens
acccaaggaaatgagggggaagtacaaacccgtttttaaacccaatgcccaggattaaggcccccggtccctgtgggttggggtgatggtgtttcaccagtggggaaattggaatgggattactttggcccagggaagcccctggttttgtccctggaaactttggaaatccttttgcattaaaaggcctttacccccctgtgtaaaaggatgtgggaaaggagggtttgaagttgagctgctaaatgaaaatccctgctttgttggtcaataaaacgcttcctaatagca

SEQ ID NO: 564033 - DNA, 619 bp, Homo sapiens
agcgggctgtggctgcgccgggctgcgacactgcagtgtctacgcgggcgggccgggacaaggaggcgtggacgggtcgcatacgttcgtcccctcgcattgggcccgacgctgcgcaaggatccccgggcggggcgcgggcgtgaacgctctggggctcagccaggcctggcgggccgaggcccggagaacccggaatccggggtacggtttgacacagggcgcatatcttcaaagcactagtactcctacaatgtcacctgatacagaatcgttgtgggaaagactggggacacagcttgtaacatttgccaccctcagaagctgctgttcctgtgtcaaccaccttagcctcttgatcgaggaaagattctcgctgaagtctgtaattctacttttgagtactttatgaataaacacgtgtcttcaaaaccatctaccatgaagctaaaacattaccatcaaccctattctataatattttatacaattttctaatactcagcttatactatttttaaccatacaatcccgtttaatttttctccgaagtcaaaacaagacaaatcaaccgattaaagcaaaggcctgtaaaattccaaaaactgattcctggata

SEQ ID NO: 564034 - DNA, 1268 bp, Homo sapiens
  misc_feature (122)..(122): n is a, c, g, or t
  misc_feature (301)..(301): n is a, c, g, or t
gagcaaagcgctgagggagctcggtacgccgccggcctcggacccggcagtctcgcgcccggcgtcgcccgctgcccagagaagccatggagatcatggcagtgtgaccggtcctggccagntgcacggcacggcaccggctaggcgcattcggcacgaagtgctgagtcgtcgtacgtgtctcgagaatgcagtaatcacttcaaggccgtactgactccaacagagtctctgtatctgatgcagttctgatgcgctgtgcgtcgtgaccctgaggagacccactggcattccctcaggngcataccttctgaggaggtatggaggaaggaggaggcaaaacagattcgcagaatcctgcatagcaaagctcgtgccactcagtaacagactctacggtgcaggattgcagatgtgctcgctcgctcccacccacaccctagctggttaacacggtacggcatggcgacggtaggtggctgactacagacggctgacggtcctacagcggagggatacgtatgcggcagtccgtatgttaggaatacggattataccgaaaaggatttatccacgaacaagtgtgcccgactattaagccagacacgccatttgacaaagaatgtgctgtcttgtcacgattctggatgcatcaatgaggagagagtgcatgatctgctgatgccatgtttgcaggtctccttttatcgccaggcagcagacctgtgagtccagcccagggggacttcgcacgggggataaacgttcttagtgttgactctgacttcaagggcgcaggccggcactgtcctaatgcttagacccccttgaaagtgtgggcaaacctcagctggttcgcggcggacccgggacgggcggagccctatagggaagagaaacttgtctttgcagaacccactcgggaacccacccggatgaggcccaggccaccccgggcccaaggacccacggagaccccctggtcgcaaacattcgcgggggcgggctcgcagccggggaccagccgcactcggagagaatcccccatgggggagagccccccgggggaaacaccgaacgacagataccgcgggggaaacccctcggagaacgccctcccatctacaacgcccctcgtggccacacctgtggcgacccacccggcaccagctctcctgcgcccaccaacgcccgcactggcgcgacacaggcgcccgccactaccggcgacgagactcccacatacacaggcaccagcggacccccgc

SEQ ID NO: 564035 - DNA, 456 bp, Homo sapiens
  misc_feature (5)..(5): n is a, c, g, or t
tcatnactggcatttcagaatgtcataccgttagctctgtgaaatgtcctccccgaaaagttacaacgcacatgattactgaatgcttgacaacttaaaaattaaatacatcaatcatacctgttacagatcccgtataattttcataaagaaaccaatatattggccgggcgtggtggctcatgcctgttatcccagcactttgggaagccatggcgggtggatcaggaggtcaggatatcgacaccatcctggctaacacggtgaaacctcgtctctactaaaaatacaaaaaattagctgagcatgatggcaggcgcctgtattcccagctactcgggaggctgaggcaggagaatggtgtgaacctgggaggccgagcttgcagtgtgctgagatcatgccactgcactcagcctgggtgacagagcgagactccatctcaaaaaaaaaaaa

SEQ ID NO: 564036 - DNA, 892 bp, Homo sapiens
gctcgacttagcttgttcgtgagtctagcagcgcattgcgccgggtgggcccagtcgctgagcctgtcgcagcgaggtgcggcggtcagcagaagagtgcaaaccgagtcgggtggctcagtgatccaccgaccgttccccaggcagagcgcccacaaataccagttgcgactcctcagcgatctcgccaccaattcaagactcgtaggacactgacggtaggaagagcggacaggtgcggtcgagagcgtctcagacataagcctgatctttcatctagcaagttgattctataatacgaaagcattcactgcgtagtcctaccatgaagcggacagtttggagtctagatgtgggagagctagatcatcaaaggctcaagcttggggaggatattcggcgaattcctattcataatgaagatagttacttatgatgaacttagtgctaagtggaatgcgaacgcagttttgcgaccaggcaacacacttctcttgaggttacatgaatggacatgtgagctgactcaacagctcctcaagagcagtgcaaggattgcgaggaaccttacttagcgaagtctttgccgcactcagtgtccttgacccttttccctctagcgacattacaaagtctcggggtcatgtggaatgaccttgcacctaggtttggatccaatttcaagttctggtctacaataggagccacgggcgcaaggaaccactctttgtagaatcgaacgattccctgggttgagaagatgagtcctgcctggccgggagggaagacggggacatacgtacacttgttccgaagggttaggcagggtggacctccggtgggtacttgggggaatcaagcctgtgggacatcgcacttatgggagacacgc

SEQ ID NO: 564037 - DNA, 117 bp, Homo sapiens
accagatcccgaacctacctgctcctccgagcatttgagaaggatcgctttacaggcattgccaccagggaagagctggccagagagacgggcaccccggagtccaggattcagatc

SEQ ID NO: 564038 - DNA, 399 bp, Homo sapiens
  misc_feature (265)..(265): n is a, c, g, or t
gtgtgtacgagataagccccattttcccaatctttattatgcagttaacttcctatctccattcttacccaccaccatccactctccaaagggcagagtgaccttgttaaaaacaaagctgatgtcgctcctccgcttaggatctgaaaagctcacaatcactcagagtcctgagcacacgattcaagtcctttattcatcatcctgtggccccagccagcctcctgctcatcacagccactcccttttctgccagaggaccatnccaagcactgacctctcagaacataccatgctctgtccaacctccacaccaagcactctccacctggaacattctcctccccttcccttcctccctcttccttatctcgtacacacgggatcctcatagagtca

SEQ ID NO: 564039 - DNA, 105 bp, Homo sapiens
tgagacagatgattttatcttggggactgacccttcagcgtcaaagaaatacatatatactgtatccgccaaagtttgtgatgcctgcatagacgcttacttgta

SEQ ID NO: 564040 - DNA, 165 bp, Homo sapiens
tccaaacaccgcaatctaacccgcatctctaataaaatacaaaatatgccggggtggtggcacatagctgtaatcccagctactcaggaggctgaggcaggagaatttgcttgaaccccaggaggcagaggtttgcagttgagccgaagattgcattctttgtac

SEQ ID NO: 564041 - DNA, 461 bp, Homo sapiens
actgtccgttgaattgggccatgaactatccagaaccagactagctcctcggaaatgcattgccttcgatattgctcccctttgcctagagccctctaactgccactcaggattcctctcaaacttgggcactcttcttactgaaatagtctctcaactttcctttcccacttgttaacagcaccagccttaaatattccaactgggttttcagcttttcttgtatttcagtgtttcttaccctggcttcacatttgagaaatcagacacttgggccttaccttcaaagattggtctcattggcctagagtgtcctgattattagcatatagttttaaagctccccaggtaattctttataatgcaaagctggggttaaaaaccacagcttccttcctgcagcttttcccatcctattcctggagtgggtgtcagcccttttctactgacaaaggcctaat

SEQ ID NO: 564042 - DNA, 636 bp, Homo sapiens
  misc_feature (278)..(278): n is a, c, g, or t
aaccattacagggagctgggacacttaacagatgcaagtgctactgatgtttcatgcgaatcttttttagcataaaattttctactcttttgtttttgtgtttgttctttaaagtcaggtccaattgtaaaaacagcatgctttctgaaattagggcccaattaataatcagcaagaattgatcgttccagttcccacttggaggcctttcatccctcgggtgtgctatggatggcttctaacaaaaactacaccatgtgattcctgagtcgcgcaanactctttccccacacagatataggagggatatcccaccggggataaatagcgcggccgtggtccgctgggaggaacatgcgggtgggtccatgttgcccttccatagcctaatccctgggcattgttttccactgaggtggggggtggggtgtactagttacacatcttcaacagaccccctctagaaatttttcagatgcttctgggagacacccaaagggtgaagctatttatctgtagtaaactatttatctggttttgaaatattaaaccctggatcagtcctttgatcagtataatttctttaagttactttgtcagaggcacaaaagggtttaaacctgattcataatcaat

SEQ ID NO: 564043 - DNA, 178 bp, Homo sapiens
  misc_feature (56)..(56): n is a, c, g, or t
  misc_feature (59)..(59): n is a, c, g, or t
  misc_feature (92)..(92): n is a, c, g, or t
cctgtgcaacctgctgcccctgccagggataaagcatctcaaaacgggtcttcagnaancctgaccctggaggacatcaatgccatcctgcnggtgcctaccgccagggtccccctgcatccccgactgccagcccagagcccccgcctcctgaataaagaccttcctttgctaccgt

SEQ ID NO: 564044 - DNA, 153 bp, Homo sapiens
gcgccgcggtgttcaggtcttgaggctgtaccaacttctctctcgggcctcggaatcaacttcctcttcaacaaccctctcagggtccaaacctccgaatcttggagagaggctctccttcccggggcccacgggcaactttcgtgtctcaaa

SEQ ID NO: 564045 - DNA, 194 bp, Homo sapiens
cctagaggacccgctgatcggctagggggggtaagagctatatacatgaaaatgagtcttataaattaagtgagtgcaataaaagccttgtactataagacattctggaatgtttgtttaataagggtattatcccatttgatctatagccagtgtgattttatttttaaaaacgaaacagccgtgtgttttct

SEQ ID NO: 564046 - DNA, 229 bp, Homo sapiens
gattcacgcttgcacgctagacactagacaagctagataatagtcaattaaagactactaatcaggttgtgaacaaccatcagaggggaactagcatagaccatatattatcctcatagtctttctatatagtagatttgatcatcatcattttgtagatggccaagactcagagagggtaataacctgcccttattggttttctaccgattaggcggtaaaacgcttg

SEQ ID NO: 564047 - DNA, 1118 bp, Homo sapiens
cttcacctaaggtaccgcgatgctaatcggctatggccattcctaatgcttaccgaacgaacaatgctagtgctatatacatacctacagcaaaggccccaacgttcgtagtgcccctaggggctactacaaacccttcgcggacgccataaaagtcttcatcaaatgagcccctaaaacccgtgacagtctacgcgatcacacctcctatgatcagctcgactccacggagacttattgctctgcaccgaatgcagctacttgctaactagtgaaacctcactcgctgcacgccaatagagcaagctgccgtgggtacaatcttcaagcaaggacgctacgctactaggatggctaacacgcaggcttgtagctctagctcgatttactaaatatacctgtgactcagggcatgaagcctggagtgtccacccatacttgcgcgtgatcagtgcgccatgaaaaaagatgggccacatgacgaaatcgtcaattaagtgagagatacgtgcacgtgacgcacattcatggcgtgactgattggaactagtctatcatcatttgaagtaagcgacgcatcttatacttgcgttcgcgagcgcattatacatgacattaggatgcacactctgagttagctccgtgaccactgatggatgcttctatatgactgggtactaaagccctactttacgacaggaccattcgcaaataccaatccgctgtgttcctcagctgaattaaccaagcctagtgccgggactagtctagtacgaaaggtgaaactcgtgtgacgcaagatcgggcctagtccgatgctacaaacgcttgtatagtcccacacttaaacaggtaacatctgcgtaagagaagtttcaccggcagcagacgcggaagtcccaagctgagcctggtggacgcaaaaaacgggtcgaccctgctctgttgtgatgagtttgttgattttgcccgcgtcgctttgaacccatgtggacggcctctttgatcctctgcccaaccctggtttgttgtaaatatgccgcaactctaggagccacattctcgcggaacgaaataggagaaggcgagaaggccgcggcgcaattcccctataaaag

SEQ ID NO: 564048 - DNA, 1209 bp, Homo sapiens
taaacaacgggtcatcaatttattaaaatagttgacttaagcatctgcacagggggactcccccctcaactctccgtggcctcaaatacgtgatgtggaagtaactcgtgcttaacaatctctctcagaaaggactgtgtgtgcaagttcaagtgacgtcgctggtgtgaatttctctcactctgtggaaacagactccccgcgctcttataaacaccctctctcaccacacacaagcggcaggcgtcttcctctctgtgagaggagagatatctctctcacaagagctctatgtggagaggcgacatatctcagacacctgtgggcgtcctctatctcacctatctgtagaagatatctcttcttctctatattgtgacgcgcctctcttatatctcacagacgtcatcacagacacacacacacctctcatttcatcacacaggggagcagtatatctcacgccgccgtgtgtcgcgcgcgcgtcatagtgctgtctagagagcgcgtagactatctcgacaagactatcttcgcgagagagacactgtcgtcgcgcaccccctctcccccgtgacttctcccccaaccgagagaagcgtagacacgtcacatcatcaccgcggagagtatactctctcataatacaaaccagccgccccaatgttgacgcggagtagcaacgccgcgcggcgccgccacgcggcgctctcccacgagtagaaaccaccgaggagccctcttgtgtgtccccccccctcgagaggcggagaacagtagcgccgagacacacgacagcgcgcgagatgaagaagcatctccacgccgaagacgaacgacagagcgagccgcgcgttgcgcgggacgacccccacaaaacagacctctccctacaagagccccccttttccacgaaaaccgcggccgcgtacctctactacgccgcgcgccgaaacagcagccgcggcggagacagagagcaaccccgcccccctacgatgagacaacggggccccacttcgaacgagccacaagccgccccataaccgaaagacgaagttcctcagccacgaagagggatcagaagcggggcagaatcacaccgctggccctgtgggccccccaaagcccccccaaacaaaggaggccgcacacacagacgcccccggccccccctcaaataacccccggcctaggcgcgcaaaacct

SEQ ID NO: 564049 - DNA, 265 bp, Homo sapiens
aatataaatctacatctttatctccatgatatcaattttatatagctccaggggacgcgagtccataactgtggtctctatacatgaacctactgaactgaaatatggcccgctttgatttccaggagcataagctgctcatataagtgagaacatgcaatagttttctttctgtgcatggcctagttcacctgacgttatgacctttaattccacccaattagctgaaaatgacaggatttcatttttttatggctaaatacta

SEQ ID NO: 564050 - DNA, 278 bp, Homo sapiens
  misc_feature (16)..(16): n is a, c, g, or t
catttccttcctccantaaagtcttgaaatcctcaaagtcatccatgagggttggtatcagcttcttccaaactcctgttagtgttgatattttgacctcctcttataaaccacaaatgttaatggcatctagaaaggtgaattattcccagaaggttttcaatttactttgcccatactcatcagaagaatcaaagtctatggcagctatagccttataaaatgtatttcttaaagaacaagagttaaaatccgaaataaaaaatttgatccataaa

SEQ ID NO: 564051 - DNA, 127 bp, Homo sapiens
acctgaggttacctgatcgacaccggcctcgccacactgtttataccttgcctctactacaatgacacagcctacctgataccggtgccgcatgactgtcatcttaggtactactgtcttatgctgt

SEQ ID NO: 564052 - DNA, 3755 bp, Homo sapiens
ccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaaaggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatctagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttcctcaatgatgcattttaacttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaatttttttttctcactctaaaagaggtgtggctcacatcaagattcttcctgatattttacctcatgctgtacaagccttaatgtgtaatcatatcttacgtgttgaagacctgactggagaaacaaaatgtgcaataacgtgaattttatcttagagatctgtgcagcctagattttacctcatgctgtacaaagccttaatgttgtaatcatatcttacgtgttgagacctgactggagaaacaaaatgtgcaataacgtgaattttatcttagagatctgtgcagcctattttctgtcacaaaagttatattgtctaataagagaagtcttaatggcctctgtgaataatgtaactcagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaacccaaagctattccaaagatttcaagctgttctgagacatcttctgatggctttacttcctgagaggcaatgtttttactttatgcataattcattgttgccaaggaataaagtgaagaaacagcacctttttaatatataggtctctctggaagagacctaaatttagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtg

SEQ ID NO: 564053 - DNA, 1515 bp, Homo sapiens
ggcggcggggatagtggcttctcgcagactccgtgagctactgaccctgggcgactgacagggcgtccaagctaccacgggactcagtattagccttcgcctcactggctcctctgcacaagaggcggcttccgagagtagccctcgagatgaaagcccccagaccagcaagctactgagctcccgttcagctgtgatcgtctgctgcatggaaacatgttctgcactgtccagctcaagctaggtccaagcgatacgaggaagtgccatgagagcaatggtcttcgtggagtagagatggtatgagctgctatcggaagcgaagcatctatctggacgcagtactgcctggaactcgctcgtggacgtgatgggctgatactcctgagttgacaggaacataccaatgcttccatctgacgagggttattcgaccctgaatgcgacccctggactttcgagtaccatccttgccagacccacaaggaggatgaagtgggtggacccccgggcatgtcaaggcgtgtgcgatacccatcacggttctgcaacgatccaatcacgtcgaaatacccagtgtgagagccttgtctaaaacgtatgcaatcagagaagggggtgtctcccctcgaaaaggccgccgttggtacatgtgacttgtcccagttcccacatgggtgtgggccctgccattttgggcgccgtggaaggacgctggttagagaaccgcgttttggttcgaaccagagacccttgggtagaaaccaatttctccggagttaatccatcgcttgggccccccaaggggcaatttggccgtatactcccttatccccaatggggttggcacacgtgaccgcgtttgagggaacgaggataggggggatcagtaggaggccgttggacgcaggataatgtttaatgggaagaacctaacctcgtggcacaagggcaggacgtcttggccgccccaaaaggagggttcaattctgcggagaaagacccttatagaccggcccctgagttccgaacagctggaaatgccgttcgggtccctttttcagaccatgtcgccccagcacataagagacttgacgtaggcgtcggaacccagaagtgtgcccccccttggtggggccacaggtttggggagccttaggacgatccaacgtgcgcgccgcggggttggttggcggccaatgtaacctgaacacaggtgaatgcgggttcgagttggccctatgtgggatagtttagctcttggcccgttgtaagtgccggccttgagtacggggggaccaggaagcggtaatgtttatcctcacggacattatatgaaagacgcccccgagtttggtgcgggagttgtgtcaatagatgaccaccccgaaaggggtgctaagatacacgatcgttgtggtatatatgttcgcctggcggaaaaccatatattgacgggataggggcccgtaatgaaggtcccttctaagctataccatgtgtggctggtctacg

SEQ ID NO: 564054 - DNA, 349 bp, Homo sapiens
tattacttttattttgcagcctttggtttgttattagcgtaagagccagtataggatatggagaggcccctggcttcatgagaacaaaggcaggcccaggttataattacagctttctcctgccccttctttactttttctaccacaggtttttcccctggttgttttcctcttgcccccatttggtaacatttaaaaaattttcctgcccccagtagtttcatatcctgtagacatcctcttagggcattttccaatttccaaataaaaaatattcatctatggagttaattaaagttaaagtttttgcaggtcaactactccaacttcttaataccttttcctgaga

SEQ ID NO: 564055 - DNA, 200 bp, Homo sapiens
gggcagcgtgctatgatgctcagctaactttggtattttttagtagagatggggtttgccatgtcggccaggctggtctcaaactcctggccgcaaggtgatctgccatttgggcctcccaaagtgctgggattacaggcgtgagccactctacccagccaagtctaacattatttcaaaataaacattttttaaaaaag

SEQ ID NO: 564056 - DNA, 661 bp, Homo sapiens
aaagtttggacccccagtgcttacgacccggcactacgtgggctcagcagctgcttttgcagggacaccagagcatggaccaattccaaggcagtcctggtggtgcctatgggactgctcagcccccacctcactatgggcccacacagccagcttataagtcctagtcaagcagctcagagctccttcggcaattccctgcagtgcacgtacctatttcaagccaccaagccaccaagccctaatgctgtgcaatggccacactttcagcccacactcagacacaggtgttcctccacagcctggtggtgccctgtcccttgcacaaagcagatggaacaatgctaaccacgcagactggcttctccgactcatcctctttgcgccccatgcacccccacggctctgcatccacgcccctggagctccttgcttgccccccagcttccctgtgcagaatgcagccagcacggaaaagtcgggctttgcagctaaccagccaacctggccctcggctccccttcatccaacacagccagaacccgcgattttaccacacagtgaccatcagattatattttcaacaccacaccccccaccccattcgtgggtgagggtatcccctgtgtgtcccaggcccattaaatctacctgccactga

SEQ ID NO: 564057 - DNA, 675 bp, Homo sapiens
  misc_feature (16)..(16): n is a, c, g, or t
  misc_feature (78)..(79): n is a, c, g, or t
  misc_feature (235)..(235): n is a, c, g, or t
  misc_feature (241)..(241): n is a, c, g, or t
  misc_feature (261)..(261): n is a, c, g, or t
  misc_feature (282)..(282): n is a, c, g, or t
  misc_feature (452)..(452): n is a, c, g, or t
  misc_feature (492)..(492): n is a, c, g, or t
  misc_feature (506)..(506): n is a, c, g, or t
  misc_feature (518)..(518): n is a, c, g, or t
  misc_feature (552)..(552): n is a, c, g, or t
  misc_feature (555)..(555): n is a, c, g, or t
  misc_feature (557)..(557): n is a, c, g, or t
  misc_feature (568)..(568): n is a, c, g, or t
  misc_feature (571)..(571): n is a, c, g, or t
  misc_feature (587)..(587): n is a, c, g, or t
  misc_feature (591)..(591): n is a, c, g, or t
  misc_feature (634)..(634): n is a, c, g, or t
atctaccattatagangtgctggcggtcaatacaatgcattacaaccatgtccaacgcacagtctagtatcaaaatcnntctacactgtagagtctcacgaaactctcaatgacatcaaacactaagccctccagacaccattcttttttttctgccaccacattaggaacgtaaatggacaatccattccaactcgcagcctccatccatttctagtatgaaattaagtcattntctacntatacaataaagtatatctncacggttctcttgattttganccaaagcagccaaggcactctccataagccgacccacaaacttaaaagatttttaaagcattcaaacaaaaaataataaaaaaagaagtaacaaataaaagtttaacagcaacaacaacaacaaaaaagacaacacaatgtttctgggacaatggcacaccctgtttccntttcagggacatccaactcagacatggaaagaaccggagnaaagaaagccagtnctcatcccaggngaaaattcattttttgtttttttcagagggaggnctntnccaaacctccnctnccgttcttgttttgtnaaanaattaacttgcacagcagttggagttctccccataacttttcngcccccaaagagcatgccaaaaaataacccataatttctca

SEQ ID NO: 564058 - DNA, 147 bp, Homo sapiens
aaaaggccccaagagggccttgggccaaggtttttttgaaaagcctttccaaaaaattgtttttggggggggtttttcccccccccccccaattaaaaaaagggttttaaagggtttaaaaaaaaggtttttttttttaaaggggga

SEQ ID NO: 564059 - DNA, 493 bp, Homo sapiens
ccggtccgcacgatgcgtacggtagtgatgtcccataagatattacctgttttagcaacctttacacattttatgcactgtaataggtgctaagaggaaaaacaggatggggaaaggaggagtggcagtatcaatagactagagggtcatcctatttgtggaaaattatattgtctacttcaaagggtcctgaatattagtccagtccttactgcccagcacttaaggaagagaggtctaatgtgactgtatggggcgttagaattaggtaccagaggaaaagctgttgcccaacagctccaagggagaaggagctgttgctcttcaggaagacggatactcgtatggtagagtagacattaatgggcatggcacatatatagtgtcattctgctactcagagctcaatcttgtagtcaaatcgatcacagtcagtccaggaaatgagggggaatgatgccagatcccgtccaaacaataacagtttacctta

SEQ ID NO: 564060 - DNA, 437 bp, Homo sapiens
tgacccatgttgaatctgtttgtccgagtaaaccagtagagctttctggtaagtgtccagatcatgtttatgtctttatcaacagtgttatatggactaatacaatcactctatctaatgagatatattattcgcttaccactgacaaatctctctcggttcttctattcgatcatgttactgatagacgcttggctatcggtctcggttgtgtaacctgattcgtcatatgcttattgcttgaatagctgttcttcttttaattttacaacaattttactatttctccttacatgtttataagtcatatggagactccttctcatctaccctgaccccagaatattaaaacttttcagagtttcaggattaattccattatatggacatgattccttgagataggaaaaactgattggattgtgacattagactta

SEQ ID NO: 564061 - DNA, 480 bp, Homo sapiens
ccacgagatttgaagagatttattctgagcaaacatgagtgaccaatggcctgtgagacagccctcaggagaccctgagaacatgtgtccaaggtggtcagcctacaacttgttttttacattttaaggagactaagacatcaatcaatacatgcaagatgtacattagttctgtccagaaaggcaagacaactggaagtagggcttgcaagtcaaaagtcaaaggcagattcaaagatgttctgattggcaattggttgagttaagtaattgtctaaaggcttacgatcaatagaaaggaatacctcggttaagataaggggttgtggagaccaagggtttattaagtagatgaaacctcaagatatcaggcttctgagagactagattgtaaatgtttcttatcagattgaaagagtctcttctattagacttaagatctgtattggtgttaatgctggtcagctttttctgaattcc

SEQ ID NO: 564062 - DNA, 862 bp, Homo sapiens
  misc_feature (119)..(120): n is a, c, g, or t
  misc_feature (697)..(697): n is a, c, g, or t
  misc_feature (718)..(718): n is a, c, g, or t
  misc_feature (809)..(809): n is a, c, g, or t
aaccctcagttctggtaattgctcacacctttcccgggaaacttatgaataatctaccccttgtttagcatataatcaataaataaccataaaaataggcaaccagcagcccttggggnnactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatggctattagtaaacgaacgcttaagtaactctagtacatctatgatgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagccttatagnagtgtctatatttagtactanaaggcagagagatccagggtcttgagtacactgtacagtgcacccagatgggagctgatggctcgatgttcgtgctcgaacgttacgtcgntagtgctgtttgaacgtaaaccacgatctttgcagaggtctaggtcccgtgaa

SEQ ID NO: 564063 - DNA, 614 bp, Homo sapiens
agcggagatgttgtgggaggccgccccaggcggtggagctgcaggtgcagagggcctcggtggcggctcagcgcccttggggagcactgagttgccgggcctggtgtggaaatgtgaccggtttgtgcctggcctcgtcagtgttgaggacctggaggaaacgcagatcttgggtggggagacaaggcggagagaacgaggtgcattggaacagtccaggcgaggggtgctggcctgcttgggggcaactcagaggcctggaggatagatgaggaggggggctgtgggccttgtaggtgttggctgtggccgtgcctggagtggagggacccttgaaagtttggcctcagctcgggacactgatgttcccgggttggcccttcatgagagtttggcctcagctcgggacactgatgttcctggtttggcccttcacagctggtgggcggggggtgctttggggagaggctgccctgcgcatcagggcatcaagacacaggggagtgaatgaacctggggctgcagtttcacctgggtgtggccctggctgctggggaggggccgtggctctgaagcctcatgattggccaggggagctggcatttctgttctgc

SEQ ID NO: 564064 - DNA, 264 bp, Homo sapiens
gactcgcatctgcccttgtgctttctcacccttcactctccaacttctataaataacctgtacagtggccaggcaccgtggttcacacctggtaatcccagcactctgggaggccaaggcgggcggatcacctgaggtcaggagttcgagaccagcccggccaacatggtgaaaccccatctctaacaaaaatacgaaaattagccaggtgtggtggcgggcatctgtaatcccagctacttgagagtctgaaggcagtctgga

SEQ ID NO: 564065 - DNA, 250 bp, Homo sapiens
tggtacagatagagtctcccaatatggcccagtcgggtctcaaattccgggactcaggtgatccaccggcctcagccacccaaaggtgctaggattataggactgagaccattttattcacaacagtcttctaactcctacacttaaagtttaaggattggaaagggtactgtgtccacctcccggtgtccggcctccgccggatggctttcctttccaaaattgttacgggtgcacgacagcccaaaag

SEQ ID NO: 564066 - DNA, 299 bp, Homo sapiens
cgtcgacggtcacagtgagtatacatggtctcagtgagtatacatggtcacagtgggtctacatggtctcagtgggtctacatggtctcagtgggtctacatggtctcagtgagtatacatggtctcagtgagtatacatggtcacagtgagtttacatggtctcagtgagtatacatggtctcagtgagtatacatggtcacagtgggtctacatggtctcagtgggtctacatggtctcagtgggtctacatggtcacagtgagtatacatggtctcagtgggtctacagtcgacgc

SEQ ID NO: 564067 - DNA, 197 bp, Homo sapiens
ttctgacatggcctggataattttccccataggatttggggattaacattagactgtttgcatacttacgcaaatttctgcagccagcgttgaatttctcccagaaagtgggtttttcttttctatcatgtagtcaggctgcaagttttccaaactttcgtgctctgattcccttataaaactgaatacctttaaca

SEQ ID NO: 564068 - DNA, 1122 bp, Homo sapiens
tatcgttatttattatcaaaatcatgaccagggtgtgttagacgattacttgctgaaaatatacagcaactgggggcttataacacatgtgagcaaagatgacatttaacacgtgtgcacgtgtctcacatctctgtggggctctagaaggctcaagaaacaaagactccacagacaagaacgtttacttaaagcggacccctgtggcagataggctcccgaattgtgcaagaatctcattccaattctccagcatgtggttcaggcagcggaaattatttcacaagaaaagaaacccagacaaaggtcctctcgtgagcccgctaagagttcaacaaggcttttgtcattacacacttatgtgggaaacgcccacggccccacattaaccctgttgaggaacacaggttccagtgtcttgggctataacacgggcttcctcaccgctgtggccttcaaaaccccgtgggccagtgtttccctcgtggctcttccatccccaccacaagcgaagaagggtatgaccgcacgttatatatagtaaagaagaactttgaggccgcaggacagggccgcatgcagcaaagctctcggggtagggcctaacggttccacccacctgagcccgtgtccccaagtgcacaggagcttcccaaatcctagagacatgactgtacttagaaacgttggtccggttacgagaacctggtttactgacataatgtcccctcatggagattttgtcacacttcccctctaaacgagaaaagacaacgcccatgttggggcccgggacatactcgaggcatgtagcaggcatatccaaaccttatgggcacaaccgtggctttgtgtgcactgaaacccgcatgtttccaaaagtcctcccggaccaaggaccgtgtgacctagagttgtaaagacaccgtagcatcggtgacagcgcacccatatgtgcgggggcaaaaatcgtagacgcgactctacaatacagggcacctaaaacgccgtgatgaggacacgtgtggtgccaccacattatgtggtccccccactaaatgtatactaagacgctcatatacaggacccagctacacacttctaaaagaactagtcgacaac

SEQ ID NO: 564069 - DNA, 476 bp, Homo sapiens
  misc_feature (50)..(50): n is a, c, g, or t
agttttatgaaggaaaatgatttaaaggaattaaattattaatattatanaattaatatttttcacaatgtatatcattactttatgtttattcactttctctggaattgaattccacatttgaatggaattaaaataagactatcggtcttatggttttctggtttacagtgccaaatgttgatagaggctgggcatgatggcccatgcctgtagtcccaccactttgggaggctcatgcaggtggatcacctgaggtcgggagttccagactagcctggccaacatggtgaaaccccatctctaataaaaatacaaaaattagctgggcgtggtggtgtgcgtctgtaattccagctactagggaggctgaggcatgagaattgctggaacccaggaggtggaggttgcagtaagctgagattgcaccattgcattccagcctaggtgatggagtgagactctgtctcaaaact

SEQ ID NO: 564070 - DNA, 815 bp, Homo sapiens
  misc_feature (463)..(463): n is a, c, g, or t
  misc_feature (465)..(465): n is a, c, g, or t
  misc_feature (540)..(540): n is a, c, g, or t
caaaagaccgctctgtaacaggttaaagcaatgtgtggacttcatcaaaatgaacacttctgctttttcaaaggcctgttgaaaaaacgaaaagacaaaccaaagactgagatgtttggagatgatgtatgtaaggatttatctccagagtataggaagagctcttgaaactcagcaggaaaacaatccatttttttaaatgggcagaaaacaatttggaaagaccctttaccagggaagataggcggcaaacaagcctgtgaagaagacgctcggcgtcgttagtcatcggggaatgcaaaggaaaagcacacggaaatgccactgtgcctctcggactgctttcaattcaagactgagcgtaccggtgccgctgagagtgggaaggagcgcggactggctcaaacactttggaaaatggttggacagtttctaaaacagttaaacgtgcaccttccctgtngnccagccttccacagctggtatttgtcccggcacagtgaaagcccaggccacacagacttgccctggacaccattngaatgcttctccacagaggagcgggcactaaactggcatctccccagaacaggccacttcccaggttcagaaaggagcgggcacaggcgggcctcagaaaacgacgcagagtgaaagaagcggagaagggaggagagtgaacgagaggcttccacttgtgtcaggctctagaaagtgcagctcagtcacgggacagatccaggggtgccgggaagccctgagagcgctgcaggcacaggagcgccgcagcaggcacacgcgcaggtaaacacaca

SEQ ID NO: 564071 - DNA, 324 bp, Homo sapiens
tgtgggtagcaataaggtacgggtccccaggttggggagagccccaagttgagaacaataattgaacaattactgtatgtaacaatggttgagatacagcgtaatcacatgcaagctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 564072 - DNA, 125 bp, Homo sapiens
cccaatcacttgattgcgcaatatccttccgcatacaacggactgattcacctgcaatgactgtgggcgttgagccggcagccgacggcaaagtgtgtcgtggtggtcattaagactggagatcc

SEQ ID NO: 564073 - DNA, 138 bp, Homo sapiens
gagcactaggataatagcttatgcctgcggggtgctaatacctaggtgatgggttgacaggtgaagcaaaccaccatggcacacgtttacctatgtaagcaaacctgcacattccacacaattatcccggaaccacag

SEQ ID NO: 564074 - DNA, 145 bp, Homo sapiens
ggcacgagctattataaaactaccaaacataaaccattagaaccacaaatcagccaaggctggatgtggtggctcacgcctgtaatttcagtacttggggaggctgaggcaggtggatcacctgaggtcaggagttcgagaccag

SEQ ID NO: 564075 - DNA, 455 bp, Homo sapiens
  misc_feature (9)..(9): n is a, c, g, or t
  misc_feature (48)..(48): n is a, c, g, or t
  misc_feature (56)..(56): n is a, c, g, or t
  misc_feature (91)..(91): n is a, c, g, or t
  misc_feature (101)..(101): n is a, c, g, or t
  misc_feature (131)..(131): n is a, c, g, or t
  misc_feature (190)..(190): n is a, c, g, or t
  misc_feature (196)..(197): n is a, c, g, or t
  misc_feature (234)..(234): n is a, c, g, or t
  misc_feature (337)..(337): n is a, c, g, or t
  misc_feature (390)..(390): n is a, c, g, or t
  misc_feature (437)..(437): n is a, c, g, or t
tctcgcacnctgttcttccgccgctccaccgtcgcctttctctcccgntcgcaatncaataacagatcacccccctggtcattgacaatcnctccgccatntgcaaaccttcttttgcttgggacgacacncccctgaaccgtgtttccttccatcgtcgggcgccccaaacaccaaggtcgtcatggtncgcatnngccagaatcactcctacgtgggcgacgagacccagancaaacgtggcatcctgaccctaaaataccccattgaacatggcatcctcaccaacttggacgacattgataagatctggcaccacaccttctataaagagctnctcgttgtccccccaggaacacccattgcttgctgaccgagagcccctctctngaacccacaaggccaacaagattaaaaatatagacttcagattaatngttatgtagacctttcaa

SEQ ID NO: 564076 - DNA, 180 bp, Homo sapiens
tttaatggtgtgggtgaacatctggagtctgtggagatgctagagaccttgttatctgttgcaccgggaactcgtggagactaatggcttcctctttggtcacaaaaatagtggataatcttggacattcgggtggcaatgtctgctccatgttccttgcggggcatccccatcccgtag

SEQ ID NO: 564077 - DNA, 438 bp, Homo sapiens
aagcgtgataattccccaggtagcatccatacttggagaggataacctcccgttagaagaaagaagctgtagcactacataaatcaagcttagtgcctgtattacctgagtcgtgaatagagccaaatatgtcatataatctataccaataaaaccactggtccagaaacacgtctatcatattctttgtaagtaagactctattggctgtatacacccatgaattatggcatgggtatctatttttcatttttacattgaaaaaaatccagtggttgcttatgaatgcatcaagtaaagatgaagaaaagaatacatccgatgcgtagattcttgaccatgtagtaatctataaaattgctatatcctcctgatagccatgggaaaacattataagatggtcattttattttgcagttagaattataccacgatcta

SEQ ID NO: 564078 - DNA, 263 bp, Homo sapiens
ttgtctgctttcctaaggattcccatgagttcagctgtgacgttagcttcaagttccgccgcatcctcacagtgacgggcactacataaagcatgctgggaattggcctgagagggttgaccgatttacaggttttgtttttcagcattccgtcgttcttactgagtctgcagcgggggagtgaacaagtgtgcagatgtaagttcttacatgataagcagattgaatacaacaccagcagcagactcagtaagaacgacgga

SEQ ID NO: 564079 - DNA, 659 bp, Homo sapiens
  misc_feature (6)..(6): n is a, c, g, or t
  misc_feature (147)..(147): n is a, c, g, or t
  misc_feature (165)..(165): n is a, c, g, or t
  misc_feature (218)..(218): n is a, c, g, or t
  misc_feature (222)..(222): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (252)..(252): n is a, c, g, or t
  misc_feature (314)..(314): n is a, c, g, or t
  misc_feature (322)..(322): n is a, c, g, or t
  misc_feature (353)..(353): n is a, c, g, or t
  misc_feature (364)..(364): n is a, c, g, or t
  misc_feature (378)..(378): n is a, c, g, or t
  misc_feature (411)..(411): n is a, c, g, or t
  misc_feature (416)..(416): n is a, c, g, or t
  misc_feature (448)..(448): n is a, c, g, or t
  misc_feature (462)..(462): n is a, c, g, or t
  misc_feature (482)..(482): n is a, c, g, or t
  misc_feature (499)..(499): n is a, c, g, or t
  misc_feature (511)..(511): n is a, c, g, or t
  misc_feature (527)..(527): n is a, c, g, or t
  misc_feature (545)..(545): n is a, c, g, or t
  misc_feature (549)..(549): n is a, c, g, or t
  misc_feature (554)..(554): n is a, c, g, or t
  misc_feature (562)..(562): n is a, c, g, or t
  misc_feature (564)..(565): n is a, c, g, or t
  misc_feature (568)..(568): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (587)..(587): n is a, c, g, or t
  misc_feature (636)..(636): n is a, c, g, or t
tatgtngaaaagcaatttattccattttaagcacttacacagttagtcatggagagtaacaggccttctggtgaaacaggtcacccaaaatggagatggcatcaaactagtggtcaaggactaactcctaaaaaaaaaaagcaactnttatcaaggattaatttnatttttaaaacaaatacaagttattgattcactcttctcaacttgacagtttncctntngtataactntnaggtaaaaacatacatntttacaacttggtggtcccaagttaaaaaaaaaaaaaaaaaccaacaacaaaaaaaaaaacnccatttcncagacaggaaataaacaacatgaaaacagcncaagaaatacnctaacgggcaaaantttttttttttttgggggaaggggaacgttttnttttnacttaacttaagaaaccaagggggaactggtnttcgtttgaaaatntgcatcctggaaagtcaggngtcaagattttcgagtnggaatctatacnacttgaatctcccccnatttcctgaataaaagtnacanctttnagtttttntnnttnatggcncanacnccnaccncatttggctctattccttactcactctagcctttacttaaatgagtttnaaaaacttggggatatagcataa

SEQ ID NO: 564080 - DNA, 298 bp, Homo sapiens
gggtcatctagaggatcccgaaaaagtgtgtggttaagccagtcaaattatgacaaggttaaagaagtaactcggggaaaagatgaaaatcccgctctgtttcagggtcttttagttgaagcactcaagaaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaac

SEQ ID NO: 564081 - DNA, 267 bp, Homo sapiens
ttaatgtatacgagaagactacgattatcggggtgagtgccgagagacgtgtgctaagtccacttcgagccacgtgagaagaatatactactagagtggcacagcagagctattgtgctgtgtgtctcaccctccaaacctaaccctgtctttaaagtgtttggtgcagcacctttggagaatgtggcgcgtaagtacaagagcatgtacaacgaggagctggagtcctgctctggcagaacacgcccctgcgccacaggaggttaa

SEQ ID NO: 564082 - DNA, 131 bp, Homo sapiens
agatgttcatgtactatactaacattagtctctataggtgatagattggccattggtgtagagtcagtatatgtagaatataaaggagtgggtgttgagcttgaacgctttcttaattggtggccttaagc

SEQ ID NO: 564083 - DNA, 455 bp, Homo sapiens
gactttggcagtggaggttcctgtgctctccggtcgctggaatcgggaacctcgcccgcttcggttcctggtcgcagagaaaggtgcccgcttggcctctctcgccctcgcgagctcttcatccgtttaagttcctagacgccgttgcgtttgcggaccgatctccgttttcagaagggagccatgtcctcggccgccatgtctaaatacgtgaacgacatgtggcccggctctccgcaggagaaagcctcgccgtccacctcgggctcgggccgctccagccgcctgtcgtcgcgctcccgcagccgctcttcgtcccgcagctcccgacgcgactcccgcagctctagccgctcgtcctcgcgcagccacagccggccgcggaggagcagacggtcccgatcccggtcccgcaggcgccaccagcgcaagtacaggcgctactcacgctcgta

SEQ ID NO: 564084 - DNA, 655 bp, Homo sapiens
cgccgatggttgggcccctacaagaccgagcccgccacctgacctcgcgcgctgcatgtgcgactcaactgcgatgagtggtgcctgttgcatgacgtggacctacctgcatggactgagctgtgccggcctgcgagcagaccgggcctggaaggccatactgccctgggtgcttggacaccataggaattagctttaagcgacttgcgccaaatgctccacacctgaccttgtgagtggggtgctcttgagactggtgactgacgattcttacagttgtgtgtgcttgcagtgacctgacgtggattgtgtgcacccttgtggagcagtgtcgttgtacttcactcgcgttatgtgacctcgagaccttgtatctacaccgtccgccaattggcactccattggtggacgccatcctccgttggagtttccgaaccattttgaacccacaaccctggattggtggcctaacttgacccaactttctcagcgattcctttggcgcccacaatggtcccctggtgggaattacacaaattggaacgcgtaaaaggaaggaatatctggttatgccttgggtaaacccctttggcctgttggtctcaggcgttgggcaatgacgtcccccattcgggactgtggttgggcctttggg

SEQ ID NO: 564085 - DNA, 229 bp, Homo sapiens
atcctcactcccttcgtactcatctcacatttctactccttcgttatggctgcatcaagtgccctatgaaatagaaactgccttcagataatatcaatttctatcatcagtcagctatccataatcagtacactcatctcaaattaccgcacgcacaagttgctccatatagcaagttatgctctgtcttttaacaggcactccacatcccacacaagccatgcaagcc

SEQ ID NO: 564086 - DNA, 1002 bp, Homo sapiens
ccagccctgtgtgtcacggtctctgcccccggctttgctgttggctggagctggtacagtgcagtgatctgccatctggtggtgggatgccaggtcgcccttttggcagtctgctagtgctgaggctgtatggacaggaacaccaggcaccctccgtgtgcttctgagctgaggttgcttcacgggaccgtggcttccttcctcaacctggctctgcctcccccgtgctactcggaggccgaaacgtgggcttcttgatgccttccccatccctggtttgcccaggatccccgctgcgcagggccctgcccttacctcacgcaccccaccggctccgacgacgcaaacaccgttcatgagtcactaagaagcattgggttccagggcaccttggtactatatgatctgggaagtacagaggagtaggagaatgtcattcccagagaaaatacataagctattatctgttctgtaaagtgatatctttgcatacttgatcaaagtacccaatagattcccaatcactgttctacaagctgtgattttgtctccccttccgagtcctccagtgcaaccgagcaatactgcccagagaggcaataggtgtgggtacccgggagcatcccgttctggagccaatgttgcatttcctgcctgaggaatggtgctcatcccagatcttgccttagctctcattaatggatgcttagtgacgcagcctaacacagtgggaagtggtggtgtgtagaaggtaggggggccaccgacagcttggatgatgtaagagggagccgggttctggaagctctcatgtccgacgcgggcctgggaaaccccccctctgatcccataatctaacttcatctctcgtagaaggggacacactgattctaagacctgcccgtgtgacataacaacttgccgggcgcaacatgcggccctttggggaacaccagcacgtttagaagactcaatcaaagaacaaaagcacgagagaacaag

SEQ ID NO: 564087 - DNA, 337 bp, Homo sapiens
cggtaacatttcattatcgtgatatagtgctgacttgtaaatgtttgaaattaaacagataggtaacctaatttgtgtcctcctgactttataaggaaaacgtgtgcagccattacacacagcctaaagctgtcactagattgactcggcattgccttcattccttcacattcacaacctacaaaagttggtgtacatttgtatatgtcatttaccttcagatctaaatggtaatctgaagccaaattagttttgatcgttctcatggcgcccagtctagataccccatctcgcgaatatctacatcaacacccgctctaatcaccacccaacaata

SEQ ID NO: 564088 - DNA, 889 bp, Homo sapiens
atttacaaaagatttcattcagctgctgcagaatacacattcttctcctcaacatatggatcattctcaaggacagaccatatttgagtcacaaaacaagtcttaaagaattcagaaaaaattgaaatcctatcaggtattttctctgaccacagtgaaataaaactggaaatcaataacaagaggaattttggaaactatacaaacacatggaaattaatatgctcctgaatgaccagtgggtcaatgaagaaattaaggaaatttttaaaatttcttgaaacaaatgataatggaaacaacatatcaaaacgtatgtcatacaatgaaagcagtactaagagagtttataggaataaacacctacgtcaaaaagtggaaaaacatctaataaataacctaatgatgcatcttaaagaactagaaaagcaagagaaaaccaaacccaaaattagtagtctgtgtcctgtgaggccagccagaaacatagaaaagcaagagcaaaccaaacccaaaattagtagaagaaaagacagaataccggtcagagcagaaataagttaaatggaaacagaccaaaaaaatccaaaagatcaatgacattgacaagttgttttttgaaaaactaacaaatagacaaaggttgccagatgagaaaaaagagaaagatcagataaatccgaagtggaaaaggggactactataccgaatgaaggttggtacgttcttgaccacgttaccatattggaactgatggtattctgaaccttacttcaaatgccgtaattgaacgagctttacaaggggggggaaagcctattccctgggaatgatatcccaacggcaacttttttaacccttaagggcccttaaacacccggggacaaaa

SEQ ID NO: 564089 - DNA, 902 bp, Homo sapiens
  misc_feature (1)..(1): n is a, c, g, or t
ncttgttgtcgcagctgtatgtcccccgcttggtgtctttatatgtagctggttagagcgatctatgggactatttcttttccgcagttgttggttttcgggcgcgcattctctctgtctcaacccccgtctctcaaattgggccgccgcccgtgtaactttcgccgcgggttcctctccgcaacgggccatatcccgttcctcaatggcgcccttctacgtctccccagggcaacgtcttgtactgttacccgcgggtttgcccctcgtccctcattggcgcgggtcttgcccctccctctacggtagtgcgccccttgggcgtcttatattttcgcaatgcgcgaccgggatgtcttagcaaccccctgggtcttggttggcccaaccgccgcgctgttaaattccgcctggggggtccctcatgcgctgtggccctcctcccgcgcgcgggcactgttagggtttctcccccgcctccaatcggatttattctacccccgggtgttccccaacgtggggtcccgccgcggaccacactttttttcctcacgggcatatccacgccccctctgtttttagaggtccacctactttccccaaagggtgtgagcccctcgatctggttcccggagcctccccattgggtcgacccctcgtctattctagcgcacggtgttgggtacccgcgtacgctcaacgactggttgtggttttccagccggggctacaacaccgcgggtgtttttacagcgatcacggatgattctgctccctccagaccgacggtatcacgacgagcctaaagtgccttccatcccgacagcggccgtggccccgctgaatcagtcgactccgccccccgcgttacccccccccccccccagaccgggttttacaat

SEQ ID NO: 564090 - DNA, 276 bp, Homo sapiens
ggtcgacataaaaactacacagaagcattctgagatgactcttttgtgaggtgtgcgctgaagtcggagtgttgaacctatcttttgattcagcagttttgaatctctctttttacagaacctgcgagtggatatttggagcgctttggggcttactgtggaaaatgaaatatcttcacacaaaaactacagagaagcattctgagaaacttctttgtgatgtgtgcattcatctcacagagttgaatgtctctgttgattgagcagttttgaaac

SEQ ID NO: 564091 - DNA, 1315 bp, Homo sapiens
  misc_feature (560)..(560): n is a, c, g, or t
  misc_feature (625)..(625): n is a, c, g, or t
  misc_feature (831)..(831): n is a, c, g, or t
tgattaaaaaacaagggggatgaccccgtgtggtgaagtagcccctccctccgtggatagtgccccccggcgggggggggggccccgcccccccgcgccccccgccgggggggggggtgtctccccccgggttttggcggcgccccacacaacgagaaaaacgaggggggccggtatatatcaccatccacgatcccaaccgggagaagaacccttcaggagtttatgaaagaccccccccccgtgttcctcagcagtgaggaagagatgggcttccctatcgtgcgcccacaagattatataaaaagggggggaaattttttcctctgcgcccccggtggtgccccccccctgtggaggaacacttccaactggacgccccaacaagccccgccctctgtgtgttgttacaacacgataatcggggcgtatcatagggggggaaccacgaccaaacgttggcccgccaacattgggggaggagctaccaccagctcttttggggagaccaccaccgggttaattatatctggaagagggaagctccctcttcggagagnggatatatattaagctctttctctcgcttcttatagagagttgtttcgcccccaccggctggggncgcattatgaccgccgcgtgtgagacggcgacaaaaggggcgctctccccaacacacaggtgaaaggttttccgcgtcacaacgggcccccgtgggctgatatgcacaccccgcacacacgcgtgggagacacacgcccacagggggtatacacacataagtgcgctcgtggagaagacaaacattcctccctgagagagggaganaaaagggtgggtcttgcccccgtgggtatatgaaatgtctcacagggagcccacattctgtgcggtctctcacacactctcacagaggccgcttcttataggagagagaacccacgacacactatgtgagataagtgcccctgtgagaacacacacacacagcgtggccgaggcttcgtggagaaaaaccccacccacggctctttaaagagagttacccgccacagagaaactctatactcacaaagacacggtgcacccacgccacggaggccctgagcccacggctgcccagcctgtgcccctcgtggtcgtctttttaatattttccttagagtggtgctgtgcctcttttgtggagtttcctgtataggaactctttattcttgaggctgtgggtgatattttgttttgtttttgtcttttaaattaagcctcggttgagcccttgtatattaaataaaagcccctttgtcctttttta

SEQ ID NO: 564092 - DNA, 154 bp, Homo sapiens
tgcctgttgttaaatcagtgtgcacactcttgtgattctcactcatccccaaattacactgtgtatagagtaaagtcgcactcttgccatggctacagaccctctctgctactggtcccatctaatactgtgacctgagcagcagggaaagaca

SEQ ID NO: 564093 - DNA, 125 bp, Homo sapiens
agcagataatacagactcaggttgtgattgatgcaggcgtctcgcgtctttcccagcctgctcaccaaccccaaaactcacattcagaaggaagctacgtgaacgagtgtcaaccatcacagccg

SEQ ID NO: 564094 - DNA, 873 bp, Homo sapiens
ggccagaggttggactcctctgctggggctcagctggtccatgaggtaacagacttgtctgattgctgtggacataacagatggtgaagttcaagtacgcttgagctgccatacatgtggttgtgctgttgctgcggggactcatgcagaacagctactgaggtcagtgctgagcgccgatcctcaggagtatctctagcatctgctgaagcgacgtagtgtgtctgggagcccggatgcatcgtggccgaagactccatgtccagttggtcctaggaaaagctggatggacatcatgtagataaacttcctgtttccctgccagagaaagctggagagagaagatcatggtcctgccgtacagctggttccgaggcacgatcgtaggagagcaggccagaggttcagggataccgcagagccgtgcccaggtcttccagtaggtggacctgctgtcatctttgagtgctgccagcatggttgaccctcgcggtgtgttggatggtgcaggtcgacttaggagtcttcagggtcccgttccgatggcatgtgtaccagcactccccgcgttcagcctgaggggtgtacagttaagagaagacagtttacagatctcattaatctacatttgacacgtgttccttctaatcacttgcacggaaggactgtctaccctggagaaaggtatatacaacgatggaatggccggaatttgcctacattgtccactcatccagggggttgaaggagaggggtggcaaccgtatgtcaccaagccataatctaacagggggcgatctctccaggaccatggagcaaaaggtacctggatgacaaaggcattcaaggtgaacacgtcgggtgcgaagcaga

SEQ ID NO: 564095 - DNA, 123 bp, Homo sapiens
actctgcttccctgatctttcatcaagcttcttcatctgttaacttctctccaagggtttgtcatcacatgagcgaagttctgcagatgaagaagtataaagcgttgatggggtaccgacgct

SEQ ID NO: 564096 - DNA, 394 bp, Homo sapiens
aagccggattggaggtgtgacgaggtttactcgcgtctagtggagacttcttcaaagcaatcactatgtcacacagacaccaggttgttttcccctttccctttcaataatgcaggggacagcacttccaagggagaattcataagaactttcaaatttcctggaaggaaaggctcttaacaatggaggggcaaacgcaaaatttacggggttaaaccccccatggttagtggggaaaattaagacgggggttatttgcagcaatttgtgtgcatatggagttaatataacacttgaaagagcaagggggaaatacttaaaaattgttgcattttcttcttgatccaacattgcgttgtgggcaagcccaaaggggagttatggtgggtaagga

SEQ ID NO: 564097 - DNA, 126 bp, Homo sapiens
taaaattttaaagggccaaaaaaaagcttttaaaaccccattttttggaaaaaccccttttttttgcccggctgggattttttttaaaactggcccttggccccccggggggccttggtttaaaaa

SEQ ID NO: 564098 - DNA, 425 bp, Homo sapiens
gcggcattgcaaatgcttgttcgtatctatggaaatgatatgatctttcttcttcattctgtaaatatggtgaattaccagtggctcacgcttgtaattccaggacttcgggaggccgaggcgggaggattacttgaagtcaggagttcgagaccagcctggccaacacggtgaaaccccgtctctaataaaaatacaaaaattagctgtgcatggtggtgcgcacctgtaatcccagctactcaggaggctgaggcaggagaatcgcttgaacccgggaggcggaggttgcggcaagccgagactgcaccactgcaatccagcctgggcgacagggcaagcctctgtctcaaaagaaaaaaaaatctacacatccctcaccacactgtacataggacagctgggtgtaaattacatctccattt

SEQ ID NO: 564099 - DNA, 204 bp, Homo sapiens
ttttatttcaaagttttttcaggggggctttttgattagtagggaattttgaacccctctttaaaaacaggtagaaaataaaacccatttgtaaagccccatttggatatgatgccagcctcacgcatttgtaaatttccaaaaattcagggaagcctccccaatttgcccgtttttaaaaaaattttgggttaaaatttgcca

SEQ ID NO: 564100 - DNA, 154 bp, Homo sapiens
tagacatgatacaatcagccggtaccctcataggggcaacttcagaagaactcagatagaatttctgcctgcagctccagtatcaaggatatggggcagcacagccacaacacagagctggtgctcctcacacgtcctcttggcccttatcgag

SEQ ID NO: 564101 - DNA, 888 bp, Homo sapiens
aggctaggatacgagcctgagtgttgaatccggcaccgaggccatgagtagctttggagctggcaaaaccaaagaagtatcttcagtgtggctattaggccatccacccagatatggtcaccatcgccacgggacaggtggcgggaaccactaaggaagggaagccgctagccgccccacgtgcgcatctgggacacaagtgtgacgctctagtggccggatcatctgagcgaagacggatgtgatgttagattcttgattgccggggatcaagtagagaattatcacctaatcttagatggcgagagcaggcctggctagaaaacagtgggtttgccgtccggttggacacagcaatcttcgcgttgagagagaaccgtggatggcaatatctgagctcattggcattgtgaaaagaagagcgggatatgcatccagcatgtgaagcaagaagattaattggactcactctggatcgcacccccatcagaagcctctcagcttgatttgcgataaatcgtcgcaatcttggtgagaaggccactcccattgcaattgttacatttggccacaacagacttattttggagtcccaacagaggtgtcaaacgtactagccgaacaaaccccacagcctttctgagctacacagtctacgatgcctgctgtgaataagaaggctgttttaaattggagccattgatgttgatttggagaacgcgtaacatttattgcatccgagattgggctattcaatgggattgtcacgcctcttgaatcaggatagactcttgaaaaagggtgctcgcaaaaacttcggcgcgggatctaattgcgcatgggatcagctccaccgttgggcaggccttggtcatggttacttggccc

SEQ ID NO: 564102 - DNA, 125 bp, Homo sapiens
ctcctccacacaactgtctcttctattctctctgctggagtttcctcctcctcctcctcctcctcctcctctcttcctcctctgccttcctactctctgtgctctcccctaggaaaggggaagag

SEQ ID NO: 564103 - DNA, 150 bp, Homo sapiens
ccccccccccccccgttataaggaggggggaagggggggggggaaaggggggccggggaaaaaagggggttttttgcccaaaaattttatgccctttaaagtcctggggggggggcccttttaaaaaaggggtaaaaccccttttgggca

SEQ ID NO: 564104 - DNA, 355 bp, Homo sapiens
ctagtagatgtgtagctaactagcttctgtcattgtatggagatgaaatttgaggccctgggtgcttctttcagcagatttctccagattacctgcaacagttatttctacggatgacttctgcataggcataggtggactctggtctgttggagcatggtctgctgaggaagcatgatcagaaagatcttgtaaagaaagatgttctttcttttcagagtttagctggaattcagctgaagacttcaaagccttcacagctttaggttcaatgcgatctgagtcactgggctagatagggcagactgaagcagagacagagcgagcaagactcataggattaccaacatcagga

SEQ ID NO: 564105 - DNA, 884 bp, Homo sapiens
gaccagtgcccgctgcgggtgctggggaatggcgccttacaggtgcccacctgcctcctcagggtgaaggcggggctgggtgtgagcgtgctgaatcagaactttcctggaaagtcgccacttggtgtggtcagaggatcactgaagtcaagtacgtaatcagaatatcccttctccctaattggtttccacctggctgtcgtggaggagggagaggcgaaggagaaggaatggtgcatgcactgaggagaggatccttggccggggatctgtctcgggtgtccacccccgtaatagaaccttgtcgccaaattctgggccaagttacagaaccttcgtcctcatttcccaaatctgagcggtttgagggagctctccctcttgttctgaccgccccgagcgttccttcaagcccctcatccaagatgtggcaagattctccgcgggctctgggccttctgccagtcttctctctccattgggcaagccaaatgattccctaaatcgtgttcttccctatgtaacaacgagtcacactgatgtccctcatgactggaggagaatacccaaggttcttaggctgactgttattcatgcctccttccttcaaaaactattttgggggcattccgggtaaatcaaatccaggatctattggtgaggttaataactaacagaacaggagtttcagggtcgtatatggcggaccggtagggacgcggggtaactttaaggtgcggctttgaatatacggtttggaattttcttgtgacctgggtgtgtgtttttggaggcaaattgagagagggtttgcacatggggaagtagggagagggggacacaaaaatgtgtttcgtgtgtttgtgttgtttgtttgtatggga

SEQ ID NO: 564106 - DNA, 1443 bp, Homo sapiens
gccttcatcttccgctctggcataatgctctgcttggaaaagacgctgagtccccgcgagctctggcacctggtgcatcgattgctacggctcagagctgggctctcacacagtgatggatgaggatatatgtctcccccttgcagctgaactggtctgggtgacccccgaaggaagtgggacgatgtgatcgccctgagcgaccatcacctcctcgtggggcagatgagctgcagacatggatccaatgctcagttgggttcgtgccgtgagccatgtcacgcccaaactttcccgagccagcttgcgactgcagaccatgggggcagatggaggaatagacggaggtgagcagcgtatgagcatgccagaccatgacgcctcctccaggccgagatcatggtgaaccaccggtgtgctgaatcccccgatgcacaggagacaccatcccatgctctgacggtggctccatccgaaacgcttgtggcaccctttgtgactccttggattgacccacgttggacgagacgcttcatttcggacgaagaactagcaggatgtaaaccttcgcttctttgacagtcgcacttggtgcgacgagacaggacatagaccttttggcgcattggaccgcttggctttcccccgtaacgcgttcttcccgtgggcacggcactattccgttcaagttcgaacacactctcgttggtacttgatcgcgaattagattgtggggacctggcactagaacgtctgcgggacttctataaggcgaagccaattgcctagtcatactaccgtactggcagaaaccttatgggcccccgtatcgcagatcgccaagagggggatcgctatctcccatataactaacgccatatgccttggcaagactggctatatcaggccaaggatactcgttgtaactccctttgaaatgtgcccactcattttgaggtgaagcttggggttggggaaaccacagggcaaacaacgttttgctcagatgcccaaaaggcggatcctcggtcgcgtttggcgcttgacgcggagttatcaactgcgaatttcgcagcgccgatattctatgaggagaagcctccagataatgtggtgatctggccctaatagttaatagcctgccactatatcctgtatgtgtgggtctggggaacgcccaccttactcatggcaacgtgcccttgttgatacacacagggtgcccggcactgatccctcccccctaaagggcaccgggcgacgcgcgtcttgtgtttgattttagggtgtgggacccttatccacgaatggtggttggccttgtcaccggtcgcagttggtggcacaatttctcgccccgatatcccatagttgtatctctatacatttccttaaaggagctgtggactgagcccgggcgcttattccttgtgaagtatctcc

SEQ ID NO: 564107 - DNA, 416 bp, Homo sapiens
gagaggggggggacgggggggctcaggttacaggggggtcttttaaatacaagcgttaatcatcgggtggatcaagaatggcaaggctcagtctaggaacagcagcagaaatagcgagagacaggggacttttatacaaaaaaattggtggcttacaaaacatatgcaaaaaaagcttaaaaaaaccagagaccaagggcagcatcctggctaatttttcatctacattaagaaaaaaaaatctggtaactaagggttttattttcccttaaaaaaaatatttcggcttagggcacaattggcgggggggctttagaagaataagccagggttccacagcatccccctggagtgatatgttcccatttctcggcttttaatagttaagggcatttttttctcccccggatacagcg

SEQ ID NO: 564108 - DNA, 413 bp, Homo sapiens
cactcaaaaagggccttctttttttaggcggttgaaactaagatggacaggttatcaacgaacttttacgcctctcgatggccttgaataaaaattgcacacctcaggggcagcaatatattcccagcaagaataaaaaagaaatccatttcttaaagaaacagctttcaagcgcctttttgcagtttttcaggagcgcaaaatagatttggaataggaataagctctagtttttaccacccgcccctcctccaagatttagaaaaaagtttccaccataatttagtttccagaaaaatcttgtgctagaatcctttttaaaaggtattttgaaacccattaaaaccgcttttttttttccagcaagtatccacccaacttggttctgcttcaataaatttttggaaaaccta

SEQ ID NO: 564109 - DNA, 112 bp, Homo sapiens
gccgcgatgagcggtcacgcttttctctcctttcattgtgtgtgcatgtgtgcgtgtgtgtgtgtgtgtgtgctgcgctgtgtgctttttctttctccaggacgtggtggtg

SEQ ID NO: 564110 - DNA, 237 bp, Homo sapiens
  misc_feature (33)..(33): n is a, c, g, or t
gtgtgacgctgcgggcgcggctagatcgctgancagaacagcgtcagcagatctcggtgctcagcggggcaggcaagtgctcgcagtctgcacactgcatgattggggcatgagtatcctggatgtgaagagcttgagtcagccttgaaggacctcaagatccaatgacctgtgaggaatatgtttgcttcatcctagctgcttgggaaggggggaagaggggtcagggaggctaag

SEQ ID NO: 564111 - DNA, 161 bp, Homo sapiens
ctttgcatgttgtgggacatggcactctcgacccggacagcagcgctcgctgacagcttgggaggacacctgcgatctgtgtttttttaaattgctcgtctcttcatgggggtcagccacgctggtctggagttgctgactgttgcattaattgtgctgtt

SEQ ID NO: 564112 - DNA, 119 bp, Homo sapiens
gaactagttctctctctctctctctcctcgtgccgaattcacaggggcatgcatgggaagtaacagttgctaggcttcaatgcctatcggtagcaagccatggaaaaagatgtgtcagc

SEQ ID NO: 564113 - DNA, 477 bp, Homo sapiens
ggcaaagaggggagtgcactgagccatgtacgcaaaatagttgaaaaacattttagagacgtggaaaaggccaacaaaaaaaaaaaaaaaaaaaaaaaaaaaaaaacttgtgtgccgggggcgggctctctcggcgccctctcgagaaagaaggcttttcatagaaccattccggttgggcgcgcgcggcgggcgcccaaggtagggataagtgtggacactgtgggccaaaagcgcgggttcccaaagggaaaactcccggggcgcaagagagaatcaagggagccgtgggggtcttctctcaaccaacattaaaaaaacaccgcgggggggaaccccaggggcggtgtccgtggaacaaaatctccaaagagggggaggtccgaggagggcccattacaggggcgttcttactaacaacggggaggccccaagggagagctcgaagatttcaaaataaccccccggcggtgtggt

SEQ ID NO: 564114 - DNA, 2589 bp, Homo sapiens
  misc_feature (2589)..(2589): n is a, c, g, or t
attgtgttgtgttgtgtgggtcatttagtaattgttttggtttatgtattttttcttgtttgattttttgttatgggtgttgtggttggtgtgtatgtgtggtatgtgtgttcggttggtctggtttggttggtttgttgaggttggtgtgtgggtttgtggatgggtgtttgtgtctggttgtgtggtggtgtgtttgtggtttggtggttgttgtggtgctgcgtctgtggcggtccttcgggcctgtccgcgttgtctttcgtgccttgtcccgcgttcgctcgtccgagcctcggtcttcgatctttccctgctctctgctctcgtgcgtggttcacgtgactacgccttgctgctctgttgtgtttctcttctctgcctcggctgctctccttccctcgtcatcgccctcctctgctcctagctcgcgcctcgcgctcctttggcgtcgctgttttccttgttgtgctttcgttttcgcgttgcttcgggccgtctgtcctctgcccgatccttcattcgctggtggtgcgttgtttgttctatgttgctctctcttcttctcgttgcgcgttggtctccgttttgtgtgtggagggtggttggtcgtggtgagtgggtgtgcagtgggtcggggggggcggtgtgggtctgattggtgggggtgggcgggggtggggtgggggtgtgtggtggtgggtgtattgatagagggggttcgagtgtgtcaggtttgaggatgatccgtggccgcgaggcggggtgtgtgggtggtggtggtgtgtgggggggcgctttctcactccgctgccatttatgaggttggcaagcgccgtcctcacctttgcttctggatgtctcaaccgtggccagctgtcagcaacagaccaggccagcacggtttcagggaactgcttcacgtggatgatttggaattggccagcggttggggttgtctgtcccttcgctgcgtgggaagttccaccgccactgtagttaagccaccaggatgaagcagggttaggtccagggacccagtagagccttgggaggcatgaggtgggggggtaaatgggcttggcagagaaatggagattggtaaggggtctctgattagaatacgagactgatgatgttggttcagcacgcgtgcaagatgaggaatggtgacatgcagcaaaccttagagcgttcccagaaggaagcaatgtgatgccgctccatctgccaagagggtacactccttcaagctccttggcacaagagccagaccaaggtgtcacagggaactccacaggacagaatgccactgccagaggttagggggatgctgggtgaaggaaagtcttcctggggcctgcagcccagtctcaaaacaaggtacaaggacatggctcactggtcctcatttgtgagctcagtaggcagggagcgagccttctctagggtagatcacatgcctggggaattttccttagggttaggatgcatccacggagacagacaggttagggccagtttccgggaagctcagtcaagtgctctgggctcctcaggcctctcaggcagaccttttctgtagggcagtgccccctaggctgcagctctgacctttaggaaaagatggaacgaagcttggctgatcccatgcccactagcatgcaccagggtccccaaaccaactagatgggcaggggctgggcccatggggtccggaatggagggtggggccactagacctggggtggggaggagatgggggcacagcccccagggtccatggtgttccagagtcccctgggggcacagcccccagggtccatggtgttccagagtcccctgagtttcaggttcagctgatgtagatacgatggaagtcgtgggcaccaaaggccgcgttgcacttggggcacttcctctggcgggcctcatagcggccccgcacgcactcgaagcagaaaacgtggaagcacttggtaaggactgcatccttcttgcgggtgttacagcaggggcaggtcaaccgcgccttgtactccttgatctcctcctggaggatttcgtcggcatctgcgtagacctccgacttcctctgcttttccagcttgcgccgcagccgtgagatgtcctccttgagccctcttgaggttgaagctctctttctcacgagcagccggtctctggcaggcagggttggatctcccgcagcagagttctgacgtgctccaggtggacttcaggtcctcgagcaactgagcggtactaagccatccgttgtagactccaggttgagtggcaaaggagtcttttaaacccgaaggtgctgaaggaggactatccctcaggttggacagcacgaagtgggcataacctgtgaattaggccagagccggtgtcacaacatcgtcacccgaaactgaacaccggtgcgcacaaccgagaaaaaaagggagtcacaatcacacgatgagaccgcctgcgtgctccaaggcaggacaacatataaccactaggacagagagatatcacacaaaagatctgtattagtgcagtcttgttgtgctcgtagtttactcttttagtcan

SEQ ID NO: 564115 - DNA, 315 bp, Homo sapiens
aatgggtcccattttccctataattccataggggttttttgagagggtcccttttatttcccctcccttattcctaacggacccccggggccccccttttgggaacctgggtaagttaccctttggggggaatgggggccaactggccttttgggttaggggggggatagaccccccccaatagggggggggggccctttattcagccccctgccgccggttttggtccaagggactgggccgattttgaacgaattgggggttggggttccccccccccgcttcccgagatttaaggttgggccaaacctttga

SEQ ID NO: 564116 - DNA, 1317 bp, Homo sapiens
ccaatgagaaattaagttcatgatagtgcttttggagaacttgtcaaagttagcagccaacggagaaacataaggagcctagcataccgtggagaacccagtgaacaaactttgaggacagaagaaacaacagaaaaagaacaacaaaaaccgggggggggagggcgccgaaagagtcgcccgccggagggggcacgcacgggtacataaagcgaggatgcacaccgggcacttggcacgcgtgcaacacaaagggggggcgcccctgataatcgagggagagccgtaatatataatacagaagtatagcaccacagaggggacggaggcaacatacaacaacacagtgcacgaggaaccggaggggaaacagcaacgtcgcggaacgaacgtcagggaaggccattgtgtgcgagaacaaaaggggaaaacaacccattatactctaccagggggggagggggaaacgagacacatacgatgcggggactaacaaagacaccaaccccacgacacaggagaataggacatctttaaaccacaggccggccccagagaggcaagacagataatactcaaaaaagattccatcacagagggaggcgaataagacagggggagagtgagacaaaagacatgaaagaagacagatgaatcacgaccagaggcgagaaggcgtgagaacaataagtccacacgggagaacccgcacgagaggaacagacgtagaaacccaaagagccaacaataaaagaaacgcgacccgaggacaacacaccaaggagaacaaaaaaaaaataaaagccaacagtaataccaccacagtgtgacgcacacaaggggacatacaacggatcgagaaaaaaaagaacaaacaggacaaaagacacacaaaaaacaagggaagaacaacagcaaaagagaagaacaaggacacgacaagaagagaaacatagagaaatgaataacagacaaatcacataagcaaaaagaaacaaaaggcgaacaaacaagggcaaaaaggaaatcgggaaaagctgagtaaccaaagacaagagtaggcacaatagacagacacgggaaatagaatgacaaggaaaaaaaacatcaacgaacaccagaagcgatagaaatagaagcaaaccaagacgacacaaaaaacagagacaaagagaaagacaataggaaagccaaaaaagtaaacaaccaaaaaaaaaccatgatgaaccccaacaaccataggcaaaggaagaaaggaattcacaaaaaaaaacaataacaaaggagaaaaataaacaagcaacgtaaagaacgcaa

SEQ ID NO: 564117 - DNA, 402 bp, Homo sapiens
  misc_feature (12)..(12): n is a, c, g, or t
  misc_feature (271)..(271): n is a, c, g, or t
  misc_feature (386)..(386): n is a, c, g, or t
ttgagacggagntggctctgttgcccaggctggagtgccgtggagagtctcggctcactgcaacctctgcctcccgggcccacaccattctcctgcctcagcctcccgagtagctgggactacagcggcccgccaccacgcccggctacttttttttgtattttcagtagagacgaggtttcactgtgttagccaggatgatctccatttcccgacctcgtgatccgcccgcctcggcgtcccaaagtgccgggattacaggcgtgacacncgcacccaagcctcctgtttaattcctgtaactgctacccttctcccactcgctgcctcctttctctgcttataaccacatatgtcacatgtcctgtgtctatgcccccactgcnctgtctgggcactctg

SEQ ID NO: 564118 - DNA, 176 bp, Homo sapiens
caaatatgtggaccaagcgggaagtaatccagaccaactcctatgacatgacaggcactcaagcctgatgaggcagaaacctggcagctgtagatgttggaaaggataatttatgtgttcaagtgactaggattctaagggctagatgctagctccaagcacggctggatcctagt

SEQ ID NO: 564119 - DNA, 239 bp, Homo sapiens
  misc_feature (17)..(17): n is a, c, g, or t
atgagaccacacacatnaatacacacatgtatatcgaatttgtaataacggatccttactgtacttcatgccacttcactgtacacttaaaacattattaaaatggtaaaatgtatgttacatgtatttaccacaataaaaaaaaacatttttaaaatggaagtagtagaggtgttgaccctacttaaagaaggaggagggcagtattttcgggatttttaatagaggatccccttagg

SEQ ID NO: 564120 - DNA, 342 bp, Homo sapiens
cgcgcagtctatagggctgaggcttctgggtcctggcgacagggctggcatgaccccggtggtcgaacatgccagttcgcctcacacgcagagggtgcctcggccagcgccctgtgagtggggcatatcagaacattggacagaagccccaagagcctcggacaattgtggaacccacattgggctgagatcccacagtgttatatactgcctcgccggagggggaggtctcgggggacttgccgaccagacccttgtgatcccaggattgcctatcccctgtgccactgaccatactgtgccgggctgtctgtctgacctccatgcctagtcggggtgtcc

SEQ ID NO: 564121 - DNA, 462 bp, Homo sapiens
gacataaatatgctgtctcagcctctgcgtagctgtatctacaggcacgcaacaccactaccagcataatttattgtatatttatagtaagagacggggtttcaccatgttggccaggctggtcttgaactcctgaccttgcgatccacctgccttggcctcccaaagtgctgggataacaggcgtgagccactgcgcccggccaagatatccttaacatttctaaaattggaaagttgtattcttgatatatgttgaataaaaaggtattacatgtaacagtatgtatagtaccatcccattaatgtaagaaaaagtgtatgcgtatttgtgcattgcagaggaatctacaagggtacatcccagcctgctaatagcaggacacaataggatagtagtagtcaactaggaaaatttgtggttccaacgtacttggagacagcatatcagggtaccgagctc

SEQ ID NO: 564122 - DNA, 113 bp, Homo sapiens
  misc_feature (77)..(77): n is a, c, g, or t
atgactctgataatagcggtccgcttaaagaagtcacaccaggtgggccgggggcggggggctgccccctcagtagntcagtcagcgcggccagcggggtcactgcagctcgc

SEQ ID NO: 564123 - DNA, 627 bp, Homo sapiens
ggtgctcaaacgggacgggcacacgggtgggcttggcagttctccaaggattcccgcctgctcccaagacccccgggagtcgtaggaacccgttcctggacgctgacgtcggcttttcagggatccctcgccggacgccgcggagggacagagcctgggaagccgtcgccccgccccgtacccttccccgcgcgcaggggcccggggcgctgagacccggtagagcaaaagcgcaatgttcccagggccccttgtgatcctcggtggcatgttccggggcaaatgtgtcattgcgaggggttcaggaagccccgtgccttgttgatctgtgagcgggaaacccccttccttggagtttccgccaaagccatggacacgcccctagtcttcgttgagcttcaaccaggcacttcttggcctgggaggtggccactagtaatttgttgtagaacccgctctttgccccagtatatggccttgtggcgcatggcattgaagcctttggggtgatcccccccttttaactgacgatgtaattgccccttttggcccgcagtattccccttgtacgcggtgttatggtcaggtttcccttgttcacccggtccttcttttcccttccgttga

SEQ ID NO: 564124 - DNA, 508 bp, Homo sapiens
cttgaaaggtacgacagacgaggaaggtacagcagaagaaggaacagagaaatatatctgtatgttataagaggccgaagtatataaaacaagaaggtagagagggttacaaagtcttaatacataagaataaataacaacctggtattctcttaacagtcaattttaagaacactaaagagaaaaaggcaaactgagaaaacaaagtataaaacaaacaatggccgggagcggtggctcatgcctgtaatcccagcactttgagaggccgaggtgggcagatcacgaggtcaggagataaagaccatcctggctaacacggtgaaacctgtctctactaaaaatacagaaaagtagccgggcgtggtggcatgtccctgtagtctcagctacccgggaggctcaggcaggagaatcgctggaacccaggaggcagaggctgccgttagctgagatcgtgctcctgcactccagcctgggcaacagaacaccgtcgaagggggatcct

SEQ ID NO: 564125 - DNA, 330 bp, Homo sapiens
tctcgaggatccccgagtgttctcaagacacattattgtcacatcaccacagttgaaatgacagcgaagaaatgttaacggcgcgagagagaaaggtcgggttacccacaaagggaagcccatcgagactaacagctgatctcttggcgaaagctctactagccagaagagtgggggccgagtattcaacattcttgaagaagagaatcttcaacccagaatttcagtatccagcctagagtaagcttcataagtcaaggagacataccatccttactgactagcgaatgctatgagatcttgcaaccaccatgcctgccctctaagagc

SEQ ID NO: 564126 - DNA, 139 bp, Homo sapiens
taacatccgtagtggtgtgggtagcacactgagtgaggacacaagagctggtccgtgtccgctgcacagggcaggtgtgatggccccacgagtctttgggagagacacgcagatatagcggctcccacggtctgacccg

SEQ ID NO: 564127 - DNA, 375 bp, Homo sapiens
  misc_feature (300)..(300): n is a, c, g, or t
  misc_feature (329)..(329): n is a, c, g, or t
  misc_feature (364)..(364): n is a, c, g, or t
ctctactgtaaaatgagagtgttcagttttaagaggcacattttcggagcatggatagagtctttccaggagaaaacagtctgtctggtgatggagtaattaaaatgatttgagacattatttaaggaattagaggctgggcgcggtggctcacgcttgtgatctcagcactttgggaggctaaggtgggcggattaccagggtcagaagatcgagaccatcctggctagcatgggtgaaaccccatctctacttgaaaatacaaaaaattagccgggcgtgggtgatggggcgcttgtngtcccagcttgctcaggaggcttgaggcngggagattggtgtgaacctggggaagccggctttnccagttgagcc

SEQ ID NO: 564128 - DNA, 105 bp, Homo sapiens
tcgctcggtcccacagctctgtacacatcaaacagtctcctctcctccacgcctcggggtctgggaagtctcacctcactgatttcacgtagaaaagaaggcgga

SEQ ID NO: 564129 - DNA, 240 bp, Homo sapiens
  misc_feature (148)..(148): n is a, c, g, or t
  misc_feature (198)..(198): n is a, c, g, or t
tcagctcggacccgctctcgtgagactgaattttttaaagcaggtctctaaaacaatatctgtattgttcaggatatgctccttcccccagcttaaaaaacaaaaagaaaaacaaaacaaataacaaaaaaaaacgccaactgtgtantaaagaagtatttatctcatgacaagaggtaggtatttcatcgtttcacnctctgaatgggggcgcgctcatcactgacatggactctatgg

SEQ ID NO: 564130 - DNA, 183 bp, Homo sapiens
atccctccccgacatcccagagtggactaagaatgccgactctcgatcggaaccgttccacccccaatctcggttgagagagtaggccccatgatatccaagagatctctaacgtgatgacccctgtaaactacgttagcaccgtcatggagaggaggtcagaccgcagagtacagacagaga

SEQ ID NO: 564131 - DNA, 812 bp, Homo sapiens
  misc_feature (780)..(780): n is a, c, g, or t
  misc_feature (792)..(792): n is a, c, g, or t
ccgacatcattaaatcacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactncagcgtgggcancaagagtgaaacgtcgtctc

SEQ ID NO: 564132 - DNA, 655 bp, Homo sapiens
ggcaaacaagagggaggatacggactcggacgtcgcgtgtcttctgcagccgctactggaacctccacctcgactccagcggcccgaagggcggaagcagtggataaagaacaggttagaaaggcagtggagcgctctcttgacgcattgcaagtccaggaaaaacgaaattatgggttgctgttgaatagagaatgaaaagtttatgtggaatggtaagtaattgatggaaaaattcgcccacgtaaagacactgaggggtcaggattagaccttggcctccgtagtatacgatcagattcggaacgatatctgtttagttacgaggggatgaaccccaattcagattcctgaaaagacagaacagtttgataagagcagctttcaacacaaggcatggaaataaaaaaccgttcctcagattatctgccctcccaagatctacacgacgggcttataaactcctatgacagccgagctccgccttcttgagcggttagattacttcccttactgatgccaggaattaatgcggtcctaaccctcactcatttgggagacatttcctccaacgaacgaaaggccggtatctgaaacctcctgccacagtatcaagagagcatccgccgtataggggacggctaaacattcacag

SEQ ID NO: 564133 - DNA, 659 bp, Homo sapiens
ttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatttatagatcacagtggctttataaatgatcaagatacatgtacaaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgt

SEQ ID NO: 564134 - DNA, 458 bp, Homo sapiens
  misc_feature (82)..(82): n is a, c, g, or t
  misc_feature (341)..(341): n is a, c, g, or t
aagtttttttttttcatatgctttcattcatttgtttttttttttgtggggggtgtataatgaaattactctgtttaggagnatgaactgatatttattttaacagcaccattgaggtatcacatttattacatggacctgagcttcaatcgtagtaaggaaaccagcccaggaaagtcgttccatcactagccagaagttacagggcaaaattatagcttaacttttggaaggcaaaatggagtctctgtcgcccaggctggagtgcagtggtgagatcttggctcactgcatcttctgcctcctgagttttagcagttctctgcctcagcctcccaagnagctgggaccacaggcacgcatcaccacgtctggctaatttttgtacttttagtagagacggggccccaccacccttggcaggccggtcccgaactcctgacctcgtgatccacccg

SEQ ID NO: 564135 - DNA, 972 bp, Homo sapiens
gcgcggtggcacatgcttgtaatcccagcactttgggaagccgaggcgggtggatcacgaggtcagaagattgagaccatcctggctaacacggtgaaaccccgtctctactaaaaatacaaaaaattagtcgggcgtggtggcgggcgcctatagtcccagctactcgggaggctgaggcaggagaatggtgtgaactcgggaggcggagcttgcagtgaggcaaaactgcgccactgcactccagcctgagtgacagagcgagaccccatctcaaggacaaacaaaaaacaaaaaccggaaaaggggttctccttcaacaacatttcagcataggagagatacgtggggtagacatcaaacaagatcgggagaactcgggctcattttggacagctaagtgatgggtaaggtacatggacagtcattccactattctactaaatttggcagtgttggaaacgtttccacagaataacaacggttcaggactatggtaatgcaatattttaaaacatttgcaccacattagcacctaaacacgggtaccaggagtccactaagctaacgccatatctacacatttgccgggcactcattaactcatacacttcaatggtggaggcagaaaacaaccagacggagcaggggttcacacgccataaggacaagctccacagtgccccaaggggacaaactgggccatttaggcagcgcaagaaacgagaagttggccccgcaaggttcaacgaaggacgcagacggggacaccaaggggggggaaccaagccaggtgggcgcagacaaggcgaaaacagcaagcaggggagggggtaacggcacagctgtggtgattgagcacaccggtgaacgccacgaccggaggacatgtagtggagggaccacaaaaacagcgaggtccccgtatgcgggaccagacaccctgggcaagaggaagacaagcgcacgaac

SEQ ID NO: 564136 - DNA, 126 bp, Homo sapiens
cacaacttggctaatttttttgtattttttagtagagaccggggtttcaccatgattgggccaggctgatctcggactacctaaatagtaggacatttcaaggattaggttatcaccgtgcagatt

SEQ ID NO: 564137 - DNA, 218 bp, Homo sapiens
aacagcatggggtgacaaataaaaaatctactttagaacccttagtaggaatgctttacactttccacagagccagaaacgaaaataccctgttatacgaataagtctcaaatacagatcctcgatgtttttgcccaatacacattgagtatttgtctaaatagcatttcttcttttgtagcgattctaggccctgtctagctcactgtgcattggtg

SEQ ID NO: 564138 - DNA, 209 bp, Homo sapiens
aaaaactacaaaaattagctgggcattgtgttgcatgcttgtagtcctggctactcaggaggctgaggtagaggattgctttagcccaggaggcagaggttgcagtagccaagatcgtgccactgactccagactgggcatagagtagaccctatctagaaaacaacaaaatcccaaaaccaggaggtgtttctagggtcagttccagg

SEQ ID NO: 564139 - DNA, 375 bp, Homo sapiens
acggaacgctgctgcgcttaagggccggcctttattccgtatttcgagtcgaggggacaggtcctagctatttctgatttcgaatcggaacaaccaggcatcgtccaggacgaactcgtcccggagaaaccttaccctccgctcaaggtcaggaaaggcgttatatagacattaaagcggccattatttagcggttttctcgggactaaggaccccaatcgatttagttaaagcccccgaatataatacgcgccaagcacgagacagaagtcagcaaacatcgggatataccccataagacctacaagaacaagccccctaaggactgcaaccggtcgccgagggaacccttcgcctccttagccgactattcgg

SEQ ID NO: 564140 - DNA, 326 bp, Homo sapiens
cgtggggcccggcctgcggagcccacagggcccggctgaccgggtggtctcggaccatgtctcccgcccaaagaccctcccgttgtctcttgctccccctgctcacgctcggaaccgcgctcgcctccctcggctcggcccaaagcagcaggttcagccccgaaggctggttacagcaatatggttacctgcctccgggggacctacgtaccaagaaacgagtgctcacccaagtcactctcagcggccatcgttgccatgcaaaagttgcagggctatgcaagtaccaggcaaagctgatgcagacaccatgaaggccatgaggc

SEQ ID NO: 564141 - DNA, 654 bp, Homo sapiens
tggggcttaagcacttgtggataatcagcagaggggtagggtagggtctcaagcctactccccaaacccgtcttaactcctaacactgggtcttctccttcttacaggattagaccttaacgtggcgttcttttcagctctccggggtggggccccttctgttggaaactcccttggttccccggcagcttcggagagtaagaatgtcgagactctccctctcaagaagaacaagaggtgggttgggggcggggatgtattagtgaaaagcgtgggtggaattagcgcgtggtctacaagagagcacaccacgcgggtggggggggccgtgcacgtgtgagacccgagcgcggcgcgcgcgagagtgggaaaaaacagcgtggatgtgggtgaagtggtagggatgagggacagatgcgcggagtgttgtctcctgtgtggagacgctctctctatcactatgagtgctctgtgtgcgcactgtgtggacactcgcgcgagagccacacagttcgcgtggggttggtcagcgtgtgtgtgtgagaagagggtgtgtgtgacagcagagcgcgcgagagcgcgccgagtgcgcgagcccgcagggtgatgagagagagagagagaccgagaggcccgagtgtgtagaagagggcc

SEQ ID NO: 564142 - DNA, 386 bp, Homo sapiens
  misc_feature (56)..(56): n is a, c, g, or t
  misc_feature (66)..(66): n is a, c, g, or t
  misc_feature (69)..(69): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (118)..(118): n is a, c, g, or t
  misc_feature (128)..(128): n is a, c, g, or t
  misc_feature (133)..(134): n is a, c, g, or t
  misc_feature (183)..(183): n is a, c, g, or t
  misc_feature (221)..(221): n is a, c, g, or t
  misc_feature (244)..(244): n is a, c, g, or t
  misc_feature (294)..(294): n is a, c, g, or t
  misc_feature (309)..(309): n is a, c, g, or t
  misc_feature (318)..(318): n is a, c, g, or t
  misc_feature (330)..(330): n is a, c, g, or t
  misc_feature (336)..(336): n is a, c, g, or t
  misc_feature (347)..(347): n is a, c, g, or t
  misc_feature (349)..(349): n is a, c, g, or t
catttgttcagtgggagtggggtccctgggattgggcagtgtggtggccctgtgtntcctcacctntgntcctgttttcatcnccttntntttggaagggaaaaggagttggaaggtntctggttttnttttnntttttttttttttgccaaaggtttacttccagcatttgagctttggctntcacccctgaaggtcagttatagtgccctgatgaactnaaaggatgggtgtggatgtgtgngcaagcctgagtgcgttttttggggaggggggtttatttttagtaccccnttttggggttttttnatgcagggnggatgtgaaaanatgggnccttttcaagngnagctctttcaaaaatagtcaatgctgggaaatgtgga

SEQ ID NO: 564143 - DNA, 274 bp, Homo sapiens
catcaggcaacactccaggagtctcaggacgtggccaaccgcttcgcccgtctaaggggcgctgaggcagaacaacgtgcacaatgtgaacgaccacaaattcatcgcgcgcttcttcaaacagcccatcttctgcagccactgcaccgacttcatctgggggtttgggaaacaacgcttccagtgccaactttgctgttttgtggtccacaaaaggtgccatgaatctgtcacttcttcttgtccgggtgcggataacggaccccacactgat

SEQ ID NO: 564144 - DNA, 181 bp, Homo sapiens
gaattccccccccccccccccccccaaggtgttatgtgaagaatttggggctgttacccaaatctaaattttgaagtgtcccgaatctccagcaacctagaatgtgttttgagatagaaccccttaaagggtgattaaatttaaaataaaggtgttaagagaggggtcccaatcaaactga

SEQ ID NO: 564145 - DNA, 481 bp, Homo sapiens
gcattattgccaagggtccaacaacatccatattttctctaaattttttttatataacccttctaaacacataaacattaagaagacttttttaaaaaacaaaccaacctccccattttcatattttaatccaaaaaaaacaaaaaatattttcactatttattacatttctacttctttccccttttcaatccgtataatcataatatacaaaaaaccttaatataaaatttcaacctaaatcctcttttacaaaattttttatttcaaaacatctaaccaacttaacccttttataaaacaaaaaaattataatattatcctcaaaaccaacaaacctacaaattttcatatattaaaattttcccataaaaaattttttctaattctaaaaatcccacattatcccttaaatatacttccatatttaccattaaatccttaacccttacaaatcttttaacaatattttaactcaacc

SEQ ID NO: 564146 - DNA, 396 bp, Homo sapiens
tgtgcaagcacagaaaccatactagggaactgtgtagacaggaaccatgccagactatccaaagggctttttatcagcactataaaattgtaaagctaatctcaattcctccaagcagtctggtcatctctgaaaatatgccattccagccaaagccttgataaaatagccagtgtatctaattatgtcctgttataaaacagatccttattgaacttatgcaaatcactattttgccataaattaagaatactcacagtttccaaatttgggagaaatccagtagtgagaaaggcaaatgcttcaaatttgcccacaaaggtatatttacccaatttttgtaagctatgaatagctcaaaagaaaaaaggtttattaactctggaagcaaaacat

SEQ ID NO: 564147 - DNA, 375 bp, Homo sapiens
ggatgcaaggctccccccatggcctagctttttgacagcctttagtgagcgggccccatgttttgtgcactcgacattgctggaaaaggccccttttttgcttgtttcgggactgtgctaaacagctgaagttgtcatattgtgactttgtataaaaaaggctttatcccattttacttttcatgaattttagctaaagcctttgattggactggggacttttttgagacaagggctgcccaccttttttttttattttcctaaaagtttagcaaagcttttgagggacaggggtcaaccctgtttgtttccctgctttgaaacaaattatgtttttatttattatgttttttattaaacaaagcctttaaagga

SEQ ID NO: 564148 - DNA, 992 bp, Homo sapiens
tatcaggagtttcttcccggagcaaggacccccaagacggaagaggatggccgcggcggctctgaggagattttggtcccggcgccgcgcagatggctgtgtgctgacgcggtagtgtgcgaagccgggagtgtggtgctgctgtgctggggtcctgggcccgcgcgctgctccgggactactgccgaggcctgcagggacgcttcggcggatgtgctaggtgccctggcctgtgggctgctgcctgctagttgtaattgttgtgtgtacttgcttggtgctgtgctgctgtgctgtgccttgctatcactgctagtgctgccacatgcgatggtgttgcctatctgatgtgatgtgctgctagcttgtgatgtgctgtctgtgggaccctaccttgcttgcttggctgcctgtgccaccctggcaaccgcggagtcctgaagccttccgttgcaggatggcttgctctggcttgctgtgggccgtggccgcctgcgctactgtcaaccttggggctctgctctgcttggtgtactgaggctgcccttcgacggcccaggccagcctctaccaggcgctgtttgccggctacctgcagccccgctggacctgacttcccctggcctgggtcctggactgtgggcttcgtgggtcgctggttgggtgctgggggcctggatgcgcgactgcgacatcaacgacgacgaattcctgcacctgcccggcgcatttgcgggtggtcgggccccagcagctgcattccgagaccaacgagcggctcttcgatgagaagtaacatgcctgtcgtgctcaccgacgatccggtgggaccaggcgctgtgggaggagcaggtcttgcagaaggctgatgaaggcaggctcgcccgtagccatgccactcgctggtgcaggcggaggccctggatgaaacactgagtcctccgagtcctggaactgcttgctgggttgtgcgaactgagttgcctccctga

SEQ ID NO: 564149 - DNA, 359 bp, Homo sapiens
gcctactactactaaattcgcggaaaaaaaaaaaccctctaccctttcacacactacggaggatttcatctcttgtatatgatgatctggatccaccccccaataaatttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggt

SEQ ID NO: 564150 - DNA, 267 bp, Homo sapiens
actatcatgaatgccaacatgcatccctaacaacccagtgctgttctccaaatattttcagttcattttttatgaacgtattctgactgttccatcccacccacttaaattttcccatggccacatgactttttttttttttttttttggccgatggaggttgagaagaaataacatgtgttgactttttgtcgggagaaattcctcacaagaaacagcgtttctattccgcatgtgttttttctctcttttcctttgagccatgtg

SEQ ID NO: 564151 - DNA, 170 bp, Homo sapiens
atgtgtctgaactggctgctgaatgtttatgatacgggacgaacagggaggatccgtgtcctgtctttaaaaactggcatcattccctgtgtaaagcacatttggagaaaagtaccagataccttttcaagcaagtgcaagttcaacaggattttgtgaccagcgcagct

SEQ ID NO: 564152 - DNA, 1158 bp, Homo sapiens
  misc_feature (813)..(813): n is a, c, g, or t
  misc_feature (1096)..(1096): n is a, c, g, or t
gggtgctccaacaccaagagctcggacagctgggattcagagaatacctttgcctcccacacctgcaccagaaacatacgaagattatggatatgatgatacatacgcagaacagagttacgaaggctatgaaggctattacagccagagtcaaggggagtcagagtattatgactatggacatggggagctccaagattcttacgaagcctacggacaagatgactggaatgggaccaggccatcactgaaggctcctccagctaggccagtgaagggagcatacagagagcatccatatggacgttattaaaaacaaacaggagggaaaaatatcagttatgagcaaagttgttactgatttcttgtatcccaggattcctgttgctttacccacaacagacaagtaattgtctaagtgtttttcttcgtggtccctttcttttccccacttcctccattcttaactctgcattctggcttctgtatgtagtattttaaaatgagttaaaatagatttaggaatatcgaattaattttttaagtgtgtagatgcttttttttcttggtggtttaaatataacagtgtaccttttataataaaaaaaagttgaggttaaaaaaaaacacaaacatgttagtttcaaagtggcatggttgcttaacaggttctgaagggctgttaacttttgcttagagttcgagtctcgagggaccccgtgaaagtccatagtgccagaaattccaaaatagggcacactttccacatcacgggcgcgtcaaactgtgaacccgatggtgcacaccgggtgngtgcccccaggtaatagggacccacaagtgccttagaaaaagctgcttatagagcagggctgggtggacgtaaaggggagagaataaaataggaaagaccccacgcgaatgatagaagacgggacaggacagagatagcggctctgaaccaaagcgatactgtgggagcggagcaacaacaggggtgggagatgagcaaccccccacggattgaaatggaatcagagaggaatacacggtgacgacgaacaagccagtgcgtagcgattagtcaagtaaagangggatccagcgggacgccccccctcgattagcgctatgcgagccatagatcgaagtacgcag

SEQ ID NO: 564153 - DNA, 123 bp, Homo sapiens
taggaccaggcttgagatagggtcatccttagggaagctcgtcgagcttacccacgatgcctgctgctgcgcgtccgaggcaggaagccgaggagacccatgatctgggagcggagaacttta

SEQ ID NO: 564154 - DNA, 191 bp, Homo sapiens
aacaaggtgaaactgtgtctctagtaaaaatccaaaaaattgtcggagtctggcggtgcacacctgtgatcccagctaatcgggaggctgaggcaggggaatcgcttgaacccggggggcagagattgcagtgagccgagatcgcaccactgcactccagcctggcaacaaagtgagactccgtctcaaag

SEQ ID NO: 564155 - DNA, 990 bp, Homo sapiens
ataaatattatactagcatttaccgatctcacttctaggaatactgagtatatcgctcacagctcatatcctccctactatgcctagagggaataatactatcgagtgttgatatatggctactctcatagccctcaacacccagtccctcttagccaatattgtgcctattgccatagtagtctaggccgcctgcgaagcggtggtgggcctagccctgacgttagtcgtcgatctccaacacatatggactagactacgtacataacctaaacctacgtccagagtgcgtaaaactaatcgtcccaacagagtttatattactaccactgacatgactttccagcaaaaccacgagttaatttgaatcaacacaacacccacagcctaatgattagcatcatccctctactattgttttaaccaaatcaacaacaagctatttagctgttggcacaacccttttcctcgggaggcgcctaaaaaggcaccctcctaatactaactagctgaagtcctaaaccgtacacaatacaatggaagacgaagcgccagtgttccagtgaaccagctatcacgaagaagaagtactacctctcgatactaaatctccatagagagcaccttaattatcaacaggtcaaggcaacagaataatcatatttaataatctgcttcgaaacaacttatgccaacttggatataatcagccgagagggcacaaagcagacggctgaaggaggaaatacgtgactaaggtaacacagagagatccgtacagaacatcgggggataaaatcaaaagcagcagaaaaattaaacagacaaggacagacagtaacggagagaagtaaataagaaaaagggaggcaggacagaaggaaagacaaagcagtcacaaggaaaaagcaaagaaaggcaaacagagagggaaaaccaaaaagaaaggaaagagggagaaccgagcaaacaccccagagaaaaggaaga

SEQ ID NO: 564156 - DNA, 313 bp, Homo sapiens
aacgggtgatgcggttgcagtgagctgagattgcaccactgtactccagcctggcgacagagcaacagcgagactcagtctaaaaaaaaaaaaaaaaaatttcgccgggtgtggttgggggccggcttttgtaatcctactcggggggctggggcaaaactgtttaaacccggggggcgggggttgcaaaaagccgatattgccccaccacactccatcctgggtaacagagggggactccgtctaaaaaaataaaaggcggcccctgtgtctcacgcctggaatcccagcactttgggaggcaaaggcaggc

SEQ ID NO: 564157 - DNA, 110 bp, Homo sapiens
tggtctcgcgggaacattcaagggggagatcatctgagtcacacaccctgacaaaattgaggtatttaggcatcatatcatggaagtcgtctgtgatgaataccatgata

SEQ ID NO: 564158 - DNA, 623 bp, Homo sapiens
  misc_feature (121)..(121): n is a, c, g, or t
  misc_feature (176)..(176): n is a, c, g, or t
  misc_feature (226)..(226): n is a, c, g, or t
  misc_feature (297)..(297): n is a, c, g, or t
aagtgcctcaagggcaaaagggtggccttctgtccgcccggcaaagggcttcctgagggttcttggtccaacgggaaacccagtggtttggaagggcacccgttatttagcaaaccggaanaggggagtcccttttccttggagaagtcaggggaccctttgctcccccagcttcnttgggagggggggaatattatccaggcctgcccgcagttatccaaaagcntaacccccccctgtgggggtggggttaaaggctcacgctttttgtccactttaaagctcctcccaaactcngggttggtttttgaaattcgtagtagaaaaaggtagaaaaaatagtgaaagttttaaagtttttgtttttttttataaaaccaaaaaaaaaaacgctgaggtatgcggccttttttttttgtttggggtccctaaaagggaagggccccctatcctgtaatcccctgacctggttccccttgtcaatcatttaaaaaattccccccccttcccccgcccccttgttttgtaaacaataaaaatcagggagcccacccatttggggccccccccggtttccgggtttttatggtaggggtccctggggcccacctgtttttttttta

SEQ ID NO: 564159 - DNA, 413 bp, Homo sapiens
ccagcgaacatcggcagcggcagctttattgaagaacaggccaggacaaggctgcaggtgatgatgaggccatgttcatagactgaaaacctcatgtactgccctgtgaatatgggcatgccccccaacagcatggctgggtgcatgggcatatgaatcgagtcgccagtgtttctcacggtactccaaacaacatcaagtgatgtacttcttgtttccttgcacatgaaaccctgaagacaagcaaggagaatgtagcaacccacttgatacacttggaaagcacaacatgttggcacttcttgtctcagaaaataataatttgccagttgtataactacaggcgtctttgcatttctgcgaaagatcaaggtctgcaagggacttcttgtgtgcttgctttccatttgaca

SEQ ID NO: 564160 - DNA, 424 bp, Homo sapiens
  misc_feature (423)..(423): n is a, c, g, or t
taactggacacactgggcttcttcagtccactttcaccacactgtatattttggtaacaaaccaaaagcatgcaaagaagccaattgttcctgtaaaaaggaagaagatcaaaaccattatcatagtataaccgaagtacaggattgtacttgctgtccccgtgatctgcagtttggagaagaagtagtgtatggcgtatatcaggaagtaaacagctgtgaagccgctggtaaggaaggaacgccactgccaatggtaatcctctgcacataggtgaaagtagcaaagaagtatagttgcttcggaacaggtaataaccaaaatgataaacaccagaaacaggaaaccaaacatgtaatacatctggtgggaccaaatgctattcagaatgaagaaaagctgtataaagatgcagccaaaang

SEQ ID NO: 564161 - DNA, 1048 bp, Homo sapiens
tctggtacctggcctgggagataatggatcggggattggtctgtggtcctctctcggctcctcgcggctcgcggcggcgacggttccgtggtgacacctgcttgcttgtgccctgtccggccggctcagtgacttctctgctgctgctcccgtgttcgctgtgactgtggaagaagggctggtgcctgtccctgtccctgtccccatctggaaccccgaatgtctgctgcctgcatgaccctgtctgcagtggctgatgatgatgctgctgtgacgcagctgggcctgtgtggtctgcctcctggccctgtgctcttgcttgccttggaggaagtggtcctgaacgggctagcggcgttcgcacctttgcactgtgtgtgatggaacgggcaatgattgtgtgccaagtacattcctgtgcttggtgtgatgccctggctctgcctggcctgaagaacgtgcggtggcttgctagagctgggggacctgggcttggtggcaggtgaacgcgcgaaacacgtggacgcacaggatgacccagctcaggcagggtgggtgaagccgcaatccgagtgacggaaatcaactgaccagttgtgcctagctggtggtcgagacgccagagacggagcgagcacgatgcaaggaagcgtcggcagtccagtgtccgaaggaggagccatgcatgacgcctgccacaaggaaaggcgcccagggggcaagaggccagaggaccggcagtggactgacgacccgtaagggtgcagtaggggggctgtaacaaacggaaaacattgatgcctcgcagaagtgacggaccaagtaggccaacccgggaacaaggcggagaaaggcttcagagacacagcctggacttcctacgaaccagtggaaccagaagggggaccccaaaggcaccataagtgggcgtacagaacagtttggacgacagcggagagaagtccagaaacaaagagcccaggcacgatccgaggcacagttggaaccgaacacatacacagcactagagcgatcaagaagtacacgg

SEQ ID NO: 564162 - DNA, 327 bp, Homo sapiens
tctcatacgccgactaattacgagctggtgcccttcggccgagcgcgtgggactctatccagtcatgaaagctgtatgaccgggcagtgagggccacgcctcccagcctggatgactgtgacgccggctgctgcccgccgagaggtggactgtgctgctacagcgctgtgatgtgtggcgtggatgccgcactgctgtatgccaagaacatggccaagtacatgaaagacctcatcagctacctggagaacggacgagctggagatggagttgccaagacctaaagatgtcacatgcaagaggtagcggaccaatggtcgtattacc

SEQ ID NO: 564163 - DNA, 850 bp, Homo sapiens
ggtgacccccaagtccaagtaccaatccactccggaatgagtctctgatcatcgctggaggaaggggcttgtgggtcctgccccccggaggaactgcctgccccatcagtgttcatcgcctggggcccatgctgcgctcctctggctgggtgacgatagtccaacactaccctgtgctccttcttcccaaccggatgagcgatctgagagctggccaaaccggcctggggggcgcccagtgtctaaggggcgagtcaggaagggcagctgatgatgtggtgagggtgatcgttaggggactgcccgatgccagagtaacgagctcaactaggcccgttcgctcctgtgacgtgatgccctgtgagctggaggggcgggcaggcgccggcatctaactcgttgtggacaggagggccatgcgtagggggagcggaggcagatggatcctcgtccgacgcgagagcttgccgtaataatacatcacagtgtggagggcatggcgtagatgtacacaagcgacctagtttattgagcacgcaggttgttacccgtatctgcgcgtcgcgtgcatgattcagcgcttcgcggtaccgcacagatgcttcgactgtgcttgtcaacgtgatctgcactgaagtgacgtaacggtgcaccctgattcagtcctgcggtgaggacatacgcggcgcgtgaagcggcgaacgtaatcggctaacaacgtttgaccgggcgatgcggtcaactcaaggctcggatggactccgaaggaaaccaatctcacattagattaacttccagccacaacacaaggcgccataaccgaaggacacaatgtgacatgatggtggct

SEQ ID NO: 564164 - DNA, 1897 bp, Homo sapiens
  misc_feature (303)..(303): n is a, c, g, or t
  misc_feature (1239)..(1239): n is a, c, g, or t
  misc_feature (1886)..(1886): n is a, c, g, or t
  misc_feature (1896)..(1897): n is a, c, g, or t
ggagacagggcttgcgagtgagttggacgcatacggcgtaataagtacagagagacgacgcgtctacaaactactctgtccacgtgccccagtagacgagcactggtcatgaccagcataggccaaggatatgggtgctaggtgctgatcctctgcattaccacggactgatactctgtcagatcatcggacaggctagactctgactgactgcacgatcatctgttcgactcgatgagaccagacatgtggaggatcccatcaagagatgcgtatagggcccttctaccgtgctactggtgnagaggtcttccatagtgaaatgtgaaaagggttctccatcacaagcacttctggggtggtcgtcaaccaggtctccgagaagcggtcgtccgacatgaaccccccaagaaagggcgtcggcgtacgggcacccgttgcccaattcgccaagagggcgatcacactccgtactctcagtctctagggcttggactttatgattcaacgctaaggggatttcttggggccaagtttgtgatcaatacccaaagagaagctctgtatcctaggtttatgacaaaccccagattgaaaatagcatgggaaaatatgcgtagaaccccccagggaatgaggggttggttgtaaccttattggtctctgtgtgccgacttgaggagaaatctctaaattaaccacgggtgccgggaggcaacttagattagttgcctccgccgagtgtccaccatgatgggtccccaaggttacactcaagaccagcgtcctgccgaggtggaacgcccaaccttaggacggtgcttagggaaaaagcctccttttctttgagaagcccacgccgaaggccagaaaatatgaaatatcgcccttgtgatggcgcccctcagacagtcaggtttgtgccaacagtctccgagctcgcggaagggttcccttcccagctgcgactgccacattccccaggcggagctaatccctccgtgggaaccgcccagaaagcttggtcccacattcaggccccataattggacaagcgcgccccgcgagtactgtgcgcgaaaattgacgcgtctcccttgaggactcgtggggggtgacgcgcacaggggatcaattgccacattacaaactgcacaggcacccgcacagacactccagggggcgcccccccggggaatatttcccccacggtggtgttggccctgtaaagaagagggncctccacaacaaggggggcccccacacgaacgggctccccacaattagtcaccccccggggggagtctggtcggcgatggtggggagagcccccacaataggcacatattatggggacgccaccaagggcaagacccatcggagggacacacggtcagcgagaggacctagtgagtaccgacgaacaacccgttgtgtgctcccgccgggaaggagaccccccacacaaccaccggagggggggcagcggagcagagccgcctaaatacaacagactagcccgaggtatggcttgacaaccaagcgagtcagatgaaccacaaccgcccgccccgtgtgccttgcggtccctcctctattacagacgcgcatcacacaaactgctgctcagtataggaacaagaagcaacagacgtcaatgaccatcaacgcggcaagcatgagcgacacatacccacacaagcacttactagcgaatcagagctcacacaactaagtcgattagatgatgataaacatacacactacatgtacccgacataccatcgacacgtacagagagatagcaggctcgtctacgtgcctttgtgctatgcgttcctactaatcgtctctgcttcgatgcctgttgtaacagattgaagggnggagacgagnn

SEQ ID NO: 564165 - DNA, 170 bp, Homo sapiens
ccggccctaattgtactcattgcggtcccgggagacgaatgaggaaccacgtcctcctactgctcatgtacacgtgagcctgggtcctggtaaatgggcagacaaagcctgagacgacaatggctgcaattactgatgatccgacctagaccactcgcctgactggacgt

SEQ ID NO: 564166 - DNA, 223 bp, Homo sapiens
atgtgaggtgatctcgcaggtcccggtctctgtctactctctccagagtcacacgacccaggtaatcagccacatagccctggtagtaacagccattctcatccaaaccccctggagcttcaccggcgcagtcattctcataatcgcccacggaacttacactcctcacttactattcgtgcctagacaacactcaaagctacaatacacatttcacgcctcg

SEQ ID NO: 564167 - DNA, 727 bp, Homo sapiens
tttgggctctagaagggggtaaagggggtgctatagggtaaatacgggccctattctcaaagattttaaggggaattaatttctaggacgaggggcatgaaactggggttggcctccacagaattctcagaagacaatgtgacaccggtagttatcaccccgcggctcggtgttagcgggtgaaaaggtggtttgtggttataaacgtctccgggaaatgtgctatcgtggttttataagcccttaagtggtggggcacgagctctccagtgaagtgtgacaagaagcgtctcttgggtgagtgtgtatatttattatatatatcaaaatggtgggggctctctcaaatctcgcggagagatatatctatactctcgagatgtgtgggtcacacgcgctctcagaggagagtctcgccgaggtctcgccccggtgggggtctctatgaggggacacatataagatgtgcggggggagaagagttatatgtgtgatagaggggagtgttgtgaaacacgacattttatagatctgcgcgcgccgcgagaaagactgcgaggtgggatcacactcgcgatgagagggttctccagaatcacccccagtgtggggtgggggccccacagtgtgagaattgtggagagtgagtcataagaggggggagaaggggaatctcgtgtgtgaaacctctcgggttgcggtggtatcagtgttttaaagagggaaa

SEQ ID NO: 564168 - DNA, 255 bp, Homo sapiens
gtccactgccagatagtactgagaagattgtttcaaacctgctctgtgaaagggaatgttcaactctgtgacttgaatgtaaacatccctaagatgtttcttagaatgcttctggctagattttatttgaagatattcccgtttccaacgaaatcctcaaagctttccaaatatccacttccagattctataaaaagaatgtttcagaacagttctgtcaaaagaaaggttcaactctgttagtggtcgacgcgg

SEQ ID NO: 564169 - DNA, 96 bp, Homo sapiens
tccccatcttttttttttgggggggtaaaccccccggggggggggggggggggaaacccccccccccaattccttcccaaagagaaaaaaaagaaa

SEQ ID NO: 564170 - DNA, 567 bp, Homo sapiens
tgctgacgagggcggcctgggcgaccgccggctggctgtgtcgtcacttaccctcattgtgcgcactgggtcagttggatgagcacggaccattcctgcactgtacatcagcctgtcgtacgtgggtccatgtggggtggtttggtatacgccggctgcacgtgataacggatggatcgtatggacagtctgttgtgctgctgggaaactattctgtggcgactgcgtgttggaggcaggtgtcatggagggtggagttggcgcaagccccgcgtggtaaatggctgactgctgctgtggactggccagatggagagcctgggcggcctggtgctgacggtgctgaacaggactgggtgcaggatgacttccaccatgttggctttgctgctgtccagtgggggtagctgaaggctgagggtgtggagtatgtgggtgcaggctagcgttagggtgcgcatactgctgagcaagggagcccgtggaaacatacatcgcatgcgtctgctcatgagccccgtactgagttgctgaagaagatactaaaccaggctgggcgtgtgttgt

SEQ ID NO: 564171 - DNA, 883 bp, Homo sapiens
ttctttgcgtcgccagccgagccacatcgctcagacaccatggcgaaggtgaaggtcggagtcaacggatgtggtcgtatgggcgcctggtcactgagggctgcttttaaactctggtagagtggatattgttgccatcaatgaccccttacattgatcgctcaaactacgagtggtttacatgttccaatatgattccacccatggcgaaattccgatggcgacctgtcaagggctgagaacgggaagcttgtcatcggaatggaaatcccatcaccgatcttccatggagcagagatcccgtccaaaagtcaacgtggtggcagatgctggcgctgagtacgtcgtggagtccactggcgtcttcaggcagcagtggagaaaggctgggggctcatttgcaggggggagccaaaagggtcatcatctctgcacccctctgctgatgcccccatgttcgtacatgggtgtgaaccattgagaaagtatgacaacagcctcaagatcatcagcaatgcctcctggagcacaactgttagaacccctggcaaggtcatccatgacaactttggtatcgtggaaggactcatgaccacagtccatgccatcacttgccacccagaagactgtggatgggccctccgggaaacttgtgggcgtgattgggccggcggggtctcccagaacatcatctctgcctctatggggctgccaggctggggcacgtcatcctttgactggacgggagcccattggattggcttccgttccccgttgccccgtgttttttggcctggccttgcgtaggaaacgcggctttttgctcttaatgtgggctgttgtgccccccaggctctctgggcacagccccggggtcctttaa

SEQ ID NO: 564172 - DNA, 935 bp, Homo sapiens
  misc_feature (129)..(129): n is a, c, g, or t
  misc_feature (348)..(348): n is a, c, g, or t
atatacagatctcggatgacagatatctacatataaagatcaatagtgtgttcctcggctagggttggtgcttccgcaaccatgatacatcgcgctagctacattaggtgcagactggatggctggganggatcatcattgaggtccgaggacgttcaagaaccggtgccttggggcaaactgtggcagtaaacgctcttgtgtatcgtctataacaaggaatcatattgggcatgggagtctgagggggatccgtcgcactagtcaaatctctcaacgacactgtgtgcgcgaggaagccgaggccgggtgtggatcaccgaagcgtcaggaagtttcgagaaccangctgtggccaaccatggttgggaaaccccatcttgtacgtggaaatacaaggcgttggcctgggcagtggttgggcgcgggccctgatagtcctagacaactcagggaggctgaggccaggagaattcgcttggagcccaggagggtggaggtttgcaggtgagccaagaatcggcgccacgtgccctccagcctgggcgaccagaagcgagactccgtctcaaaaaaagaacagaagagacaagagaacaaaaaaaatcgttggttcggggcgcaccacagggcccccgagaaagaagaacgtgtctgaagacacccaagcggtgggggcgagggggagcccccagagagggtacggtggacaccctggggcccaagacagggggttaccaccgagaggagaaaaaacacgggggcacgcacgaacaaaggagagggaaaatcgcacagcaaaatgaaaaaaacacgcccgggggtaaaaccacgagaacgtgttggaaaagactccccaaaggggaataagagagggccacaaaggggggaatcatacacagaggggtcacaaggggagcgcacataaataaccc

SEQ ID NO: 564173 - DNA, 1114 bp, Homo sapiens
caacattaaaaaagaatgcaaaacgaaatcctaaagtagatcccggagcatgctcgaaggaaattatcagccagaggaaattttagactgcagcaatcataattggcagcacaacagtgggcctagaatgtgtagatattctcagcgaactctttcgaaggggactcagacatgtcttagcaactcatttcagcacaactcagtgacatggacttaatcaatgtgtctaaagtgagcacaacttggaagaagatcctcagaagatgataagggggcattccagttgtcacagataaagcaatacaaagagttaccgaaacacaaccaatacattttcacctcatgcttcaacccagagactcatgtcatgtccagacacccagtggcattcatgtacagaaatcagacagccagacttctctcaaaaaagatgctcagccccaagttatcccaatcaaaggtgatcagaaacggttctacttcatcaggtcgaccacaaatgacatcctctgaggttgacaagcacattgcacacacgacacgaaagactcaaaaggctgtacttcgctgataatacaaacctgacaaatcatgattcgactactacacaagcgggcaacactgcaacacggagacacaggctgcggatatcgacccattggcaaccgaaagtgtgctcatgtaccatcactcattacctactacaaaggactggtctcacgattcgggacacagcatcacgtacaacaagaccaagttgtgacaaacaaagggtaacacctggagccggacaacgaaagacacaagcgaaccacgactatcccagaaagacaattgacgcgaataccacaccacacctacaagatcaacacaggtgaaccacgcactccacatgcacatggttacagcaaccaacaacatcggacaagagatgaaaacagtagacaacaaacaaccaggcaacacggaatgacaacatccaacaaccacaacgctgacaaaacaacgcggcaaaaaaaagacaaacaggcagaaaaaacaccaccacgaaacgccacagcaaggaacaaaagacccagagccgtaaagcacgcacaccaacaaaaaacacgca

SEQ ID NO: 564174 - DNA, 865 bp, Homo sapiens
  misc_feature (1)..(1): n is a, c, g, or t
  misc_feature (65)..(65): n is a, c, g, or t
  misc_feature (75)..(75): n is a, c, g, or t
  misc_feature (107)..(107): n is a, c, g, or t
  misc_feature (109)..(109): n is a, c, g, or t
  misc_feature (112)..(113): n is a, c, g, or t
  misc_feature (118)..(118): n is a, c, g, or t
  misc_feature (120)..(121): n is a, c, g, or t
  misc_feature (146)..(146): n is a, c, g, or t
  misc_feature (150)..(150): n is a, c, g, or t
  misc_feature (162)..(162): n is a, c, g, or t
  misc_feature (167)..(168): n is a, c, g, or t
  misc_feature (182)..(183): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (219)..(225): n is a, c, g, or t
  misc_feature (243)..(243): n is a, c, g, or t
  misc_feature (254)..(254): n is a, c, g, or t
  misc_feature (259)..(259): n is a, c, g, or t
  misc_feature (286)..(286): n is a, c, g, or t
  misc_feature (291)..(291): n is a, c, g, or t
  misc_feature (296)..(296): n is a, c, g, or t
  misc_feature (316)..(316): n is a, c, g, or t
  misc_feature (321)..(321): n is a, c, g, or t
  misc_feature (324)..(324): n is a, c, g, or t
  misc_feature (333)..(333): n is a, c, g, or t
  misc_feature (336)..(336): n is a, c, g, or t
  misc_feature (344)..(344): n is a, c, g, or t
  misc_feature (348)..(348): n is a, c, g, or t
  misc_feature (350)..(351): n is a, c, g, or t
  misc_feature (375)..(375): n is a, c, g, or t
  misc_feature (380)..(380): n is a, c, g, or t
  misc_feature (390)..(390): n is a, c, g, or t
  misc_feature (430)..(430): n is a, c, g, or t
  misc_feature (433)..(433): n is a, c, g, or t
  misc_feature (439)..(439): n is a, c, g, or t
  misc_feature (458)..(458): n is a, c, g, or t
  misc_feature (468)..(468): n is a, c, g, or t
  misc_feature (480)..(480): n is a, c, g, or t
  misc_feature (520)..(520): n is a, c, g, or t
  misc_feature (527)..(527): n is a, c, g, or t
  misc_feature (558)..(558): n is a, c, g, or t
  misc_feature (597)..(597): n is a, c, g, or t
  misc_feature (630)..(630): n is a, c, g, or t
  misc_feature (644)..(644): n is a, c, g, or t
  misc_feature (770)..(770): n is a, c, g, or t
  misc_feature (863)..(863): n is a, c, g, or t
naaaaataaaaaaaaaaaaaaaaaaaaaaaaaaaaaaataagaaaaaaaaaaaaaaaaaaaaaanttaaaaaaanaaaaaaaaaaagagagagaataaaaaaaaaangnatnngggtnannaaaaaggatacaaaaattccctgcnaagngctaagtggtcnaaacnnaaaaaaaaagggtnntctgggtggtgtcntagaaanatncagtgccggttnnnnnnnttagggactataagaaanaggggattaanaaatnaggctgcatattaacatgattttattngactntgtcntcacgcttttgctttattanttttnttngcccattgntanaagcttcnttananntttttttagcactgccatcaatgnttagntttttttttnttattcatttgttttcccagctctactccccattggtcanatntgtttnttttccaaatgatgccctnaacgaagatnttttgctcatanatggcgaccaaggctccaagcatgaatggtgtgagcttgntgaacanaataaagttggttgggcgatttccttcaaanaccttatgtggcagcagcctctcaaggtcctctggactnttgcccgcagcctggagctcctttcgggcctcntccgtcgattttcncctcatcagggcctctgtctgggccaagaagttggccaggaggatcttgtgatgcagacccttccgtatggggtgctgggtctggaccgggatgaggaagtcacagggtatcatcttggtgccttngtggatgagctggtaaaaagcatgctggccattggtccctggctcccccacacaatggggcctgtctggtggtccacacgggttttttttttngt

SEQ ID NO: 564175 - DNA, 800 bp, Homo sapiens
  misc_feature (328)..(328): n is a, c, g, or t
  misc_feature (336)..(336): n is a, c, g, or t
  misc_feature (346)..(346): n is a, c, g, or t
  misc_feature (358)..(358): n is a, c, g, or t
  misc_feature (363)..(363): n is a, c, g, or t
  misc_feature (366)..(366): n is a, c, g, or t
  misc_feature (388)..(388): n is a, c, g, or t
  misc_feature (417)..(417): n is a, c, g, or t
  misc_feature (425)..(425): n is a, c, g, or t
  misc_feature (428)..(428): n is a, c, g, or t
  misc_feature (639)..(639): n is a, c, g, or t
  misc_feature (730)..(730): n is a, c, g, or t
cgccgcctctgagtcccgcgcattcaccttctgggtactctgcttctggagcgtcggttgtcggttcccccaggttgttggaccgccccactggcccgctgtacatctctttggattgtttcattgaaggacccttatgggcgccggtcctttttttttttcttttgaaggaccggtttctctctgtcctgactcttggggtctgtggccctggccatgagtgttttctagtagtagattggagggaagctttgtggacactttacttggggttacccagcctcaactgggccagacccattaccgtccaccggcaccgttcctgccnaggccccnacccccaggnagtctctccgcngagcnttnttggtgttgccctaacttgccngtggcctttgctcagagcctcctcctgtnacatgtgnacnatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcccactgaagcgggtnttcctccaggaacggggtcccccaggcgtgttgttttaaataacctgatgctgtgtgcatgatgctggtgcttgaccatgaaaggaaagtntcatccttaaaatgtgttgtacttcacaatcctggactgttggttcaagtaaaccatatcccctttttga

SEQ ID NO: 564176 - DNA, 996 bp, Homo sapiens
gctgccgttgcgtggtctggccgtctcgttcttggcctcgttgctctcgcgccttctcgctgtgcccctgcggtttgtccctccgccccgcgccttttacccccgagcgcgcccctgccctcttctgtctcaccgcttgcttttggcccgctcgtctctccccctcgcatcctgccatccgcccgccgcaagccatttttctcctcgtatccttcttctggcccacctgtctcttcccgctcgctccctcgactctcacgctgtcccccctggtcacctgcggtgtgtcgcgctctgttgttctctcttcttctgttgtcctcttttcgtttgtgctctttcgtttgcagttcgcgagtgttgtagttgtttgctgtgggatgttttccgcttgtttttttgtctgttgcctagttgtatgattgttttcgcttccgatctcatctcacttcttttagtgtgcattttgttgcttgtgtgtgcaaaaccatcctgaacagtggttcttagctcagattttgggtagtatatgcaacacaacgcaaccgttctctgccttgttttttgtttaatgagagaatttggaccatgtttgactgtgtttaaagtgcctggcatctctaccagccaagtaaagctggaagatctgttactggtagaacaggttgaggagacagtaggaatttgttgattagtcatttgatttataatctaacactacaaatactatgtgttatttataaaatgcataaagaacagcttgttgtcagactgccataaatgttgtatatagcttccaggccataagagttgagtggtattattgatgactttgtagattaagttagttatgtatgaaacaaagcaggtaatatatatattgagaagggatcgtgtttacagaggacttctttaaagtgtcacatttttaaaatgtaaacagtattgtttaatgcatacttaagtaatatttaagtaactataaaccgggggata

SEQ ID NO: 564177 - DNA, 391 bp, Homo sapiens
acgagcctgactggcgaagcatgggctgcagcatcgacgttcatacccacggacctgcgccactcagagaagcagcacatggtctcagcctgaagccatcaagcggcacggcatgcccttagccttcgcgagatcgatgggttgtagctatacggcgtagtgtcaacgagccggcctgacacaccggggcctgcggactcaaggcctatcgacaggaaagtccggtcgccggtcgcgcagcatctctcgcgtagatgtcgccctgcagggacccactcgcgtgggtaccctgacctaccaaacgatacctagttagcaatatttaataagcttgacacataggatagaagagctctgtgtttgtctacctgcctccagttcgccgggcact

SEQ ID NO: 564178 - DNA, 394 bp, Homo sapiens
  misc_feature (137)..(137): n is a, c, g, or t
acagtttccatggtcccaaatttttgaccttcccccggcccgggaggtgcagcctgggtttgcctttgttgtgtgtgctgatttgagtggcttagcttgccacagggcaaccttttttgtccctttcagtcatttgntggacttccctgtggcacgttaccatggaaaccgctccagggtgggtcagggtgcaaactgctggtaaggtttggaagcatcaggctcccgggtgtttaatgggggtttgggggggggggggggaacgggtaaaaaactgaagggtttgtacggaatgccctttgctagccatggggtggtccccaaattgttttgtaaagcccgccccttgcctcgatattgccagttttttgtgcaataaacaatcagcaggtga

SEQ ID NO: 564179 - DNA, 493 bp, Homo sapiens
  misc_feature (61)..(61): n is a, c, g, or t
  misc_feature (133)..(133): n is a, c, g, or t
  misc_feature (144)..(144): n is a, c, g, or t
  misc_feature (171)..(172): n is a, c, g, or t
tgcatttgccgcccctctactgctttgttaaaccaaagaaacacaaaatgtaagaactagntgggcagaatcatcagcagagagccccctcactgtccattggcccggggggcccccccccttttggggtggnaaggggccaanctttcccaaggggaaaaaaaaaaagcnntacagcagtcacttacatgacaacaccaactttcaatgtattggttcacatattttaattacatcttggtccctaaagaagcctgcagccagcaaacagacccaggcacgaaaagtaaatgagtctcaaactgattagcccaataggaattggacaaccccttaaggggctctagatggtgaaggacacgctgtttgccctgccattctgcagcacaaaaatccaggcaggtcgaagagggcggacaccctcgcgtggccaccagcccggagccgcagctcacacagcggcctccaaggcgtttcgcaggcagtccccaca

SEQ ID NO: 564180 - DNA, 658 bp, Homo sapiens
  misc_feature (15)..(15): n is a, c, g, or t
  misc_feature (68)..(68): n is a, c, g, or t
  misc_feature (111)..(111): n is a, c, g, or t
  misc_feature (137)..(137): n is a, c, g, or t
  misc_feature (154)..(154): n is a, c, g, or t
  misc_feature (159)..(159): n is a, c, g, or t
  misc_feature (164)..(164): n is a, c, g, or t
  misc_feature (168)..(168): n is a, c, g, or t
  misc_feature (186)..(186): n is a, c, g, or t
  misc_feature (194)..(194): n is a, c, g, or t
  misc_feature (204)..(204): n is a, c, g, or t
  misc_feature (216)..(216): n is a, c, g, or t
  misc_feature (221)..(221): n is a, c, g, or t
  misc_feature (224)..(224): n is a, c, g, or t
  misc_feature (246)..(246): n is a, c, g, or t
  misc_feature (275)..(275): n is a, c, g, or t
  misc_feature (283)..(283): n is a, c, g, or t
  misc_feature (286)..(286): n is a, c, g, or t
  misc_feature (497)..(497): n is a, c, g, or t
  misc_feature (588)..(588): n is a, c, g, or t
ttttgtgacaacttnagtcacgtgtgtttttgtaaggaaggaaattaattttggttcccaggatgtgnttagagggatcatttttgtacgtgagggttttttaacactttnactttgggtttcactcaagccgtccnactgaacaagacctatnaaacnagtcnaacnaggctaccgttcctgccnaggccccnacccccaggnagtctctccgcngagcnttnttggtgttgccctaacttgccngtggcctttgctcagagcctcctcctgtnacatgtgnacnatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcccactgaagcgggtnttcctccaggaacggggtcccccaggcgtgttgttttaaataacctgatgctgtgtgcatgatgctggtgcttgaccatgaaaggaaagtntcatccttaaaatgtgttgtacttcacaatcctggactgttggttcaagtaaaccatatcccctttttga

SEQ ID NO: 564181 - DNA, 126 bp, Homo sapiens
ggatagctttaacctaatcgcacctacgtattacgcggctgtggcacgtagttagcggtgcttattcttcaggtaccgtcatcctcccggggtattagccagaagatttcttcctgacaaaagcag

SEQ ID NO: 564182 - DNA, 541 bp, Homo sapiens
  misc_feature (254)..(254): n is a, c, g, or t
ggctggtacggcccggaatgtaatggatcaagatggcagaagtatagcatgatagaagaagcggaccttccgcaagttcacctaccgcggggtggacctcgagcacgctgctggacatgtcctacgtagcagctgatacatctgtacagctgcgcgccaccggacggacggctgaaccggtggctctgcggacgagaagtcagacactccctgactgaagcgcctgcgtcaaggccaagaaggacggcgccgtncctatggtagaagccggaatgctggtagaagacgacagctctgctgtgacatgatcatcctatcccgagatggtgggtcaggcatggtgggctgtctacaacggcaagaccttcaaccaggtggatgatcaagcccgagatgattcgagcactagctgggcgagttctccatcacctaccaagcgccgtaaagcatggccggcccggcatcggggccacccactcctcccgcttcatccctctcaagtaatggctcagctaataaaggcgcacattgactccaatag

SEQ ID NO: 564183 - DNA, 92 bp, Homo sapiens
gggggccgggggggggccgcccttttttttttttccccccccttttttttcccgggggcgggggggtttatggttttgttgccctcccccca

SEQ ID NO: 564184 - DNA, 175 bp, Homo sapiens
gagagcccagcacgtcatcccctgatctgagtctactgaacacctgttttatggactacactgtcttttcctttgaatccccacttctcctggaactgtacttggaccaccaggaacatcgtaagacacaacccaatacactcaccgcattcagacaactgtccagacactgccc

SEQ ID NO: 564185 - DNA, 417 bp, Homo sapiens
tccgactcttccttggcttcaaccttagctggggctgcaacaacagcaggagcagctgtgggggcagcagccacaggggcagcagccacaaaggcagatggatcagccaagaaggccttgaccttttcagcaagtgggaaggtgtgattcggctccacagacaagggcaggactcgtttgtacccgctgatgatagaatggggcactgatgcaacagttgggggtggccatttgcagacagacactgtggacattgtgggcaccccttcaggaagcgggaatgccgaggttcctttgggatatcaaacaccttaaggggtgggaatggtgcccttggcgaacccccgctggggtggccccccccaaaaggaaaggggggggagtgttatcttttgtatggagtgggtgtttgcgtgt

SEQ ID NO: 564186 - DNA, 116 bp, Homo sapiens
tgaactcaagaaagtattcatagtacagcgacacagctggcagcagatctattaaataccatgctgatcatgtggtctaaaagcatttaaacttactggaagtagaagggaattta

SEQ ID NO: 564187 - DNA, 668 bp, Homo sapiens
  misc_feature (1)..(1): n is a, c, g, or t
  misc_feature (83)..(83): n is a, c, g, or t
  misc_feature (133)..(133): n is a, c, g, or t
  misc_feature (145)..(146): n is a, c, g, or t
  misc_feature (162)..(162): n is a, c, g, or t
  misc_feature (202)..(202): n is a, c, g, or t
  misc_feature (204)..(204): n is a, c, g, or t
  misc_feature (213)..(213): n is a, c, g, or t
  misc_feature (227)..(227): n is a, c, g, or t
  misc_feature (231)..(231): n is a, c, g, or t
  misc_feature (235)..(235): n is a, c, g, or t
  misc_feature (237)..(237): n is a, c, g, or t
  misc_feature (239)..(239): n is a, c, g, or t
  misc_feature (251)..(251): n is a, c, g, or t
  misc_feature (255)..(255): n is a, c, g, or t
  misc_feature (275)..(275): n is a, c, g, or t
  misc_feature (295)..(295): n is a, c, g, or t
  misc_feature (302)..(303): n is a, c, g, or t
  misc_feature (335)..(335): n is a, c, g, or t
  misc_feature (342)..(342): n is a, c, g, or t
  misc_feature (344)..(344): n is a, c, g, or t
  misc_feature (361)..(361): n is a, c, g, or t
  misc_feature (386)..(386): n is a, c, g, or t
  misc_feature (399)..(399): n is a, c, g, or t
  misc_feature (405)..(405): n is a, c, g, or t
  misc_feature (420)..(420): n is a, c, g, or t
  misc_feature (530)..(530): n is a, c, g, or t
  misc_feature (654)..(654): n is a, c, g, or t
nctgtttaaataccacatatgctaaaaaccgacgccaggccattctctaaatgagttacaaatcagtttccggaaaggaagtnctccatgaaaagcttatagcaagataactcacgctttcacgcggcgtatngcacgtgaatcnnccttacagtaattgtntacatagtatgtttagtcattattcgcaatcaaaacttcncngcggagtgnccttttttcaaggncatnacgncngnagaagaaccgtncaanatagccttttgttgcctgcngagggatctggcgcattgcngggcggnncaaatacctgcagatagaatattcaccgcagnctacgtnangttcagagtgttcaggntcatttctatataaaactacaattngctgaactatggnaaaggnccttgaacataaagnctttcttcatttcattgcatcttaataagtagaatgccactaccgtaaatgctgcttatatgtattttattcacatataagttatgatttttctaactaccctctgtagntataaatttttcccttcctgaaaatctctcttccacacctgttctgcttgtccctttgttccctaaagcctgtattttttctttaaggggatctattttcctttgaaacaattgctggaaagcnagcctcagaaaggt

SEQ ID NO: 564188 - DNA, 171 bp, Homo sapiens
aaagcatattcctttttggttgccttgtatgtagaaatcagttctccaagtgcctgtgaatggtgccacttaggagtagagcctgatgattgttgacatggcctctgggtggtctgacatagcccagtggaaacaggtagctttgtaggcaggaggccattagtagcaatg

SEQ ID NO: 564189 - DNA, 211 bp, Homo sapiens
gaagtatgtaatgacgtttggttttatgaaaatagttttgatttcccggataccctgaaagctgttcagaccccacagacgtcctcagactacacttcgagaccaccgttttagtttttgctctctctctgtcctggacgacggcactttcgcctctagctcagcccagcgcctggcagctgcacactggcgacgaatcctcgcgcctcga

SEQ ID NO: 564190 - DNA, 717 bp, Homo sapiens
ctgcgctgtaggctcagtctttgccggcgtggccgtcgccttcctgggcattggacgttctcggagtcgtttcttcgttcgcttcgtcggctgtgtgcgcgcccttctcgcgcctcggggctgcgaggctgggcgaaggggttggacgggggctgttgatcggcgcgtttaagttgcgctcggggcggccgatgtccggccgggcgaggtcgacgcgccgtagctgtcagtgagactgagcctggtcggtgaccggaggggtgatgaggatggaagacgtggtcgtctatgcgcggcccatgtggactgtgcatgtgcactgtgatttgtgcaaaggacctagactgaaagatgaagtggacaggccagaagaagagaatgccatgtgcctaagtcctccagtctggaattgacatgatgaatactgtgtgagaatactggtgtgaccagaaaccggaaggtgactgagaccgacgatgatagtgatacgtgacagcgatgatggactgacatgatgatgttgcatgtcactataggatgacgattaatagaggggacgcaccgacgaggtatgggaagtcatgggtacagcgacctgtgaagctcttaactagtcaatgaccgggggaagacgtttgatggacacttacgagggcacagagaatgtcgaacggcagtagaccttgatgcgacctggaagcgttaatgggagttcca

SEQ ID NO: 564191 - DNA, 975 bp, Homo sapiens
  misc_feature (6)..(6): n is a, c, g, or t
gagcgnactagaaaagagaaaggcacacgaacgaagaaaagagtagtgctgtgtgccgacagggaaacttcggtggaacgcgccgcgggtgacaaacacgtcggcagattggttcagcggcacacgacctgtgaggcctcctgggtctgcccgcccccagcaatagtggcccttgggcaacagagtcgtgttccgttgcaaggagggcaccccgtttccggtccaacgggccaggccaagggccggtgtgcaacgtggcgcagaccgcatcgtggacggggccccaccacggttctctcatgggggctttaaccgctgtgggtgccggtctactttcggggcaaaatttaatgcacgcgtgagtcgccaatgaaaccacaggggccagttgtttgtggaaagaccagctccgggtgcttgggccaaaaagataattaattactacgggccccatcaaaatgaggtaactattagtttcgccggggagcccccggcagtaattgtgagttttttccgaagggccaacagcttttgcccggagaagcccgcaaaaatatgtccccgcaatgctgttggcccgccgtggtcaacatttgtgagttgttccctcctgtcggtccgtcgatcccgcggccgaagtgtaaaacaagcatctcgggggtaaaccacacccgaggaagtgtatgggaagcgtgtggcaaacgagtgtttcaagtgctccaagaagggagttgtacaaacatgtgcgaaatctcaggacacaaccactgtggccgacacatatccttaagagtacccgcgcttgtattataaagcgacacgggcaccacaaatgggcccactgtgggaaaccaaagatatatggaccggcagtacatagaggagttggggagtaagctcgtgcaattgtttccgcggttcaaaatgccataatattttggattcgcaatcttgaagggaaaaccccacaaaaca

SEQ ID NO: 564192 - DNA, 749 bp, Homo sapiens
cgtgctcgcgttgggggcgcgtcagatcacgaggtcaggagatcgagaccatccttggtctaatcactggttgaataccccggtctctatctaaataataagaaacaataaaaattataccgggatattggtggcatgcagcctgtcgtccctagactacctcagtgaggtactgtcagtgcgacgcgatgaattggtcctgagacccagggacggcagagcctggcaggtgagccaagcatcgagccatctgctacttccaagcactgtggttgaccaggaaagatgtagcacttcctaattcatccataaaaaacacataacatacacaacatagactttaaaacacaatgagcgcgcgtgtgcgcgcgagagcgaacagcgccactttagttagctcaccgagctgaaaccctagctggagcaagagcgccgtgagagagacaagcgagacaatagggtgtcttgtttagaatccccgcggcgaaagcgcgtagcgcgcgacttgtgcccgttagtagtgagaagctctgaagagaaatcttcgaagtgcccccatttcgggaccattagttggaaacggctcagaggggcgcagaacaataccaaacgtgtggccaaaagcctcacaggttccagtcccatagattatacacaccaaaacaaacatagaaatacaacagtgcgcgggaacacccaaccgaggtaacaactgagaagacgcagcacccatctctgcgccccgtcaa

SEQ ID NO: 564193 - DNA, 294 bp, Homo sapiens
gtgagtgaagccatcaaagtactaatgggaagtgccggcgctttttggatgaactaaatgcggttcaaatggactgagcttggatgcttttgaggcaagctgaagctttgggttttgactgaccccccctacaggactgttgaacaaaaagcccagtgtgactagggatcctgagttttttgggacaattccagctttaatcaaaacattttgttaaatgggccataaaatgagcctttttacgcctttataaggccttagatgtaaataaactccccccaacaaaaaaaaaaa

SEQ ID NO: 564194 - DNA, 372 bp, Homo sapiens
ccttcccaagtgaggactcagtgtattacttgtttgcttcattttatgatacagaccttagaatttcagaattgccaaacccatgcctcccaaacacaaaattaagtcgaatttggcctttccttggtagtccttttatgtctttagattgaaagtatttattccaaaaagtattgtattccaaagttgggtacatttcttttttcttcctgtgtaggtattttaataagataaaatagaattcagtttatttgctttgtgtcctattttagtttttctcctacttctatttgattttactttatttcatgcataatatttaagttcccaaaagtcaaaacctctaaccctatagagaggtatactctgaat

SEQ ID NO: 564195 - DNA, 705 bp, Homo sapiens
ccaaagaccacatcatcgaaaccgcaaacatatcatacacaaacgcctgagccctatctattactctcatcgctaccgtccctgacaagcgcctatagcactgcgaataattcttctcacgcctaacagggtcaacctctgcttccaccacgcctatactaacaattgaacgagagaatagacccacatccgcgtgactaaatgcgccgagttgaaagcgcctgagcagccggagagcctattcgcgaggatttctcattactaacaacatttcccccggcatcccccttcgccagacaagcaagtccgctcctctaccatagaaactcacagcgcctcggctgtcactttaccgtaggagcttcgtaacaggcccgtagaccatcaatctacctaaccaacaaacattaaaagtaaaagtcccctacttatgcacattttagtttctccaacatactcggattctaccactagctatcacgacaccgcacaagtccccatatctaggccattcttacgagccaaaacctgccccgtactcctcctagacctaacctgagctagaaaagctattacctaaaacaatttcacagtcaccaaatctccacctccatcgatcgacctcaacccaaaaaggcataattaaactttacttcctctctttcttcttcccactcatcctaaccctactcctaatcacataac

SEQ ID NO: 564196 - DNA, 128 bp, Homo sapiens
gaatggagacgccattggatgtttggtccagggcagcatctctggtgcatgctgatgacgaaaaacgcgaagctgctcttaggggagaacccagaatgcagaccctgccggtggcctctgccctcagc

SEQ ID NO: 564197 - DNA, 157 bp, Homo sapiens
cggtgactttccgctggatctgagcatagacactaaccacatactccacatgtgggctgcaagcattcaatagtcatttctgtttgatctggacctgcagttatagtttttagttggtcctggatccattttatgggagtggtggttactctgtaac

SEQ ID NO: 564198 - DNA, 217 bp, Homo sapiens
atttgacaagcctattttcaaatgatgtaaattcatcctttccagggaagcagaaggtagaccagtgcaggttatcctcaaggccacatacatcctgcttccctggaaaggatgaatttacatcatttgacaagcctattttcaagttattggtggttgttgctgtcttggtttttgcagctaaaataaaaatttcaaagtacaacttttagttctt

SEQ ID NO: 564199 - DNA, 242 bp, Homo sapiens
  misc_feature (45)..(45): n is a, c, g, or t
  misc_feature (153)..(153): n is a, c, g, or t
gtctcatgagtggagtgtaaataatcatgctaggcgagatgaaancgatatcgcgatacggttgtatagattgttgaatgggtggtgtgtggcatctggtcgggcgtacatcactgatgaagcagaaggatataattcctacgccctctcagncgatgaacagttggaataagttgttagcggtaactaaagataagtatggtaattaggaaaatgagtagatatttgaagaactgattaat

SEQ ID NO: 564200 - DNA, 330 bp, Homo sapiens
agaggctggctgggcccagttggtgaaagccgtgtcctggtcccctgtggtccacgtgaagccgcgcagtgggcgctgcagctggcattgccgggcctgccgctgcagcccgatccacagcagccggctggctgggcccgcacccaccaggctgtccacacgctgggcctcctcgggggtccgaggagtggccaggtcgccccccagctcgcggcaggcccgccaggcctccaggaaggtgcggcgccgtgggaagagagcgtagcagctgctggggccgcaggcggcacggggctcagcagcccaggggtcctggcccagtgtgggccc

SEQ ID NO: 564201 - DNA, 121 bp, Homo sapiens
aggtgcagtagtttcccagggattacacagggatttagtacctggccttttaaggccctccaaaggtcaaaggttttgttttgcccctttcctagcaccccttttaccccttttagagcca

SEQ ID NO: 564202 - DNA, 272 bp, Homo sapiens
tgggtttggtttttgttttgttttgttttgttttgtttccaaaaaaattaagaattttaatgttgaaaaaccggcccaaatttttatggggcaaagcctagaaaaaagaaatgtagtttgaatcataatttaaatcatcgtatgataaaaaagggaaagttttggggccaaaatttttcctttccctggggttggacttaaatcagttgaaatgtatttttgtcccccaatttacgcttcaaaaaaagtttaattgtttagtgacattcaga

SEQ ID NO: 564203 - DNA, 728 bp, Homo sapiens
ggtaattacttcaacagcagagcgactcatacagccggcagtccacttgttcttctatagatcctgcctgtggtgtggatctaacagcttcttccctgacccaagattatgaaggatttctcctgtgttctcttctaaaaattttacatttaggtacataatccattgtgagctaattcttttaaatagtgcaaagtatggactgaagttcttttttttttttttggggagatactttttaaattttccagcacctttggtggaaaagatagggtttggccggaatagccttgggctatggttgggtggaaaatcagggtgcacacttgtacactttccagtggatctatgggcctctgggtggacaatactactattcgggagtaaatatatatcataggggagtctaaaaatcatatcttaaaaagatggtgggaagtatttacccttactcgggctttgacaaattgggtgcggggatatccaagatctcggggtgccatataacgttcgtataatccagtggggcaatttattcaaaatattcctcgggggatttggagggctattaccgtggaatcgagggatcgtgtgcgagacaagtgagcttcttaccaatttggagtcatctaccattgtgatccgggaactgggtccatttatttagatcttcttgccaaatctggaagcaggggttgcggtaccagcgcaataggattcaaatagag

SEQ ID NO: 564204 - DNA, 111 bp, Homo sapiens
aaaaaccgggccccccccaaaaaaaaattttggcccggggttttttgggggccaaaaaaaggcccccatttttttttttccccaaaaaacctttgggggggtcccttccca

SEQ ID NO: 564205 - DNA, 146 bp, Homo sapiens
tacacacactgtctctaggaaaggagaaagctacccatacggaaagaaccaagctacccatacggaaagaaccaagctaccatacggaaagaaccaagctaccatacggaaagaaccaagctaccatacggaaagaaccaagctac

SEQ ID NO: 564206 - DNA, 108 bp, Homo sapiens
tccatatttttccacagggagggtgatcagattgtttgtaccatatccggaaaagttgtagctttcaaggaagaactgtaggaatagtcacagcttgacaaccgaaca

SEQ ID NO: 564207 - DNA, 135 bp, Homo sapiens
aaccttgaatacctgtaagtctgaatctagagtatcccctgcaatcacgggtgacaaactgaactttatcatcacaaagcaaaaaaagaaaatcacatcttcacaaatcatacaatctattaaactgaacatgag

SEQ ID NO: 564208 - DNA, 518 bp, Homo sapiens
agatccccctttccatcgcgtgagaattccgggtcgaccttcaagatgatgaaagcctaaacgaacaggcacttgaccagttgtaattctccacaggtgacatgtagctgaggtggctcttcacagcctcggggaggcaggctccttctactcttgtcctgccttactatgaccttcacgcctaagatcattttctggccccagggtggtagctcctactccagccatctggtccacattccagagtgctggatggaggaaaggtgggggatgacgccttcccccttaagaacacttcctagaagctgcatataccacttctgttcaacatctttttggctagaatttggtcacaataccacacctaatttcaagagacactaggaaaataccttgaatccatgtagtcatctgcccagctaaaaatcagagcttctacattaggaaggggagaatagataccgagataactgatctatcttgccacagttctctccctagtaccgtcctgattactc

SEQ ID NO: 564209 - DNA, 366 bp, Homo sapiens
accttcaggagatagaactgcagtcccagctcagcatgaagcatcctggagggcaacctggcggagaagagaaccgctactgtgtgcagttgtcccagatccagggctgattgggaagtgtggaggagcagctggccagcttcgttgcgagatggagcagcagaaccaggaatacaaaatcctgcgtgatgtgaagacgcggctggagcaggagattgccacctaacgggcgcctgctggaagggagaggatgccccaacctgactcagctaacaagaaaaggaaccggtgaccacccggtcaggtgccttaccatttgtgggaagaggtccgaggatggcaagggtcaatcctcctccccgggga

SEQ ID NO: 564210 - DNA, 1682 bp, Homo sapiens
  misc_feature (2)..(2): n is a, c, g, or t
  misc_feature (921)..(921): n is a, c, g, or t
gntcgtatatagataaatgatatttgttgttagagaagactaccagtggaagtatgtctgtactcggtcacttgtgtttagtgtacgctcatgtgcttgcttgcagtgcatcgtttatcttggtggatggttgtttgcgcttggtagctgttgtctgttcgtgtggaggtgttatcagctctgtgggttgttctgtgaccgatatcgtcgttgtgttggtgtgtgtgctatctcctacgtcgatctgtttgtccgtggagggccgccgctgcggtgctgtctcgtccgcccgagggtgtcacgcacacggtggtggtagtggttgggatgccttcgttcctgtgcccccgtggggaacgctggggtgttcgaaccgacacaccggcggtgtgggggtggccaccaccctgggtgtgccccctgtgcagcgtttttctccccgcggatggtgtgaatttgctggtggtcgttagagcggccccccccgtggagtgctgttgtggggcggtggacctctcttcttcccctcgggggggaccacacattagttgggggccgttgcctaaatgcttcccagaggaatattgtgtgtgcattggtgctcacatgaggatgtttgtgtttcctgttcgtgtggggccaaaaccggtggtgcccttcgtgttgctcccacgcccccagttagtgtgtgtccgcccccccccctagtggcggaacgtcctcgccttgggctttttcacccttggcttctccagggtggacttttatgcccctcgggagcccccttgtccccgggcgccccttatttttagcgtcccccgggcttatttgccgccccctcgtgattttgggggtttgcccacaccacgggcgtgccacaccatttggggcactggacacaatgttttcgcctcggagggnctcggataagtgagaaaacagagtttgagttcgcccccttttctcgcgtataaaaaacagcccgtgagaagagtggcgcccctcccaagttttctctggagaagtttctcgcgtggagatgccctcgcccactctgtctagataatattggtgtttcctggggccaaaggcccccacatcgtgagtggttcgaggggagcttttctccacgagctatttccaccccctcttgtggtcgccttcttgctcgttttcctcgaatatatgaggaccacgaccacgctttccgcgttgggtggctcactcacaaagccccgctgtgacccacagagaagggctcgcctcgggaggccttggcccaaggtcacccccacagttctgcccacgagaacgtcttcacgaaggcctataaatgagatatttattcccttaatatcctgccacccccaccttcttataatcacgctggtggagaagaaccgggtttcacgagacctcgtttgtttccaattggccacatttatagtttagtagataaaaagaactggttaaatgagtaacccactgcactcgttaaaccctctcacgaaaggaaaaggagaaatgttttgtggagcccctcttggttttcttttttgcgtgtggccgcttttaagattattaggtttttataaatccgtactttttaatggaaaccaccttgcccccaaatttgtccccagaattttgagaccccctttaaaaagttctaatgaggaaca

SEQ ID NO: 564211 - DNA, 375 bp, Homo sapiens
atactattctgatctctcggtcacctgaagttatatctatatacctaccaggcttcggaataatctacccatattgtaactatactactccggaaaaaagaaccattaggatacataggtatggtctgagctatgatatcaataggcttcctagggtaatatcgtgtgagcacaccatatatataacagtaggactagacgtagacacacgagcatatctcaactccgctaccataatcatcgcataatcccaaacggcgtaaaagtatatagatgactcgacacactccaaggaagcaatatgaaacgatcagctgcagagctctgagccctaggcttcatctatcttatcaacgtaagtggcctgactggcat

SEQ ID NO: 564212 - DNA, 415 bp, Homo sapiens
  misc_feature (5)..(5): n is a, c, g, or t
  misc_feature (22)..(22): n is a, c, g, or t
  misc_feature (38)..(38): n is a, c, g, or t
  misc_feature (81)..(81): n is a, c, g, or t
  misc_feature (117)..(117): n is a, c, g, or t
  misc_feature (124)..(124): n is a, c, g, or t
  misc_feature (332)..(332): n is a, c, g, or t
cgggnataaggccgtgtactgncgatgctggaggttcntaaaaagttccccttctgcgatggggctcaccataaagcacancgaagagactggcgacaaacgtaggacctctgatcnatcaagnaaaaggaaaccttaatggacagttgcgaggctgcacccagcgtgttgtgatgtcacctgctgatttacgtagaatggcacccaacccaccgtctgattggcctccccggttctagatgtggttggtccctgcaaatcacagctctcatatccatggcatcggccttgctactgaaaccatgtggtgcacgtttgttgaaagaagaagnaaggctaaaccaacctcgtgctatatgggttattttggtcttgtaaggatccgttcctttaaaataatggtcttagaatatag

SEQ ID NO: 564213 - DNA, 248 bp, Homo sapiens
  misc_feature (27)..(27): n is a, c, g, or t
  misc_feature (77)..(77): n is a, c, g, or t
  misc_feature (127)..(127): n is a, c, g, or t
  misc_feature (131)..(131): n is a, c, g, or t
tctcccatcctgacatttgtcccctgnagaagttcttagcagggaggagaagagaaaagaggaagcaaagaatcacnaggacctctggctagatgatcctgatgttcctactgagttttctgtatcnaganttctgaaaccgagtaatcatgtctgtttgattgggtggtcatctctccatcccagtgaaatttacctgtagcccagtgaagggtgtgtttggacattcattaaatgatctaacatct

SEQ ID NO: 564214 - DNA, 305 bp, Homo sapiens
  misc_feature (166)..(166): n is a, c, g, or t
cccccccgggtaaaattttttttttgttgaaacggattttttatgttcccccggctggtttcaggctcctgggctcaaatggtcccccccccccagcttccaaaggcccaggcccagttgtagttttttcccctcccctcatgccccccaaaaggttttacacccntttaaagaattgcctttcaaaaattggttatgttggggggccagttttttaagctggaaattgtaaattcccccccaaatgttttttccccccgttccccttaactaaaacccccaaaaaggagggttttgggggtcca

SEQ ID NO: 564215 - DNA, 1087 bp, Homo sapiens
aaagttggtcgtctccgttacatgagaataagagatttattgaatacatgttaaatggatggtcctccgcaccatgacccatcgtccttttccatttaacatgggaaaaagtggtaggagggcccggccatggtagtctatgggcgcagtggctcatgtgtacctcagctttattgaaatgcatgtgtacctcaggcttggtacttagacatgtaaggcccaggattattaacccagcatgttcatacacctcacagtttggtcatgtcaaatatgtttgaggcagagccatgctaaagaggagatttaaaatgcccatggtgaccacgggtcagaggtccaacatgacggaacaggaggctactctgtcccatgctaaggtggttttttttctatattgaactgggaaaaaaatgtttgaaaaattaaaaactgaggtgattgagagcgtgtaggttaccctgtggaaaaagcggtgcatgaggcacagaaatactccgcgtggtggcggacgggacccttctattaaaagtgttacagtgacatagaacattatcgaaacgcatcttttcccccccatgtaaaccaggtagctgtatgaccagtgtagagaaacaacgcctattaacatgttggggcaccagggcgacgaaccaaggtttgtaatctctgtgagagaacgacaagtgtctgtgggaaaacatataccacggcactgtcgtgggaatgtcgcaccacaagttgacccacaaactgtgttcacaatcaaccgccaatatgtttcaccgccacaagtgtttcccagaaaaccctccgcgatgtcctatcagcgggcgaaccgacaagtgtagaaaacatagtcggagttgaggtggatcaacaacccacaaagtttttttcctcccccagtggtgggccatatattggcggccccgtgcgaaagcatcatccactctccatccgcaggggcgacattacatctacatcttataaatattatccgacagtttatacaaccgacttttcttgaaaagcgggtgaacacacaaatatacacaccacgccgacatgttagtggtattacacc

SEQ ID NO: 564216 - DNA, 565 bp, Homo sapiens
  misc_feature (346)..(346): n is a, c, g, or t
ggcattactgccgagtatctgatgctcacctatgccaacgacgccaaactgtatgttccggtgtcgtcactgcatctgattagccgttacgcaggtggcgcggaagaaaacgccccgctgcataaacttggcggcgatgcgtggtcacgcgcgcggcagaaagcggcggaaaaagtgcgtgatgtggcggcggaattgctggatatcttaacgcaacgcgccgccaaagaggcgttcgcgtttaaacacgatcgtgagcagtatcagttgttctgcgacagcttcccgtttgaaaccacgccggatcaggcgcaggccattaatgcggtacttagcgacatgtgtncaccgctggcaatggatcgtctggtgtgcggcgatgttggctttggtaaaacagaagtggcgatgcgcgcagctttcctggcagtagataaccacaagcaggtggcggtgctggtgcctaccacccttctcgcgcagcagcattacgacaacttccgcgaccgtttcgccaactggccggtacgtatcgaaatgatctcccgtttccgcagcgccaaag

SEQ ID NO: 564217 - DNA, 116 bp, Homo sapiens
gatggcagtgctcatcttaaaacatgagcataacatatatttggaatagcagaaggttaagtaatttcttactgtatcgttaaactaacgcagtacttcagtgggacttaacaagt

SEQ ID NO: 564218 - DNA, 709 bp, Homo sapiens
ggaagaaccctggggaaggaatgcattcctgggggtaggtctatagatggccgctctgggagtgtttgtcttatgcggttgagataaggactgaaatacgccctggtgtcctgcagtaccctcaggcttactaggattgggaaattccagccgggtaaattctagtcagagtggttctctgttctcaaaccctgtttcctgtgaagatgtttatcaagacaatgtgtgcacagcaggacatagaccctcatcagtaattctaattttgcctttgccttgtgatctttactgccctttgaagcatgtgatccttgtgacctactccctgttcgtacaccctctcctcttttaaaatccctaataaaaacttgctggttttgctgctcggggtcaccatcatagtcctaccactatgtgatgacagccccagaggcccagctgtaaaatttctgtctttgtactcgttctctttatttctcagaccggccgacacttaggaaaaatagaaagaacctatgttcaaatattgtgggctggttcccctgatagattggaaaagaatgagaccctgcaacttggaatggggaggtatgggaggacactggtgaagctggggtcactgactttgtaaactccaatgaactttttttgccagaagaaacaattcctccccaccagtagtgggcgcattctctcctaaccatgctgc

SEQ ID NO: 564219 - DNA, 136 bp, Homo sapiens
ctatatggagactatcttctggcctccacaggacaaccaagattgaggtcatttctttctcctgagttggatccaatggcttggctgtgaacttatctgattgtgctgtcagaaaataaagttgtatgtaacaggt

SEQ ID NO: 564220 - DNA, 285 bp, Homo sapiens
aatactatgtccatgactagacaagaccactgagtggctataataatagaagacagacaacaacacgttgtcaaggatgtggagaaattggaacattcagactggtggtgggaatgtaaaatggtgcagccactttagaaaacagtttggccgttcctcaaaaagtttaatatagaattactgtgtgacccagcagttccactcctagatacccaacgtaattgaaaacgtaagtctacacagaagctgtatacaaatgttcacaggattgatcattattcatta

SEQ ID NO: 564221 - DNA, 940 bp, Homo sapiens
tggagccaaacctcgccttgtttcgcgccaactgcgaaactgctcaagcgccgcctttttggagctggttcatctgtcggccctttaatatatcgagctgccgttgagcccggctttacaaagtaaagaccccctctagttgttacgcacacaggggtagcacaccgacggtgtcctcttgagagaaatcatttcgttgacagaggggccacgcaaggcacattccttttaaggaaaaggggtccccccgggccgccacttttatcagttgctcaggcgtattcccacaggggttatatcccccggggaactatgtttacgcgcgtaggtttcccccccgcggagccttttttgcggcgaaggccccgtaatctacctgattttttcctcccgttgaaccactggtcttgtggtctcccctccaagaatttacccaccctttcgcaaaatatttcaaggatgttaaaaattgtatacggtctaagagatatagtagtgtaacagccaataccccctgtgtctcaatagatattacttctgtgattactatatagaacgcgctgttttaaaaacaactgtctctttcaaaggaaaaaaaaaggacaatttgtgtgagagcgcggtcacgaccccagtggagtcccttgtcggcccgcgagattttcgggaaccagaccctgagccaaaatacaccggtcggtcaaattctgtgttgtaatagtaagtcaccccaagaattattaggcgtgagtgagagtgcgtggggctacaaatcgcctagtacattcctgacacagattgtgtggagggtgcaggttgtgggaaaaatttttctagcactataggagtaagattgaaggattgtatacgtagtccggtagtcaaggctccgtccagccccaccccgggaccaaaggggcagaccccccccccatttaca

SEQ ID NO: 564222 - DNA, 343 bp, Homo sapiens
tttttgcccctaacccctttttaaaaaggttttttttgcctttccccaacaagaagccatagtttcccgggccatataaattttcccgaaaaaagggttttttttttcccgaaaaagggttgtggggatcctttaaccctgggcccatttagggattttttgttttttttccctgttttatatactggggccaattcccccgattttttaatttttttcccaggggttgggtttttttttttaaatggggaaagggcctttttcggttttttggggtttttgttttttttcccaaatatggaaaaaaaatttaaatggggccataaattttttttagagggga

SEQ ID NO: 564223 - DNA, 172 bp, Homo sapiens
tgtgcagatgggtctcagaggagaggtagaatggacgaaatggtggaggggcaactcctctttcccgcccgagcctcagtttcctcatctgctccctcaggtggtgaggagtccagtgaaccacccgccaatgtgtcttgcatgtggcatggacatggcctgctggagtggg

SEQ ID NO: 564224 - DNA, 176 bp, Homo sapiens
gtcttatcgacggtaccaacacctagaaccaagtagtacttagcaaacatttgcgtgagccaatgagtaatggcacaaatatagggacaagaaagagaatgagccatttgttcttcatgacgacagtgcatgagaatgagtccagaggcacttggggtccaaattcccaacctcca

SEQ ID NO: 564225 - DNA, 152 bp, Homo sapiens
ggcggcaggagttttagttagaaagcggacgcttgtttctaaaaaaggtcttcctgccagatcttttcttggcttttattgacggaatatttattaaatgttgccttttcctgaagagattttttttagcttccaaagctttttcccatcgc

SEQ ID NO: 564226 - DNA, 284 bp, Homo sapiens
ttaacaaaagtgcactcttctactatctactggtatcatctccctggttcattcatggccttatcatgctcatctttttaaaaaggttttattaattttaattggcacataataattatacatattaatggggtacaatgtgatgttttgatacatgtatacattgtgtaatgatcaaatcagggtaattaggatatctgtcatcttaaatatttattgtttctttgtggtacgaacattgaaaatccttcattctagcgtagatatagaagagtgcacttttg

SEQ ID NO: 564227 - DNA, 126 bp, Homo sapiens
  misc_feature (29)..(29): n is a, c, g, or t
gccgcaacacaacccagggagactcaagnccacaggggccccccggctctgagggattcaccgtcgcctcccggtccccgaaggcccacaagggcagaaaggtgagccttatgcactgcctaaaga

SEQ ID NO: 564228 - DNA, 123 bp, Homo sapiens
  misc_feature (14)..(14): n is a, c, g, or t
  misc_feature (90)..(91): n is a, c, g, or t
ggacgaccgaagcncgagctggttcaggtggcagccacagcagcctcagggacctcagcatctatggcctcctgaacagactctgcctgnntttgggtgcttgctggctccgcgagcctgcca

SEQ ID NO: 564229 - DNA, 266 bp, Homo sapiens
gcttgtgcctaaactgaattgacaaatgcattgtaactacaaatttatttattgttatgaactgtaggtctacatataagggaaaagttatgtggaagctgatctacactcagctgatgccagcatacattaaggcggttcacgtgcagagaccaaagcagtgccaccattggccttagcattccgcatactataggtgcttaaaggaagggaaggctttgtgccttcctatcttgccatgatagcttccataatggaatatactg

SEQ ID NO: 564230 - DNA, 836 bp, Homo sapiens
gctggtgtcctacttgatgtcgggtacagatgcttagtctgccctgctggcagtacccacatgacaccaacagacttcgctgtggacatgtgagccctcgcgagctgtgtcgactgcaggattagaatatacctggtgtgagtccagtcagtcataggctggaaaacggtccggagtgtacccgcttccagattcacatgagatcgttgctctcacatcttgtgtctgcgctcattggacccttgcgaggattcttctggctaagttggatttcgatacgaagcctatacacagatcagagactttgccgagtaccattcctggccattggcatggcatcaaggatcgctttgactgccatgtatcatgatgggcacctttgtcaatgtatacaactcgccacgtattagtcacggaggctcgcataatccctagagctagatacttggattcagtgatgttcctgactttacggaggcagatcaatgcagcgtcctactatcgttctacacacagcgtgcggtctcatctgatcgactaagggatgctgatgtccaccacaagaggaacgaggtacgcgggccacccaggtctggaataacaggaacagaactgaacatggggcaggtcgtccaaggcgagtccagttggtgtgacttagacgatgacgaggcttgaagatcactgtgcttttgttggaatctctgaagggaaactctgtatgcgggggtgttcacataccctcgtttattcaggcaatgggttaaaaattcggggtgatcacccccccccttgggttggccaaaaaccgggttgaaacccctgggttttaacca

SEQ ID NO: 564231 - DNA, 495 bp, Homo sapiens
ctagccttactggaactctgtgaaaggcaagaagtcctgccacaccgccgtggacaggactgcaggctggaatatccccattggcctgctcttcaaccagatccggtggctcctgcagattagattgaatatttcagtcagagctgtgcccttgggtctgagctgagatctaatctctgtgctctgtgtattggcgacgagcgagggttagaataattgcgtgcccaacagaaacaaaatatagtacggctacactggggctttccgttgcctggatgacaatgctggagacgttgcatttgtaaaagatgtcactgtcttgcagtagctctgattgacataacagtgtaggctgggcttaggatttgaggctggcagactttgcgctgctgtgcctcgatggcgaacggtgtcctgtgagttaggctatgaagctgtcgtcttgccatggacccgtgtcatgccgtggtgtctcggatgggggggcggatctgg

SEQ ID NO: 564232 - DNA, 656 bp, Homo sapiens
tttctctctttaggtatctaagatctttgaacacctggacctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttatgtttcagactattgttagaaaaacaaaacaaaaaacaaaaaaaccctcactaatttgccctaattggatagggcaatcagaacaaaatctgactttcgaatatttaaaagatatgtaagtttgattgcattttcgtacattttaagcaaactaggttaacaacaacatagcctagtcaaacttctcaggaaacttgttttaataaatatgtaaaaatacccaaaaaaaaaaaa

SEQ ID NO: 564233 - DNA, 1143 bp, Homo sapiens
  misc_feature (1134)..(1134): n is a, c, g, or t
agagatccactgttctaaaaaaaaaaaaaaaaaaaaacactaaatgtgtgccttctcccttaattttataagaagagtaattagtaaaaactggttttaaactatatttttctttttttctaattcccttctcagttctcctttagatctgcctccttacaaatgatcatgtggttggcatctgcctgattgagtttcccttgggtcaaacctctccctaatcacttatcagaagttggtccactaaatgtttttccctaatttcctttcatggtggattggactttataaagtcacctgggtaaacctttaactattgggctaaccttctcatgctttataactgacttggatcgaatgggcagtttttatattttaaccctttaacaacgttggtcagggaaacaactcagagctaagaacaaaatctaactgggaatccgtttcttcctttggctgctgaagcagcagcaagtcacgtaacctcatttagttctctggatttcacaaaatggtggataataacctacctcacagatgttgtgtgagcaactggtttgaaagcccttggtttaactcacgggtttatattccccaaatttccactgtaaaatttcgtcttttttttaaccaccaatcaacgtctctctgacacctcgaatagggaagaggattcccgacttcaggaacgaatccacgtttcccacactggtgcgcgtcgtcaacggtgaccttctatatttcttgggacctcccgtttttcacttatccactctgtccgctgtcgtcccatttctcgatcctcacaggtggcgcgagagcgcctttgtccccaatagcgtcttccaacggtcgcccattctgcgtgtcgccgctggcacatacgtacacatggtgggaaactgggcagcccagagggatctctcatgttgccgaacaacgcggcgtcctcgtcagcgataaaacaaacgggtgtgacgcacaataagacggccccgtgtgttgaaggcaccatatcactcctctttagccaccgcgatattctcccagagaaaaggacgatcgtcaatcaattccattgactctcgcacgctccctcccccacgcattacctccatttctattctttcgtgngaggggggt

SEQ ID NO: 564234 - DNA, 626 bp, Homo sapiens
  misc_feature (544)..(544): n is a, c, g, or t
aggcggcgagctcgggggccccagaaaatgaaactgaacccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcagagcngtccactctaaatcctcccccccccactaccctcccctctccctcctcttttgcctcctcccccaccaccttccccccccgc

SEQ ID NO: 564235 - DNA, 435 bp, Homo sapiens
gtggggtctttgcgagtctactggagctgtgcgtgggtgacagccctgcctgtctgaagggggtcgtgtttcaacagggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcaggtagtccgagtcaatagtttgggcagaatgctcccttgcctggtgcaatgctggacaggccgggaaggccaactcggacttccgggcccttgagtccctgccagtcggaggaaggctgcccaggatgggcgtatacgggtcacccttgggttgtgacagagcaacgagaaatcaggctggggtcctggtgactctgaagccacaatcgaag

SEQ ID NO: 564236 - DNA, 292 bp, Homo sapiens
tgccacaaagaacggttacataataaaaaaattctttttctagcataatatggtactactaacagttctggggggcaggaaactattcctggaacatgcagtagttcttaaatggtatcccatttagatgagaaaacggatagatgtatttagatggcttagtcacggattggacctcgtgggatgactttttacatgtggctgttaaaacggttctattttcatccaaagcacattcggtgacctttaggatcaggatttcaaatgcggtctaccatctaacagggtatct

SEQ ID NO: 564237 - DNA, 474 bp, Homo sapiens
aggcggcgagctcgggggccccagaaaatgaaactgaacccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaagtgagtgcactgcctcggctcccctccgcccccgtcactctgcgccaggaaaatctcactgcacatacagctcgaggtcgg

SEQ ID NO: 564238 - DNA, 189 bp, Homo sapiens
  misc_feature (92)..(92): n is a, c, g, or t
cgtgcagataacaacagtaaagacaggaagtctcagcccatgggactctggagcacaggtggaaggaatggcggattggacagcaggacagncaacttcagcaaggcagggaggacatctttatggagcacctgaaagacatcgtggagtattacaacgcaccagtaacgggtctcacgtattgcaggc

SEQ ID NO: 564239 - DNA, 578 bp, Homo sapiens
  misc_feature (496)..(496): n is a, c, g, or t
aggcggcgagctcgggggccccagaaaatgaaactgaacccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaaggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcagagcngtccactctaaatcctcccccccccactaccctcccctctccctcctcttttgcctcctcccccaccaccttccccccccgc

SEQ ID NO: 564240 - DNA, 881 bp, Homo sapiens
cctttataaagcgcgctctctgtttatcccccctttttggagaggtgctctttaatcaagcttccccgcggtgttccccccgagggtcaacattgttgccggcggccccccctcttaagaggtggtcttctcacgggtggtgccccctctgtccctctcgctatggggcccacctaagtctcgtcggtgtggctctgttaaccaccgcgccgctttttcacccccgcgctagatggtcggcctgttctctcccgagacatgtttcgctcccgcagcgggtttatcacacgctcccccccccgccgtgtgcaggaacctcactccgtttgtgtgggatattttctcccctcccccctggtttgccatgcaacaattatctgctttcccatcgctccccccacgcgccttttcattactccacctacgagctctgtctccttctccaaccacgctctttatctctacactatataagcgccccccctgccgcctcctactaaatctatctctctactatctccctctctttgaaatatatcatcttcgagcatttccctcctacgattgtccatacatagtggtggcctaattatatagataaatacaaagtcgtcccatctacacacccctcgcaactatctacacgcacgagaatgtatgatgcccccccccactcatgcatcacacttggtatatattataataaacaacaacaaagcaatttctagtaaaatagaccactcacaagttattaagaataagaaatatttcggtccacaaccacccagaaggtgctataataacaatgtctgtagtaccactcatccattgtttctcgcttgttatgttttcccccccccgccccccaaacaaacaaaaca

SEQ ID NO: 564241 - DNA, 328 bp, Homo sapiens
acctttgcgctgtagccgcaatgctgcggcaggtgcaacaacatcgacagcataaaatgtgccaactctaaacaaggcatttctgaaaatcacacaaaacactaaaattccatccaagcttcctcccgactccagcagccacttcgagtcatcccgcccatccttctccactaccgccattgcacacatgactgattccttctatggctacgacgttatcgtcatcggtgctggccatgccggtagcgaagccgctctggctgccgcacggaacggagcacacaccctattgctgacccacaatattgaaaaccatccggtgcaatga

SEQ ID NO: 564242 - DNA, 348 bp, Homo sapiens
  misc_feature (44)..(44): n is a, c, g, or t
attcataatttaatgaatattaatattatcaaatagggactaanaagtaatgaaatcaggccggatgcagtggctcacgccctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaa

SEQ ID NO: 564243 - DNA, 170 bp, Homo sapiens
  misc_feature (162)..(162): n is a, c, g, or t
cgggttgaggttaggggagagagagcatgcagtaactagtaagttaatggagtgctgggagttaagtacatggtgatgaagttgatcagtgcagcaaaccaccgtggcagcagcattgtcttatgtaacaaacgtgcatatcctgcctgtaccccgcaaatntaaaataa

SEQ ID NO: 564244 - DNA, 332 bp, Homo sapiens
ggatgatgcgtagagacaggaatataatgacactggtacttattatataaatgacttggtctccactgtaaaatactatcatggtataagactaagtgttagcctgtagctcgttaaaacaatgcacagccacgaagaatggtctccggttaggattgatgatcaaattcattgtatgatatgtacttcaatccctgcattaaactcgcgttagctgtcatggaattggattgcgtgtagtacacatagtatgctcaccaattcttctcaggaggtcttgttccattctctagggtagcttccaggccataggggccaagcttgattgatcc

SEQ ID NO: 564245 - DNA, 457 bp, Homo sapiens
ctgtttacataaattctaggtttctcctatttacctcaagcacgtatggagtgaattcttaccttttaatattgccatggattcacattgaatgtaagttgaactctctcatatggtagctgggttcagattcccttgacaatttccagttctaaccctcacagttcctcagtgtggctggcccagatactgaccctacacagttgcctccccctggtgactacccgccatggaaccgttggatacaatctgcatgactcaccccacagacctcacagcccacttggacagcccccacacgccagagtgacctgctcagttgcagtggaagccaagaaatgtgcctgctggcactcaccccaccgactagagccccgtggaaaacttatttgggtactgttctgggcccaataaaggctggagtcccacagaccccttttctctctcttgctcccca

SEQ ID NO: 564246 - DNA, 198 bp, Homo sapiens
  misc_feature (11)..(11): n is a, c, g, or t
ccttgtgctgnatcgggtggcgagctgcgccgctacgcctggggctggctccccggggtccccgcctcacggtggtggctgtggacgctgacgtcccctccccgtacctctctgcaacggccacgcaccgggtaccgacgctcgacacttcgtacctactggtcactacgctgtttcctagtgtgccacttgttctcc

SEQ ID NO: 564247 - DNA, 397 bp, Homo sapiens
acattactgagcgtgaaacactcgggcgcagtcctattagttcattgtcatactgtaagataaagatacccaagactgcataatttatcacgaaaaacaagtttaatggactcacagttcctggtggctcggcgaggcctcataatcatggcagaatgcacaaggcagcatcttacatggcggcaggcaagagagaatgagaaccaagtgaaagtggaaaccccttataaaaccatcagatctcatgagacttattcactaccatgagaacagtatgagggcaactgcccccatgattcaattatctcccaccagttccctcctacaacacgtgggaatgatgggagctacaattcaagatgagatttgggtggggacacagccaaaccatattaga

SEQ ID NO: 564248 - DNA, 479 bp, Homo sapiens
ggtatggttgtggccactttttcccacatcggtcccttagatagggactgcatcctccttaatgtgataaagaggttcccataatttaaaaaaagtattcttttggtgcaatttggaggttggatttaaaatcgcggttagttgaaagcgtgtagtttctggcattttttaaacattaaaataatttacttttacagcatattataatattgatctttaaaaacaaaactggtttatttatttttttaatttttccattataatctaaatatcatgatggattttgaacgtctcaccaatgagcttttggcagtcgaatgttatgtcacttttcttttctttgaattttcgtttccatttcatttccctcacaaaattttatcctgttagcctggctgtcgtatgcctttgcaacagaaatagggatgtagatcgaagctgaaaaaatttatgttcctaaccataaggccctaagtgct

SEQ ID NO: 564249 - DNA, 109 bp, Homo sapiens
caagcagttactacatgactcactggtgaaggctatgctaaacgccaatgagggtgctatctgtggaggttgcactaggaatggtactacaagggacaatgctctttga

SEQ ID NO: 564250 - DNA, 574 bp, Homo sapiens
agctgggaagaagcagctacctcgtaggcaatgtggcgcgcaggcgggcggcgatgagagggggcgcatgccgcatgccccgcgctgtgtgagcccaccgctaaaccctgcagtccctatccacccctgcacaatgacgagcttgtctgggtagctggtcacgttagcctgggtgaccttcctcggatgtggaatccggccctgcgagcatcctcttcctcacttaggcttctgaagggcccgcggtgagctgtgagccgatgcccagcgtgcacgcctggtgctaggggctactccctcatgtttgcctagttataggatggatgagcgctgttctcaagtgctgcagcaggggtcatcccctgacctatccaggcgcagtgccctcttcccagcatcccatgggggaccaccgacagccacgctccgcgatggaacacacgatggatgctgaatgtagcgaaatggccggggacgacagatccttcccaggcccagttcccagtaaacagacgggcggtgccaactgcttggcagatccgtgatggaagacacactcctaatgatcccagaa

SEQ ID NO: 564251 - DNA, 130 bp, Homo sapiens
acatcgatacgacttttttttattttaatatcagtttatggagcagagaccataaggcatcttatttgtaaatatatgtattacattcctagaaaaagaatcacaggattttcccttctgtcgtcttctc

SEQ ID NO: 564252 - DNA, 1421 bp, Homo sapiens
  misc_feature (843)..(843): n is a, c, g, or t
gtggggagaaagcctcttgtgtgggagggggggagaggagcccccccccgcgtggtgttccgtatttcctcctgtccggcgggggcgcctctgtgtcgggggggttgtggttgggtggggcagcacccccacacatcggcccaccacctgctgggattatttctcctttcgggggggcgcccccccccaccaggggtgtccgccccgcacacaacagtcgtgttggtagaggaaggtgctcccacctgcccccgccggaaggaggggcccccggcggttgtttttttgttggccacgagcagcaacgtgggtgcccgtcggggccccaacgtgggctccgcccaacaaccacagcacggggtggatgaccaccaggacgtgttgttgttccttcttgggcgtcgcccgccccttctggtcaggtaggccgcctcctctccatctggcggccgcagcgtggtcgccccgccccaacattggtgtggtcgcccgcgacccgcccccgctctgggttgaaggccgcctgcgcgaactggtgccccccacctggggagaggaggcccccccctcctgggtggcgcccctctgggcgttctcttcttgtggtgggtgtgtcacagcccccctctggggtgaagaacacaagagacgcccctacaacgcctctccaacaggtttcgcgtgaggacacaccctcgccgcgggagtggagacacgcgagtaggggcgacgaggcacaagagggccccccttctgcgtggggcgccgcaacgaatagtctcgcgccgactagtctcgggtgggcacgacacacaggggtgcggccctgtgagaggttgtccncccacacgagagagaagtgtggcgccgccccacaagaggctcaagacgacacaggagtgtccccccgctgtgtctcgcgagacactctcacacacagcacagcgctctcgcacacacacacacacagtgctctcaccacagagacctcaaggggctctcacttgggacacagagagagatggggagaagtgcgcacacacagcgcgagagaaagggggagaatacaccgctcacacacactctcacagagaccccacaggcggctcgagacacacacaggctggagactcggtgcgctctctccaccctgcccacagccactcttggggcccctctcgcgctcttttgtaacgcgctcaatttaaccctcgcacaggcgttgagagccacctctcttctttccctctttcgcccacgcactcacctccccacacacaggaaagagagcccactatgttttgccacacccactaatcctctttctgccgacaccctagttccctctgctccaacccagacttggtatccagctttcagggccctggttccaccacattagaataaaaggtagtaattag

SEQ ID NO: 564253 - DNA, 319 bp, Homo sapiens
  misc_feature (212)..(212): n is a, c, g, or t
  misc_feature (251)..(251): n is a, c, g, or t
  misc_feature (273)..(273): n is a, c, g, or t
  misc_feature (284)..(284): n is a, c, g, or t
aagtgaaataagtctggcacagaaagacaaatatcccatggtctcactcatgtgggagcttaaaaagttgatctcatggagtagagataagtaccagaggctgggaaggtggagttgggggagggagggaagagattggttaatgggtacaaacgtagatagaaggaataagttcaagtgtttgatagcacagtagggtgactatagttaancaatatgttatatatttcaaaaataactaggagattagnaatgttccaagcacaaaattgntaaatgtttgngggtgataggtatcctaaacaccctggatttggtc

SEQ ID NO: 564254 - DNA, 124 bp, Homo sapiens
ccatatcagccttagaaaaacgtagggtacggtacagctctggtcacgtgttgttgatacatgaatctgtacgtctggctccctgagcgttctggcattcgcagacaacctatcggcagtgtgg

SEQ ID NO: 564255 - DNA, 249 bp, Homo sapiens
agccatcgtgtggtaccgaaccttggggcatcccaccatggtccaccgttaaaaacctcatgatggttcctgcttccctcatggtcttgcttttgaagcctacaagaaagtttgcctatttggagcgcctgtctaacaaggttgtttgtaagtaccagacattgacatccaccttgatggaaaatatgaaagacaaagccaaaatccattactcaaataaaaaacaccttatgaggtttcagaaacagg

SEQ ID NO: 564256 - DNA, 88 bp, Homo sapiens
  misc_feature (13)..(14): n is a, c, g, or t
agttggaattagnnataatcctttacaactgccaatttaaattgaaatatttaatgcctgtgaggttaggtcagtatcccagaatacc

SEQ ID NO: 564257 - DNA, 127 bp, Homo sapiens
aaatcaagtcgtgtataactcactgaatgcatacgtgggtactggtgggaataatacctgtgtactacgatcatctcacaggagaccatgagaagggcaggcacaaccaatcaaagcagtttcccca

SEQ ID NO: 564258 - DNA, 180 bp, Homo sapiens
  misc_feature (161)..(161): n is a, c, g, or t
gtagcctctatatttgatgtagtttggtgtttctcgaacctattattagttgaccttgtatgacagtgactagctatgatagattttcactcatcagcggatagtaagtcagcgcgactacttgagacatatctgtgtctttgagtaccactatatataanccgtgaaacttcaccttct

SEQ ID NO: 564259 - DNA, 930 bp, Homo sapiens
gtgtgctgagaccccaggctcgggagggcggagactgggagggagggagaagcccctttggcctgccttacggaaggcctgcgagggagggtggtgtccactgcccagttccgtgtccgatgcccagtgccggcgccagccggaagcagtcaaggacgtaagccgcggacaactcatggacgccgtgcgcgaagattatgctaagcgagacgatatgcgcaatatcttcaatgatacaatcacaagaaaaaccagatcgagttctggtccgggttagagacttgacaatacaaaaagctgatgaacgttgtgtgggtacgtgcaagagttcatacaagcagagctaacggggacacacgtgcttctttagttccctacgtcaggccacggccagtcttaatggtcccaggctctttgtgggcgggtgggagcaccatgcaaaggcaaagcacgaatggttcaacattttgccttgccaactatcaacaatagagagcattgtggactgtaggaaggtgctgtgaggacacgagttgacttcacgaaactttgggccacctgtacacagcacgcacgtcgagttacattgttcagcacagatttattgtgatcgaggttgtggttgaaacccgcgttcttggccccctggaaggcttgagattgaatgcttgtccgggcctgaaggggcagcaacgcgagacggaggaccgggaaggacgctactgttcacacccagggcttaccacgattcgcacaccagagttcatttgatcttaggaccatcaacgtcatccaggcccggtccttcgggctcccaggtctggcatttggcctcttttccggaaaacttttattcacccacggtttgggcgaaccccacccctaaaatattgagtgccgttcaacgggggcccaggtttccggggcaag

SEQ ID NO: 564260 - DNA, 305 bp, Homo sapiens
  misc_feature (16)..(16): n is a, c, g, or t
ggttcgacaccgcacngtctctggctgcgcgacgccaggacagcgccacgatcgacgttcaggcggcgggcgatgtcatccgggtgctggccactgagaaaggcagtcaccgtgtccaaggggctagcgatgggatcggtttgtcgttgcgtcgatctgttggcggaggagttcgcgatcgtcgactgcgcgcctggccgagtccgtcgctttctccggccatactgcctgatctgctcctcgacggtcagaggcctacctgtacgggccgatgtgatgggcctatcttcacggaccgaggtgtc

SEQ ID NO: 564261 - DNA, 639 bp, Homo sapiens
tatctcctgtgcgcacatgtgtgcagtgctctggcaaggacaagcagcagcagggctagaagcaagctgatcaacctgttgtagtcccagacacagcagtcagaaggttttccacgtaagaggccaaggcgtagaacaccttgtgggtgaactacactaagaatggggacagcaagtactagtgcagctgcaccttggttgtcaggcgctaggacctcaggaccttgaacaggtgttagcgcaaatagcgcagccgcagggggaaaacccctaccactaagacctgctgacgtagaggtatgctttagtgcagctagtggcgcagcgccagggctcatcacttctcggggacaagctggactaagcagaccactctctgtgtcaattggcttcgaacaccatccctaaccagaaggctgtagcagcgctgctcgatcaaggctatgtctacctgtcaggcagacacctctgtgtagaagcggcctcccagccaccgtcctcccaccacaaacgtgggatccgtgcacgttaacgattacaggacatcgaaaaacccttttggggttgtattttttttttttttttctctttttttagtgtgttttcttgtttcttcggttgttttttctgtttcttttt

SEQ ID NO: 564262 - DNA, 274 bp, Homo sapiens
aatcgagcgcggtacctgatcattgtgtcccacgcctatctactacagcatactactttatgctgctccggggtcatcatccacaacctttatcaatgaacagagatattcgacaagaataggaggagtattcaagaaccatacctctcagttcaatctccctcaccgatttggctgcctagcattagcaggaatacctttcctcacaggtttcttactccagtagaccactatcatcgaaaccgtaaacatatcatgaggacacgaatgttca

SEQ ID NO: 564263 - DNA, 329 bp, Homo sapiens
cttctgggttacatcttatgattctcttgagtctactttattccctaagagcacagtggccatagacttgataggaatcttctgggcttatctatcatatctgataagatgttttgacgtgtcttgtaccagattatcatagacaagcaaaacattttgaaatctcagccctgggaatttggtagatcacattcttttggctcagcttgtttttcatttttccctttgaggattgttttactaccaaagtaaattaaagagtatttggagacatagatatctcatagcataaaatgtacactgggctgtgagtctatatataaaggaag

SEQ ID NO: 564264 - DNA, 285 bp, Homo sapiens
ggttttttttttttaaaaggttccccccaaaaaaaccccccccccctttttttttttggggggcccccccccgggcccccgggggtggggggggggccccccttgggaaaaggggggggttttccccctttttacccccccccccccggggggtttttggggggggccccccctttttgggggtcccccttttttttttacccttttcaaagggaaaaatttttttccgcccccggggggtttggttttttttttttttgggggcccttttttacccccttttta

SEQ ID NO: 564265 - DNA, 419 bp, Homo sapiens
aggaaacgaatgagctcaagcaaagaggtccctgcaggacagtaggttcaggaacaattggcatgattggggaaaaagctggcttgatagagtaagtgtagggagtgggaggttctagacatacggtaatgtgagtgcaggcacatcccggctctggtcaccccagcttgcccagctctcacatcccgctcagcctttgctgcttttgtgtcctccagcttgagactcgagccaataccactaattgttttctctactggccaaatggtgggaatgaggggtcataaaggaagcaaacagcacattccatgcatccagcaattttactgttggcaatttgatacagaaaaataaaatgaggacagagctgcagggtcagtaaagggaagtacatttccaagtgattttcccttttactg

SEQ ID NO: 564266 - DNA, 275 bp, Homo sapiens
acctctgtcatcatccagcacattttggtggtggttctttacatggcccagttgccattgttctcctggccaaaagcacgaccaagctgccagaaatatcagactgtcctagatattctattcaccagccaaacttctagtttacctgagaacacatgagtaaagaccagcacgagatcagtctgagctcggcccatgtccagtaattgccccgaagagggatccgtctagtagctcgcaccgtgcaggacactgcaaggcttggtcatcgtggc

SEQ ID NO: 564267 - DNA, 175 bp, Homo sapiens
gcacgggtctgagcgcatcatggtgctgagctgcatcatggtgctgagctgcatcatggtgcactcctgtaatcccagctactcaggaggctgaggcaggaggatcacttgaaccaaggaggcagaggttgcagttagctgagatcatgccactgcactccagcctgggtgacac

SEQ ID NO: 564268 - DNA, 296 bp, Homo sapiens
  misc_feature (6)..(6): n is a, c, g, or t
  misc_feature (26)..(26): n is a, c, g, or t
  misc_feature (44)..(44): n is a, c, g, or t
  misc_feature (211)..(211): n is a, c, g, or t
  misc_feature (230)..(230): n is a, c, g, or t
cctcanaccccctggggtagagtttnatgtactttccagccccntcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattaccngggtgtggtggggcatgtntgtagtcccagctgctcaggaggctgacgtagaaggatcactggagcccaggaagtttaggctgca

SEQ ID NO: 564269 - DNA, 2779 bp, Homo sapiens
ctttttcattaagtaactttcattattgttattttttgttactaccaatgttatccatgtttgttttagaaaatataggcactactgacaaacaaaaagcagaaaaattaatgttgcctattttcctcccactcagaagtgctgttagtatttgtatatgtaccaatgcatatgaatgcatgtatcagtgagaatttatatggatattatttttcctcataaaaataaaatctactgtttgggaatctaccttcccatacttaattttgtacagaggtattataaatatgcccccatattgtaaaatatcctatactgggtttttttttcagctgctgaatatttcattacagaggtgtttcatactttaattatcgttgggcatttcagctctttctgattcccacaaactttataaaactcttgtagttatgcacatagccatgactatttctttatacatttgtagggggggatcgctggttcaaagtgcacacagaacgttaagacacctatcccctaccttatctcctctcctaaaccttctttgccctagcctaactagtctaactgcctggttttctttctctttaaccacatgtactcagtcccctgccttccaaactctccagtgtgttttaagtggctcatgcctctctactcgtggaatagcctttctaggagtcctacctgtgggaattctgcctttcgtttaagacttgtttaagcctctgaagcccttctcagccttccagctcagaggaattgccctgctttattgagctcttatcttatcacatttagtgtctctaccaccttattgatcaccttactctatacctacctatataatgcagtatcttttttcatgtgtttatcttatcttcccaaaaagtcttaactctatagtgttagcactcagacatcaaagctatacctagtaggttaagtaaacatgcggcttttatgatcagactttcctgaaatctctggagttctctgttcttagtctacctgagacacctatgtgcatttgaaggttgatttgagttcttttagagcacttcctaagacactctctagtggagaggctgtttcattggtaccctgtagaagcagcagctacttggggtattagtttgctaactattcttggtctaattagtagtcatctattcatcactcattctagaaaacacattgagagatcacgtgaacatgcttgaagctatcctgctagcctgaggattgtaggtggtgttataggtgtgtgtgtgtgtgtgtgtgtgtgtggacattttacatctaatagtggtacatattaatgcctttctcaagggaatcttcttcgtgtttcagggtcatagtagtgacaaaaatatgcagggaataaatccagattggacttgttccaccttacctttttttttattattatcggcttgtttgtaatctttttttaagatgacaggttattaagaagatgattgtagcacgacatctagtgctgcttattctaggcaatcacaccgttttaatcttcgcctcccttaaaatggttgcttgctaattatggtggaagatattctccatcttccaactactcactctacaacttttgttcacaaagaaagtattctgttaggccttacaaaaacaatgcttcatgcctggcctattctctcaataggaaataaaacattgttttcatagcagagctgataataaggcagagttcaaagcatgatgaatcatatacttttctagcagagaaaaacctatagttacctggctaattaactatcacgtgatggctgtgtgtataaagatacaggcttttcacatgtgcggcctgtatctgggtttcttttcttttttttttaattgagaatgctcatttagttcccattgatttgtattaatgttttccatcaaagatttagaagaatgagcaaacacagaagctgccattttagggtagcttctttttgaccactgtactaaacctcagtagtcagttatgttgtagcggaaagagcatgaactttacaaagtaagatggacctggattgaagtccttgctccataaactgtatggccttaaaagctttcactctgctttgattgcttatctataaatcagcgttaacaatacccatctcacagttttgtctcccaggacttgggaagattacgttagatcatctataggggtacccaacacacagtgggagcacttggtcaacaatattagtttcctttcccctttcctttagaaaggtaaacccttactcaagaaagcaaagtgagtagatgcaacataaaaagaataccaagacagagattacagtagtatgttatttcattttatttaattcacaaacacttgagttatctattataagacattgaaattgattgagggttaagtgagccatgatcccagttctgtaggaattttgaagtttttaatgtgatttttaaaaaatataaatttcagccgggcacggtggctcatgcctgtaatcccagcaatttggaaggctgaggtggtggatcacctgaggttgggagttctagaccagcctgaccaacatggagaaaccccgtatccactaaaaatacaaaattagccaggcatggtggcgcgtgcctgtaatcccagctactcgggaggctgaggcaggagaatcacttgaacctggggggtgggggttgcagtgagccaagattgcgccattgcactctagcctgggcaacaagagggaaactgcatccc

SEQ ID NO: 564270 - DNA, 511 bp, Homo sapiens
  misc_feature (115)..(115): n is a, c, g, or t
  misc_feature (118)..(119): n is a, c, g, or t
  misc_feature (161)..(161): n is a, c, g, or t
  misc_feature (195)..(195): n is a, c, g, or t
  misc_feature (228)..(228): n is a, c, g, or t
  misc_feature (233)..(233): n is a, c, g, or t
  misc_feature (249)..(249): n is a, c, g, or t
  misc_feature (267)..(267): n is a, c, g, or t
  misc_feature (298)..(298): n is a, c, g, or t
  misc_feature (311)..(311): n is a, c, g, or t
  misc_feature (313)..(313): n is a, c, g, or t
  misc_feature (316)..(316): n is a, c, g, or t
  misc_feature (319)..(319): n is a, c, g, or t
  misc_feature (327)..(327): n is a, c, g, or t
  misc_feature (371)..(371): n is a, c, g, or t
  misc_feature (378)..(378): n is a, c, g, or t
  misc_feature (408)..(408): n is a, c, g, or t
  misc_feature (432)..(432): n is a, c, g, or t
  misc_feature (451)..(451): n is a, c, g, or t
  misc_feature (506)..(506): n is a, c, g, or t
ttactgggcctgctactcctggggcacctaacagtggacacttatggccgtcccaatcctggaaagtgccaagaagaagtgtaaaaaggaccttggaaaaggggaatgtgaaatnttnnctgcaacctaatgaccccctgcataaggctaaacccaaagtnttggtgaaagtggctggtaaaaaagtggcttaanaaacctgttaaacaatttttttaaagtgaactnttttngaagaaccaataattnaagcaaggcaaaagtaancaagggccgcctgcatgtgaagccaaaaaangtttcaggagatntnttnctncataattnaagcaccctggaaaatggaatagaacacggagcaaataaacgtntgaaatnaaatggaaaaatcctgatggaaaacaaatngtgaaagataagatttttgagctncgtgttcagaaaatttttntttttaaaacaaaagtgacaaatggcagcggttatggatttacaggtgccccaanagaat

SEQ ID NO: 564271 - DNA, 263 bp, Homo sapiens
ctgcgtatacagctggtttgaaaatgcagaggaggacttaacagaccccgtgcgctgaaactccttggaagaatcaaagctttgcgcgagcccacgatgccttctgctcctccctcagctctgcccaggatgacttcaaccagctgggcgagctgaacctgcagatcaagagcttccgtgtagcctccaacccctacacctggtttaccatggatggccttggagaagaccttgatgaaccttacagaaaatcatcaaggaga

SEQ ID NO: 564272 - DNA, 125 bp, Homo sapiens
ccgccttcatctgccaggcatgtagcactcacctgcaatcccagctactcatgaggctaatgcaggaagtcacttgagcccaggagtttgacgccagcctaggcaacaaagctaaactccatctc

SEQ ID NO: 564273 - DNA, 459 bp, Homo sapiens
cggccttgccgccgacacctagcggagaagccagccatgggcgccggcggctcctccacactggcgcgctttgacctactcgcgcaatcaaggcccgggtggctcgcggttgcctcgctggacctgaccgcggaggcactgggggctgtcgcctggcgccgtgcatggcccacgcggcgccggccgctgatgcagcaggtgggcacagcggtacagctctggatctaccctgtgaaatcctgctctggggtgccagggagcgaggcggagtgcacggccatggcgctgcgcagcggcaacctgcgggacaggcagtggcttgtgatcaaccaggagggaaacatggatactgctcggcaggaacctcctctggttctgagttgcctgacctgcgatggtgacgctctgactctcagtgcacactacacggacctactaatgcctattactgcccatcac

SEQ ID NO: 564274 - DNA, 1014 bp, Homo sapiens
  misc_feature (1011)..(1011): n is a, c, g, or t
gagcactgaagatagcggctgctgtaggtacggtgtggtccgagctgtcgctggcccgagatgtgatgctatatccttgaatggcagttctggcatgtactatcatggctgttgcatggtgtaagaacgagcttgataaggtttatggtgtgtcggatccagtgtcaacgcgagaatgttatatttcgagcagccatgtgcctcatggcatgtagcctggtgtctaccaaggatgcagccggtaatgttaggggtaaacgacgccgtggctactaatcgggggagtgcaaatcgtagcttaatgcccttgagagacctttacaggtgacggtataggatgctccatgtgctatcctttgtttggagccttgtgatgtgtattatgagccaatgtgttgcctttctaggtagacacaacgtcgtatcgaagtgacatccgtgcgtgagactgagtaaattcgtccgtgagttcctcagcggagttcgcctgatttacctcaatctcgcctggatccagttccaccaggcacacgacgctggtggtctgggccctgtgaacatcggacgtcttgctactactgagtaacgcacgagttcccggagtactagggtgggctgtcacacacgtgctgttcttgctgtaggagtgtcttgatggtttgagcccaatggagtcaatcgacctgtgacgcgtcaacgaatcttcgcaggtggggccgaattcgggtgggagaaaccttccaggttgggaaaagcgcatgctgtgaacacatttgtacttgtcgcgccgcgagtagaacccgggtcctagaaaagcaagtgccgtggcgccagaggcgttcccagggagacggagcaccggttttggccttagagaaaaaacacggagcggtgtatataacaagtggaagggccacctcgccatatacagcggagtagacaaatgtagcaatacgtcgcgtataatacgatctcctctctttcaactattctttttgtatcattctcggncgc

SEQ ID NO: 564275 - DNA, 826 bp, Homo sapiens
gacatactgtgctggtggccatgcccaggagatgtgtgggctgagcgcgcgcgcgccgaatcgcggtgggttcataccctgcgggtgcttcgccggtagacggccctgggctgccggcatgtccgtccgacgcgtgggtggcctacttccctgacgcgttggtggagtgtccccgaccgtcgttagtcttccgtgcaggagtttgcggattagacggatgtggcccgatcgtgcctccgggtcactcttctcttcgaggtcgtttcaaacacctgtggtgtgtctggggttcgttcgccttgggagctcggcgcagctcatggggcctcagggcgacttatcgcttctatggggattgttgtgagtatgtcgcctttcgctgggtattccctacggatacgtgactgcggtggtgttctcggtgatacccactggtattacttgggaacgggctggtgagctttggtcttgtttagctctagtcttaatcttttgcgttttaagcttttcccttctatcatggtcacgttgccgagaggacgcgtgccttgttacgagatgaggggtgtcagtgtcgtggggactggggagctaatcgtgttgcagtaaatgtggagcagtcgcggacaggtcgtggctcggggaacagtgtgtcgtcggtggaaggaaattgggtccaggcaattgagtgcaggagtcatggcgacacatgttgctcaccgtagtgttacccgagttgtcatagaatctttagtcctgttatctagtgacgacttggaagggtgcctttaatgaattcactctggggggataagccgggggtagc

SEQ ID NO: 564276 - DNA, 282 bp, Homo sapiens
actgatctagtaacacttaggagagtctggcgacatagtaagtgcccataaatgtgttattaaaaaaaaaaatttccatctgatcacttcacccttctgctgaaatcctttccttgttttccacttatgttggaactcctcagtacagcacagaataagcgcctcagagatggtgtcttcctggtctcaagtactgccattgtgggcttcataatattgctttagtcacggcacacaactcccaggtccacagacaagttgcacggttccaggccttgtcac

SEQ ID NO: 564277 - DNA, 171 bp, Homo sapiens
gtgacgttggccctgtttgcttttataaccaactctatctgaatccaacaaaaaatttaactcatatgtgtcctctcgttctaatctggtcaccagtgcaggtgacccacaatttccagttattattccaaatgtttgggaaccagttatttggacaaggaaatggtaact

SEQ ID NO: 564278 - DNA, 163 bp, Homo sapiens
  misc_feature (145)..(145): n is a, c, g, or t
ctagaggagctggagggtctcttcctcaataagcactcactgaatgtctactctggccgagactaagtgggacagtgggggatggtactagaggcggtactgtctggtgtggtttaccaaaacccacatccttctcttctccctngaggacacatggtagtcc

SEQ ID NO: 564279 - DNA, 813 bp, Homo sapiens
ggcagaagtcctggtagtctggtccttgttcccgtgtggatagcagcttgcttcagcgagagcaggcggtggtccctgaggcgccgtggaaggagtcaaacttgcgggaattatgcggaagtcattgtagtgtcgaaagaagaataacgcaagaattagaagaatgaaggtaaggagagagaggtagagcaggatacatagatgaaatccggtggtcaaagagtggaatggaaaacgagaagaatgaggagtgaaccaaagcatgaggcaagagccaaagccgtgaggaaaagccagtaagaggcaggcaggaagctagaggaggagggcaaagcacaaggagcgtcttagtagaaccggctgattcaatctctccaggagtttagagaagatgtaccacaactaggcattggacagcaatgaatgatatgttgtagagcaagtggatgaaatgagatgagatagggagagtcagaagtgaacttatagtgatgcgtcggaatggttagtcgaagaccagtcctgacgccctatataagtgtagttgtaccttgcattgcaatctgatattagcaataccatatagccttgcttgcctattagccatccccgtgatattccgtttgtccatatttctacgttataagcgtgtggctatcaatggtctcagatggtatctcttgtttatctgcatgctccattgtccactcgtagtccgaaccaaatctacagagtcttctgtcttcaataaaagacctttacacattgtaacagacgagggtcttggggccagcacttcgatggaaaacggta

SEQ ID NO: 564280 - DNA, 451 bp, Homo sapiens
cccccttttctctttaaaaagggcccccttgtgagcccgggcgcgtctttttttttctcggccccccctccatgcttttttctttaaggtttgggggggggaaaaagaaacctttttgtgtgcccgggggggttttttttaaccccccccgccccccccctttcccctttaagaaaggaaccccccccgggggggggggggggggtttcccaggggggcccttttttttttttcccccccctttttaaggggggggtttccggggggcccccccccccccgggggtggccccccccccttttttttaggggggggccccccccgggggcccccgggggttttcccccccttttttttccctcggggagggggggggggggggtggtttttaattttaaaccccccccccttttggggcccccgcccatttaaaccttttttttggggggga

SEQ ID NO: 564281 - DNA, 472 bp, Homo sapiens
cggtcacacccccgacccgcgccccgaccgccgcacgccccgcacgtctcgtctcccaaagacgggccggaaagaataaatacctaattcttcaatggccagacatcaataaacgtccacaagcatcaaaaccatccaggaaatcatgacttcaccaaatgaactaaataaggcaccagggaccaatcctggagaggcagagacatgtgacctttcagacagagaatttagaatagctgattagaggaaactcagtgaaaatcaagataacacagagaaggaattcagaattatatcagataaatttaacaaagagatttaaataattaaaaagaatcaaacagaaattctggaagtgaaaaatgcaattgatgtactgaagaatgcgtcagagtctgatagcagcagaattgatcaagcagaagaaagaattagtgagcttggatagactattcgatacacagaggagacg

SEQ ID NO: 564282 - DNA, 719 bp, Homo sapiens
aacccagctacgcgaaatcttagcatactcctcaattacccagcataggatgattaatagcagttctaccgtacaagcctaacataaccattctaaatcttaactcattgataataagtcctggaatgtagataccagaatgtcctgacatgacctcaactaaaactccagaaccagtgatcctagtactatctcgcacctgaaacaaggctaacatgactaacacccttagttccatctgagcctcctctccctaggaggcctgcccccgctaaccaggcttttggccccaaatgggccattatcgaagagttcagaagaaaacaagagcctcatcatccccaccatcatagccaccatcaccctccttaacctctacttctacctacgcctaatctatccacctcaatcacactactccccatatctaacagggtacaaaataaaagtgacagttgaacataacaaaacccacccatgcctccccaaagtcatcgccttaccaagactactcctagctatgtcccctttagtactaataatcttataagaagaaaatggaaagagaagggaagagaaaaaagaaagaaaagaaagttgggggggagggcgaggaaaagattagtaaccattggaggaggggcagcgaaatgaaagagaaagggaaagctctgaaaagtgggagaaggggtgttcaaaaaaaaaggggggaaggttga

SEQ ID NO: 564283 - DNA, 850 bp, Homo sapiens
  misc_feature (82)..(82): n is a, c, g, or t
gcgtatgtaggatgggccatgatggtgttaaatcgtcggtctcatggggatcttgcacggtttcgtgcggcgtgaacagtgncgtgttattgtccccatccaaatgtgtgggggcgtgcacgacgctgcagatcccagtgtggggtgggcaatgttgccgtggatcgttgtgcgacgaactttctctgactcgtcggcgcccccccctctgccccgtgggggggaccccccgcacccccagtgggggtttcccacctgaagaatgttctcgccggcggcacgcttgtcctgtgacccgggtgatgacccatgctggtttccccgatgtgcttttcgcacgcttttcgtggaaaccctccgtctggagccatgttgcacccttgaggcacacctgtttccccgcccggggggggattccacggtgctatctgggagcccgtcatgccacggcgattttcagccccctgttcaggggagcccccatagttggggcccccgagaattcccccccgcctcggcaatttttctatgattaacgaggcgatcaggacagccagcaggattaacggcgccccagacgagtcacccagggattttcgctacacgccacccctagtgatggcagcaccgccccgggtatgtcagtggccacttccccgagctaggagatacttgtgacaaaagagcttacacggtcgattcccgcgtaattgagggaaggggggctagcaaaactcgcaacatgcagagagccttagataccacggcggggtgctcaaaaagagacgcaaagcatgatcgaagccctcatcaaccggtttttttacaaaaccccccccaaccacataac

SEQ ID NO: 564284 - DNA, 190 bp, Homo sapiens
gcggatcccccttggttgacgtggtgtacgacactttcccggacgcactcggctgcagctccactttctcccgttctgtgggctcttctgtgttcttgccgatgctctgccggcgcagtggggtacttggtcacccgcatcacccgttcgcacgggtgatgcggttgccgttgccattatgagtcatgtt

SEQ ID NO: 564285 - DNA, 872 bp, Homo sapiens
gccttggctggatgtttcttgtccccctgggtcgcccactccccattgttgtcctccttcatctatgggggacctttgctgtacccgaagttccctggccagcctttccggggtacccccggctttttggtggtgtttctgagcccccgggggtggtacccccgccgccttttcccacggaggccatcttttatggttacacactcacgcgtacaccctgtgcgccgtggtgtacaccgcccaggtatttctctcttgcgcgtatttgttgggactcatttgcctcatccccatgctcaccacaccacagggggagctcctcacctcactacagtggggtttttaaatgatgtggtggaatgactgtgcttcggggaagatttttgcgcgctcaaggcgggtggcgcacccattttctccccgtggcaccaccccatggggaggtctaatagccctgtatcttgggacattctttcacacgagagatcccctgtagaagaggattgtttaaaagaagagccaggctctctgcttgagaagcgccagtgacacaggaggaatttctagggtgaatggactgcgtctcccgcctcgctgagttctactgctacatcacgccctgaggttcgccagacatggtcttgagaggtgtcacacaggtggcctctcttgtgcctattccacgccaattctcttacgtgaagacgtggggcggctccgcagccctcggcccccggaaaactggtttcagctcccccggctcaggcccctgaatgggtaggagccacccctgactggttttaaactgtttttgcaaagggttttaaacaccatggaaaaatggttgatgggaaataaacatccgtttctta

SEQ ID NO: 564286 - DNA, 321 bp, Homo sapiens
cattcagcgctaagcacgtccacagtgctgtgcggccactcatctcacggaactgaaactttgaatcctgcccatcagttagttttcgggttatggaatttcatgtgaacagaacccaggtgtttctggaaatccggctgctttcactcagcatctggtctttggagttcacccacgctgttgcagagagcagcagtctcttcctttttattgctggaatgcactacagtttgtctatctgttctgtagttttgatctattatgaatacagctgctataataaataaaacatatattaaaacatccaaagaaaactaaaaa

SEQ ID NO: 564287 - DNA, 187 bp, Homo sapiens
caaagggaagaagaggaagaagagaaggaacctgaagcagaacctcttgtacctccccaggtgtcagtagaggtggccttgccccgacctgcagagcttgaagtaaagaaagtgactaaaggagataccttaactcgacgtaccgttaaccagcagaagtccggagtttccaattaccattgataga

SEQ ID NO: 564288 - DNA, 486 bp, Homo sapiens
caacttattcgtgacgttccactcatggtagaagtgatccataatgcttttgttccgtggtagttgataaccatgtcagttttgctccgatacagattagaaatctagttcaatctagtctgtgttcagaatccagatttacactgacccttgtgtgtgagaagagatagattattttttatcacaagtggtttacacttcttattaattcagacggaagttaattcactcaacatttgtagggaacagagtgggcagggtgctaggacacagagataaaaacattagcaccctcgaggacatcttgagccattgagctttcagtcagacatcataaagactgagtaagaaatatcaaacctgagcacaaaaaagatactacccaagggactcttaaagtgcaagagatgaagcaaagataaaaccaagcccctgcctgtcagcccctggggggatgtgtaacgatgtgcactatgagatgtgtgc

SEQ ID NO: 564289 - DNA, 685 bp, Homo sapiens
gctatcatgaccctcggcataatatgatttatctccacactagcagagaccaaccgaacccgccttcgaccttgccgaaggggagtccgaactagtctcaggcttcaacatcgaatacgccgcgaggcccgcattcgccctattcttcatagccgaatacacaaacgataattcatcagataaacaccctcaacgcactacaatcgttcctaggaacaacatatgacgcactctgcccgtgaactctacacaagcactataatggtcaccaagaccctacgttactaacctcccgtgtgtcttatgacacttcgaagcagacatacccccgaattcacgctacgagccaactcatacagcctcctatgaacaaaaccttccgtacgcaggtcaaccctagtcacttacattactagtgactatggtctccagtagcccaagttacaagtctccagggattcaccccgtcaagaccgtaaggagagaaaacacacaaccgcagagaagaaaaacacacgatgacggagagcaaacaagcacgcaacacgcagaaaaggacgccacaacacaacaaaaataagggcacgcgcgacacgaagaaaaacacgaacaaggagaacagaggaaaagcacataacaaacaaagcaagacaacagggcaagggcaaaacacaaaagcaaaaga

SEQ ID NO: 564290 - DNA, 328 bp, Homo sapiens
gcagagtatcaaacccatctagatatcaatcttagcacccagcacagaactaatgggccatcaaatccaaacccaacccaaggtcaagttgggctgatgtaggccaggagtccatgtagggggaaaactttcctcagagcaagagcagctgagtagggtttctggcatctttctctgggctcggtcacaagccagtattcagcacaacatcttcttttggccacagggcagcagcaactccacacatacaacaatggcaatgctcaccatctttccaacattcagccacacactggtcctccagtgcaatgcatcacaaggtcatcca

SEQ ID NO: 564291 - DNA, 754 bp, Homo sapiens
  misc_feature (534)..(534): n is a, c, g, or t
agcggggcgtacggaggtggcatctgtgggatgaggcggtgtgtaacggtcagacggagctcaaagcccggatcaatccccacgttccgggtgcgcgaagcctgataccatgaagaagtactcgggaagacgaaaacggtccggatgggccgcctgagcccgaactcgggacgactgatggtggagcccccatgtcagctgagatcaggatgttccagcgtatcactgagggtacgtggagcactgtaggatcccaatgttcctgatggatcactttggtatgcacgcgtcagcatatgagcccgtgatgttgtcaggtgagctgtgtggatatagaactcattcactcagcgatctacaggatgtgcagactatgtcctatgggaacgcaggcacgtgaccaaagcacgctcgggaatgcagtcgggcgtggaggactgtatcccccttttgtggagtgctgggaatagtcgggatggattatcttggaccgagtgatttgggatgatgaagtgaggactgagttggagatantactgggatcacatgatatgctggaggcaatggtcagaacttactcatggttgccaactgttcaatcgtcctaattcgcaagtacgggtgatgcgtgcccgccatatgtctaccaaggggacatcaagtaggatgctgctcgggcagccatggcgggatcccgggagacacgtgaggaccctgttcagggatttcagacagttggaactgtagcacgatg

SEQ ID NO: 564292 - DNA, 905 bp, Homo sapiens
ggggtttcggggcgagcgttgggcgccgcccgcgccgcgctgggtgcctcggtccgactcagcggtggggagcgagccaggcctcccgccaaccgtgtgccgtcaccactgcgtcgggctggtgcagccccgggccaggccgcggccgggtcaggagcgcaggggctttgttatgcacctaaagccatatttggaagcttccagaagaaagagcaccccccggaatgtcaagcagggacaaccgctcgagaactcttatgaaccaccaaaaggcgtgtacattgatgaacacattgcaaaggttagccacatacatatcacgtgtcttttcctttcagcctctctcggtacagcatcatctcgaaagccattgtgggatcctttctccaaattgtctgggcagtatgagtgggaacgagtcctgtagagagcagtttgaattgttaaaaccaaaaggaattgcccattctgagggaatccaccagtgcgaaagaagagggaccactgaatatctgggctgttgtgaaaccgtgaaattcccaaggacacaagttggcattcttggatcccaccagtgtagtaccagcggttagggactctctgcaccactacaacagttcccctggaatattgagtgcgagcagcctctacgagcaaggacacaacatccagggcgcattcttaaaaaaggcaaggtacaggtgcgcacggctacgggacggttaccaggcgggttggtaccaacctgaagccttttggcatgtgtggatttgacaccgtgctgtgcccattgtacgtgaacgtcggaatggcgtcacgcagtagggcccgtacgtataacatgttgcccttgagcaaacacgctcttgcagtgtcaaaaggaaccccctacgtgtgagttgcac

SEQ ID NO: 564293 - DNA, 1787 bp, Homo sapiens
  misc_feature (714)..(714): n is a, c, g, or t
  misc_feature (947)..(947): n is a, c, g, or t
  misc_feature (1141)..(1141): n is a, c, g, or t
  misc_feature (1324)..(1324): n is a, c, g, or t
ctagagcagcgacttttttgttctggggagcacagataacgagtcgatcacttcgtgttggacgctagcaacccaccacggtgggtgtggcagcaccagcacccttgtggggtgcgcgcattaatagtcaagagggcgggtgttgttaaagcggcccgctttgtcttgctcacgcccagggcgtcgttttgttgcacgagagctagcgcacacgcccgcggggtgtggtgtgcgacgaaagccgacgccggcggcccggtttttaccacgcgccggccccccccgccgtctttcccgcgggcctatttttcttttttgagcgccgcaaaaatttgtacaaaacacttgtgttgtgtgacagaacaaagaagttgtgcccaccaccaaaccgttgtgggaagaaggcgagttaaaaaaaacagggttgttcccccacacaaggaggaccacctgctccctacctccctgttgtttaaaatattgggggcccaccccccccccccccgcgggtgatatagaagaaaaaaaggggggtttttccaacacccggggggataaatgagagtagtacgcccccatggagaagtgccgcccccccaactaggggccgtttggatggcacccccgggataatagtgggagtggcggatagggcatgaaaataaaatagggccgcggggcgtgttgtgccgacccccccacttggccgtcctnctcccggaattgatgaatggagaacgagatatttgggagtacgaaaataattgtgtgggggcgccccagggccgcgtcttgggtcttctgccttgtgaggagcccctcaccacagggccctcacaacagggaggcgcgccctctttccgccttgtcacacctcgggccgccgccccacaagagtagtgtagcctcgtctgttgtgtggtgtttggagtagtgagaaaattttnaaaaggcgccgcccacgttatatctcgccccacatcgagggggagaccacacacactctctctctcgtttggtgcacacactcgcgcccacatatatatgttctcgtggagagcacacactcgtgtgtatgatatatagggagcacgcgcgcttgggtgctcccctcgctgggtgatatcatctcacagagagntatattctgcgcggctgtccccccgctgagagagagacactctctactctctctcaggagacccgctttcacactgagagcgtcgtcacacatgcttctacactctacacgctgtgagaaatgtgttctcacagccgcagacttgtgacacacacagtcgtgagagagagagagagaatgtcnccttctctccacagggtgtgcactcccctctcttgtggagaccaccacaccactatagcacggctcaccacatctttctcggagagttctcgcgagttctcttccgcagcggccaccgcgagagcgtctggcctcctttttccccccgtcgagagtcccacaggcagattgtgccacgggcgcttgggagactatcacgagagtcacaaacacacactcggcgctgagaaacttggagtcctctggcacagccgagaggaggagacccacgagacgcctcggtgttcgaagaagtaactcttttcctcgggagagggggcctctccacgccacagttgggccaaagcctctccaatcccgggcaagtattttccagatggacaatcttttgccctcacctagctgccctgcccctgccccttcagggagatgggggtccatttaagggaactggacccttgtg

SEQ ID NO: 564294 - DNA, 123 bp, Homo sapiens
gctgactatatgtatggccgtgaaggtactacaatgctggtggtagataaccaaagagggactacatggaaggaaggcggaatgtcacacggaactataactattggctctattgggtagggt

SEQ ID NO: 564295 - DNA, 244 bp, Homo sapiens
  misc_feature (156)..(156): n is a, c, g, or t
agcatcggttaaattagccgacgaactcctagaagaaaacgtaggcaaacactctctgacatcaacattatgaatattttctcaggtcagtcccccaaagcaataggaattagagcaaaaataaacccatgggacgtcatcaaagggacaagcttnggcacagcaaaggaaacccaaaagaaaacaaaaagacaacttacagaatgggagaaaatagtttcaaatgatgccgtcggataatttt

SEQ ID NO: 564296 - DNA, 329 bp, Homo sapiens
  misc_feature (149)..(149): n is a, c, g, or t
  misc_feature (163)..(163): n is a, c, g, or t
  misc_feature (181)..(182): n is a, c, g, or t
  misc_feature (200)..(201): n is a, c, g, or t
  misc_feature (226)..(226): n is a, c, g, or t
  misc_feature (237)..(237): n is a, c, g, or t
caggagcttagcagctatcggttcaatgcgtatgtgttattacaatctagatttatgatcatgcctcttagtctccattccccaaattatttccatgtgatctcatctgcagtaccctctcaggcttcagttaggtgtcagttctccanatgggatggcctcnatactatgctctgtcgcnnagttcaggatatagactnnagataaagcccaagtgtaattcccnctttcctgaangcaatgtaaattccggtagttttagccgtgtccgtgttttcagccctcctggaaattgccttcaagtgaaggcattactgttctatagcttg

SEQ ID NO: 564297 - DNA, 478 bp, Homo sapiens
agtacgattattatttgaaagagagagatatatctacacatacacataaagtcatgcgttgcttacggacagtgataggattctgataaatgcatcattatgctctctccttttgcgaacatccatagggtctacttgcatcaatctagatggtatcacctactacacacctcagctgtatggtatagccttttttgttcctatgctgcaaacctgtgcagcattgctactgtactgaatactgtaggcagttataacacaatggtatttgtgtaaacgtagaaccattctaaacatcgaaaacgtacagtaaaactgtggtataaaagataaaaaatggtatacctgtctaaagcccttaccatacctggggcttgcaggactgcaatttgctctcggtgagtcagtgagtgagtggtgagtgaatgtgtgaaagtcctaggatactactgtggatttaataaacattgtatcctta

SEQ ID NO: 564298 - DNA, 164 bp, Homo sapiens
ttactagaggatccgtacgagcgctagggactcctcctatcagcatgaggagactaacaaactccgggcaaagttggggctgaaacccttggagtttaatgccatcaagaaggaggcgggcaccaaggaggagcgctgtgacagctgatgtcatcaaccctatg

SEQ ID NO: 564299 - DNA, 774 bp, Homo sapiens
  misc_feature (18)..(18): n is a, c, g, or t
  misc_feature (111)..(111): n is a, c, g, or t
  misc_feature (126)..(126): n is a, c, g, or t
  misc_feature (129)..(130): n is a, c, g, or t
  misc_feature (133)..(133): n is a, c, g, or t
  misc_feature (139)..(139): n is a, c, g, or t
  misc_feature (165)..(165): n is a, c, g, or t
  misc_feature (170)..(170): n is a, c, g, or t
  misc_feature (178)..(178): n is a, c, g, or t
  misc_feature (188)..(188): n is a, c, g, or t
  misc_feature (191)..(191): n is a, c, g, or t
  misc_feature (195)..(195): n is a, c, g, or t
  misc_feature (200)..(200): n is a, c, g, or t
  misc_feature (203)..(203): n is a, c, g, or t
  misc_feature (206)..(206): n is a, c, g, or t
  misc_feature (209)..(209): n is a, c, g, or t
  misc_feature (230)..(230): n is a, c, g, or t
  misc_feature (234)..(234): n is a, c, g, or t
  misc_feature (241)..(242): n is a, c, g, or t
  misc_feature (246)..(246): n is a, c, g, or t
  misc_feature (256)..(256): n is a, c, g, or t
  misc_feature (261)..(261): n is a, c, g, or t
  misc_feature (267)..(267): n is a, c, g, or t
  misc_feature (276)..(276): n is a, c, g, or t
  misc_feature (280)..(280): n is a, c, g, or t
  misc_feature (296)..(296): n is a, c, g, or t
  misc_feature (309)..(309): n is a, c, g, or t
  misc_feature (312)..(312): n is a, c, g, or t
  misc_feature (319)..(319): n is a, c, g, or t
  misc_feature (321)..(322): n is a, c, g, or t
  misc_feature (331)..(331): n is a, c, g, or t
  misc_feature (338)..(338): n is a, c, g, or t
  misc_feature (344)..(345): n is a, c, g, or t
  misc_feature (349)..(349): n is a, c, g, or t
  misc_feature (370)..(370): n is a, c, g, or t
  misc_feature (374)..(374): n is a, c, g, or t
  misc_feature (384)..(386): n is a, c, g, or t
  misc_feature (388)..(388): n is a, c, g, or t
  misc_feature (391)..(391): n is a, c, g, or t
  misc_feature (395)..(395): n is a, c, g, or t
  misc_feature (397)..(397): n is a, c, g, or t
  misc_feature (403)..(403): n is a, c, g, or t
  misc_feature (406)..(406): n is a, c, g, or t
  misc_feature (410)..(410): n is a, c, g, or t
  misc_feature (412)..(412): n is a, c, g, or t
  misc_feature (432)..(432): n is a, c, g, or t
  misc_feature (463)..(463): n is a, c, g, or t
  misc_feature (480)..(480): n is a, c, g, or t
  misc_feature (487)..(487): n is a, c, g, or t
  misc_feature (521)..(521): n is a, c, g, or t
  misc_feature (554)..(554): n is a, c, g, or t
  misc_feature (585)..(585): n is a, c, g, or t
  misc_feature (601)..(601): n is a, c, g, or t
taaaaagtgacccaaaantaagatttgaacatcacttgtagtttcttcctcgtaacatgagtgctttcagctggacagtagattacaaagcctctccgatcacgttaaggngggtgatcaatctgnggnngcntctgtnactcctcctggggaaataatcctgtnggggngggggggncttcccagtngtntggntagtnggnccnggnggggggggtcctggggcgggngggnggggggnngggncccacctgtnttgtnactggncgttctgcngggnctctgtcactgatgcngatacggggcccnggnccttgtngnnatcactgangcgcacncactgnncatnaactgagtccttccacagggngacnttattgtgtnnncnagngagngngagggngtngggngngggggggcagctcacatgcnacaccacatcgttgaacttgtgcaaaatttngggggccacgtattggntgggggntcatcacagggccaaatgaacacacgaccatccngggagcagcgggggagggggcgggggggcaggnggggggggggggcgcagggcacatctcgaanccagtcactgtgcgcntctagcttctgcgcctccttccactggccgtcctcctcctccttccacagcttgatgaggttgtcacagccacctgatgcaaacctcttgatgtaattgggtttctgccccgatgggtggtctatgaggcttccaggtacaacagcaggggcccagctgacggcattgcagcc

SEQ ID NO: 564300 - DNA, 266 bp, Homo sapiens
ctagcaggatcccatcagtgcgaagactgtggtacgtggagttgagggagattgggtaggttgatgttgagtggaacttgggcagtgcacatgtcacatcttggctgggattcgtgtagtgcttcactgttgcatgtcactggacttgcctggctagtgcacttgtgtggcctggcagtgtcagctggctgctcgtggtgtacagtgtcccctgtatggcatcctgtgcttgggtgtgagacagtttcttggctggcactgccctg

SEQ ID NO: 564301 - DNA, 577 bp, Homo sapiens
tcgctgctcacatcatactcaattactatacttgagtatccatgtctacacagactcgtaactataatattagcatattactaagcaattaattttctaacactacatttctatcactataggtaactattcttcttaaaatgctccctcagtcatagctatctggataattttcatttaataattacatatagaacacaacagcccaataaaagctgcagactaagttcactctgagcagtgtcggcaaactgtatatgatgtcagctgctacttcagatgtattagataaataaaacagtaaggtgataagacattggtacttcaagctaaaataatactgtgtaaaaacatattacacatatttacagtcacattaaaaagccacaggtaaaactatgttactaaccatcttccagtctgataagccatctgtacttctcatttctgtagctccgatgtataggccataagtcgagcatagacaccatgagattctaactgcatgtaaacttgatcttactgagtgctcagagacaggagtacatatccttctcgatcgatatctagtcacaaa

SEQ ID NO: 564302 - DNA, 530 bp, Homo sapiens
  misc_feature (19)..(19): n is a, c, g, or t
  misc_feature (59)..(59): n is a, c, g, or t
  misc_feature (106)..(106): n is a, c, g, or t
  misc_feature (143)..(143): n is a, c, g, or t
  misc_feature (170)..(170): n is a, c, g, or t
  misc_feature (179)..(179): n is a, c, g, or t
  misc_feature (249)..(249): n is a, c, g, or t
  misc_feature (272)..(272): n is a, c, g, or t
  misc_feature (299)..(299): n is a, c, g, or t
  misc_feature (323)..(323): n is a, c, g, or t
  misc_feature (486)..(486): n is a, c, g, or t
cagcgagaaggatgcttgnctcccgctgctggaaccttggcttctcgagttgctctccnctgtctgtctgttgttgagaagagctgaactcatgccgactggaccngctttcagcattgtttcgtcaaagtcctttggaaggnaagatgaggactaggggctcatgatgncagggatgnccccatagtcatgcccggggatggaggggagagagcatcactggaaactggcatgggtttaaaacgacanttggccaggcgcggtgatcacgnctgtaatcccaacatttgggaggtcgnaggcgggtggatcatttgaggtcngagttcagaccagcctggccaacatggtgaaaccctgtctctactaaaatacaaaagttagcctggcagtagtgatgcgggcctataatcccagctacttgggagactgaggcaggagaattgcttgagcctgggaggcagaggttgcagtgagctgagatcntgccactgtactccagcctgggagacagaatgagaccctgtctt

SEQ ID NO: 564303 - DNA, 247 bp, Homo sapiens
caaaaaaaaaaaaaaagcaatgttttaattaaagtgtgtttatataacatatatgcaataaactatagagctcagtgaattgtcccaaagtgaaccctcgcaggtaaccccagtccagatcaagaaatagaacccctccttcagtcagcatcccccccctacttttgaagacccccccctctctttcctgacttttagcattatttattagtttgcccctttttgaataagtaaatatttgcaagca

SEQ ID NO: 564304 - DNA, 165 bp, Homo sapiens
cggaaaaaaaaaccccccccccccccccctttggttccctttgggcacgggggggggggggcctgggaacaaccccccccccccccccttcccccccccctgggggggggggggggggggttttcccctgcccttcccccgggggtttttccccgccctaaatga

SEQ ID NO: 564305 - DNA, 114 bp, Homo sapiens
gcagagcagctccctcgctgcgatctattgaaagtcagccctcgacacaagggtttgtctacgaatggtttagcgccagtcgacgcggccgcggtcgacgcggccgcgaattta

SEQ ID NO: 564306 - DNA, 337 bp, Homo sapiens
ttggcccgggggtttttttggggcccccctcccccttgggggttccctttcccatgggggtttttatcctgggacccttcggtggggggttccaaaggcccttttttttccccgggggggttccccgttttttttttttgccaccacttttttattggcccgttaaattttggtaattgtttggaatgggtgggggttttaaaattttggttttttttggaaaaattttggattgaaattgaacccagttttttttttgggggttttgggccccttttttcctgccttcctttttcctggccggaaatttttgggggttaaaaattaaattttccca

SEQ ID NO: 564307 - DNA, 1788 bp, Homo sapiens
attggctcagtacgcagccctacggagtacggagacccgacggtccttgcggcactggacagtgcggccggagagctgtaagggatccgagtgacaggacagcctccagccagcagaggcagaggcgcggacgcagagacggaagagagcagaggcagggtgtaagagagacctagagccagtaagaaagagtaatgggggagacgaagaagagaaagaaccaggggatacccggataagaacacgagtaagcaagggtaaccaaagcatagaacgcagacagagccaccaggctagggacacgacgataacgaacagcattgagacagagaaccagagagacagcaagagaacaacaagaggaccaagcgacaacagtgagaagagcccaaggggagcggagcaaagaggagagacagagagcggcacagacaccagaacgacagggaaatgacgagcaatgcagaccgcacagatgcaacagaacaggataggacacccaaaaagcaaaagccacgggaacgcagaaacagcacgaaagaaagacacaacgaagagaaagtcaacaaaaagaggaggcacaacatgatagagaagaaaagcaggaaagaaaagacaagagcacaacacaagaacagacaagcaccgacccaggcggccaacgacacaacagaagtgaaaacgagaagctggaaaacggagggcacatgatgtacggcgaccacgcacaggggagtaatcacggagaggagatcgagtagcaacgacgccgggcaagacactagaggaccaatcacaatagagaggaaggaacacaggcacgcagcccagagcacaggaccagtcgtatagtgagccaacacgacaacagagagaacacagtggacagaggacgaaataagagagcgaggtacagcgcgtagtacgaggcagagaaagagagatacgcacatacgacagagagaaccgacgagaaaggcaacaagaacaactagacatcgtccgagagacagcagaagccccatgacgaggacagcgagagcacacaaacaacgagcaaaacgacgcacgtagggacgacaaagagacgtggagagacacgagcaacagaagcgagagagcacgtagcaaaggacaacaacgtcgacatagtaacaggaccgacacgcaggccacaccaaacgagatagaacataaatagcacacgatggaaagaagtagatacccacagaacagaaaaccaacaaaacaccgcaacaagcgagcacaagcgagaagacaagaacacaacacaacaaaacgagaactacagaaaaagaggccgagagtagagaaaaattacacaagaatggaacacaacaaaatcgtcagaacaaagcgacgagaagatgcagaaaagaacaagaaaccaacacaaaagcaacacagagccaagagaactacacgcaagaacacaagaaaagcagaaaaataagacgagggaagacgagcagaaagagaacagactagaacgaacaaaggagcaagggagcgaagagagagtagcgacaagacagcagagatagacccgcaagccgagatgcacgaacaaacaagacgaaacacgtcacgagcctagaaggcaaccaccaagagcaagagtgaggactaaaagacagggggcaacatcgataaacgacttagacaggagcaagagacagagtgcaaaagagcggagaagacagaccgaagagaagagagacgcaagagagaccgcaatacagacgtagcccacactagcaagaaggc

SEQ ID NO: 564308 - DNA, 149 bp, Homo sapiens
tcggagctccatcctagatccagccggcctcctccctggggcctcctgcgagttccccgtataaggctgggagtggggccccctatattatttaagtaaaatctaccatatactattggtgctcccgcatggttgccttccttcatgaa

SEQ ID NO: 564309 - DNA, 262 bp, Homo sapiens
ggggggtaagttccgattacggtgggggctagtctttgataaactgttatgtcgtgtctgttcggacatatatattaggaagagcttctgtgactgtcctttaatagcaggcttcttgtctctttgatcttgtggataaagtctgtttatcaaagactaggatgaaccccggcttttttggtttccatttgctggtagatcttcctccatccctttattttgagcctatgtgtgtctctgcatgtgagatgggtttcctgaa

SEQ ID NO: 564310 - DNA, 299 bp, Homo sapiens
ccatgtacaagtccttcatcaacgactacccagtggtgtctatcgaagctcacatagaacaggatgactggggcgctatggaatcagtacacagaccagtgcaggaatccaggtagtggaggatgatctcacagtgaccaccccacagaggatcgccaaggccagtgaacgagaagtcctgccactgcctcctgctcacagtcaaccagataggctccgtgaccgagtctcttcaggcgtgcaagctggcccaggccaatggttggggcgtcctggtgtctcatcgtacgggggcgact

SEQ ID NO: 564311 - DNA, 310 bp, Homo sapiens
tgcgacgcagtaggccgcgggggggggctcgagggggacgccttactatctttactgcatgtaactgtgtgtgctttgatgtgtacatatgagagacattgacaaaagtgagtgtgaggtatccgaattcctgtttcagtgagctttcacggagtaaattctttttgtctacttgcctgtgatctcttctaatatgacttgcgttaatgacctttaagaaatcttttaataaaataaaaaattttattaaaatctttttttaaaaaaaggggggttacaaccttctaataaaaaattttattaaaatctt

SEQ ID NO: 564312 - DNA, 527 bp, Homo sapiens
tacttcagcaaggcaaacgctcattcacacggggaggagctctatacccctcttcagcacggtcactgctgcaggctgctgctggcccacccctgttgctactatccaggccagcactcaactctacctgaactacacagcctactacccaaggtaccctgcagctaagagaatatcacagtcccactccctgtcccaatctggggaaaggtcacgatcccctttctggggcagataactcctcccttgagatgacaagggagtaaggtggcagctggctaatgccatctacaaaacagatcgaaaatgactctgaagaggctggggcttcagggaggaactgaattaagcacaaggcagaaacaagggaggagggaaacaggtctcggtctaggccacaggtggcatgcatgactaaaccttgtctctcccaccctagccccccagtctcccccaccactgtgggctacctcactacacccactgatgccctggcctctgctcccaactcagtgtggtcccagtca

SEQ ID NO: 564313 - DNA, 373 bp, Homo sapiens
  misc_feature (201)..(201): n is a, c, g, or t
cgtatgtcagcgataaaagcttggagcaattatgcgtatgaggttcattctgtactctcttctcaaaccacatcagtggtccatagtggaagaatcaagaataccaggctctctgcgttatgcaaggtaatatattgggttccaacctctaaaattcatcgtggaatctagctgcttccgtccttcatctcaagtctcacnttcatacgggacatcctttcataacctagtggttttgctcccagtccagcttctccttttcattcccttctccctttcattccctttcattcccttcttcctttcattcccttgtaagcttcctcctttcattcccgtgtagaaatctgtctgtgttctcagtggaggtcag

SEQ ID NO: 564314 - DNA, 448 bp, Homo sapiens
cagttacatcaatggagagaccgtagtagtgggggaggaaccccttctcgcctctgaggaccccagaaacagcctaccagggcaggtgtgtggggcgggctcagtccaccttgcctctgtcgcccttcgttgcccaccacctaacatcttgttcacctcacaaaatcagttctgcccagtgataagttcctgctttccctgtggtcgaagtgtggtcagatgagcatccttgctgttgctatggccttgaaaacggctttggggagggggcgggaagctgggggataggtagtgggaaaagggcttgctgagaagactgtggctactttagtgaagatcaaatccctctcatcctcgcctctggacactttgaggagagatagaagggacagacctgaacagagatagaaattaacaatttacgtataaggtacaaataaaatgaaga

SEQ ID NO: 564315 - DNA, 440 bp, Homo sapiens
gactgttgcaacttatttctactgcattatacaagcagggactgtgctatctggaggccagaccagactggtagagaagtatcttaagtgtttcctgacacacaaatccccaaacacacttgtggttcagtttctgctcacgctacccgacttaagtaacttgtgcaggactccaatcatctcagcattaagccctcctgcactcaaggccttgctgtgtggcctttgagcctcagcttcctgagctgtaaaatagagctagtaagacctttcctatagagctgtaggggaatgggttcacggcacggtggagctgacttgtactgactcaggagggttgactgatgattttcagaaatcattggagccagtttgtaaatacagccatcattaacaattaagttctatacacttacgattaaataaattatattaaaaac

SEQ ID NO: 564316 - DNA, 489 bp, Homo sapiens
  misc_feature (4)..(4): n is a, c, g, or t
  misc_feature (186)..(186): n is a, c, g, or t
cccnagtcccttgggcagattcgcactggttgtggaagtcctttcaactcaaaagaggcgggttttgggcacccccccaaagtttttggaagtcttttatctttctcgtgtgaacaggccccaacaaaaaagaccagggcgcttcccaagccagccagacaccttgggtctgagccataaactggngtagttaagctttgcagcttcccagtggattttatttaatcttttggtggggttttggttggttcttcttgtaaaaatggacaaaaacctttttaaaaaaattggatttgaaactggatggggatttggaaccccaaaaattttatttggggaatggttcttttaataattcaggtaaaattttacaatattttgcaaggatatttttttggacaaagaccctacatgttttcccaggatgatgtgatggaaaaatttttttttgcccccaggtttttttaaaaatttaacaaatttgcctga

SEQ ID NO: 564317 - DNA, 574 bp, Homo sapiens
atcgtggtctgtgccatggtcccgtctctatggtggttgaggagaaaggcggggaagcttcctcagccttgcagatatgtgtggcatttactagccagagctctgacaggcagtgctgtctgtttcttgtactgggaccaatagtaataatatccatagcacattccccttgcatttatgggtgaggcctattgccttctcataagcagagtattgcatgccttcatcaaactcagcccaaaactctgtttacatgggtggctgcagtatggagctaggtcaatgtacagagttgggatggtcaggacctggtccattgctaaccaataatggggacttcctgggtagcggaggtcactccctctactcactgagctatgattagggagtggttattgccccaaccattgctaatgggatgggtggcagggactaggctctaagactcctcattgtctaaatgaaggcctaaacatgtgtgaagtgcgtatttctgcttttgtgtaccccactcaacccattaccacagtttgcctttgtgtgtctgtgtcattaaaaagccaaatcctgaaaa

SEQ ID NO: 564318 - DNA, 220 bp, Homo sapiens
gcggccgcctactactactaaattcgcggccgcgtcgacgcgtggccgaggaccagcgcggcgcacagcacgccgagcttaagcacgttacgaggtttgaacatggaaaggactccgggtgaggggcaatcagaattcataatcgacactggcggtgagcgtgcgagcggcacctgggatgccgtagagctggaagccgtcgagggacgcgccgacctgg

SEQ ID NO: 564319 - DNA, 376 bp, Homo sapiens
ccagtctctagagtatcccctccgtcgaagaacaacggcaggtaaatccttcagccaattctaatccacttgggttttcagctgtatttacatctaatagcaatagactagaactgatttatcttctacatagtacaatcacaattgtggaattacaggaattctggtgattttaaggtgaaataacaaaatacaataggccctatttaacagtttgatgtgacagttagtttaattatgaacctgtaacttcactcttggaaattgcttctccaccacataatgggctttttcccctattttaaggagccagattgaatgaaagatgtggaaataggctgctgtagatcttgatcttccaggtaccccatgtacc

SEQ ID NO: 564320 - DNA, 476 bp, Homo sapiens
  misc_feature (417)..(417): n is a, c, g, or t
  misc_feature (461)..(461): n is a, c, g, or t
  misc_feature (476)..(476): n is a, c, g, or t
taaatcccaactaacccctttaaaaagtaccccaaactacttgaggagaaagtgcaggaaacatgattccctatggtgccttgcttaaaactatttggctaaatttaaaagcagtcccaagtgcaaaatgtaatttattggtgcaaaagggcacacggccaggtgcactcttaaaactatcgtcaatttactctatttaatagtgttggactctttaaatataccagtcttttaattttatgaaccctagcatgtagggggagggaggtccacttcagaaatatacattttaaaaagggtccaagacttttggcggccatttggctactttatccataccatagatcaggtcggtgttggtcaattttccacggtatttccagagagaaataatctccaaaatttcacctatggctnttcacctattttcctgtccattttataaaacttctgccagtgtnttcctgaataatccn

SEQ ID NO: 564321 - DNA, 194 bp, Homo sapiens
ctttcctttctcatccagcacagcaagaccaacgggatctcttctgcggccgcttttcctctccgtgacgacagggcagtcttggtgtgcagcccctctcctctctatcctggtagggaatgcctcgacccaccctgagaaagtgcaaaaaacactagcatgtactgataaccccgtgctcgcggggccgcaag

SEQ ID NO: 564322 - DNA, 132 bp, Homo sapiens
tctcatatatcactagtaaacctccacaagacagttgctctccgggagctttatcaataaactggctacaacggggacattcgctcaatttactccagcggtctgtatagaccccggcttttcataactgta

SEQ ID NO: 564323 - DNA, 631 bp, Homo sapiens
caaggtggctcactgtgatcctcagaactttgggaggccgaggcgggcagatcacctgaggtcgggagtttgagaccagcctgaccaacatggagaaacccccatctctactaaaaatacaaaattagccaggcgtggtggcatacgcctgtaatcctagctactcaggaggctgaggcaggagaatcgcttgaacctgggaggcagaggttgcagtgagctgagatcgcgtcattgcactccagcctgggcaacaagagagaaactccatctcaacaacaacaacaaaaagtgtggctgggcaccgtggctcgtgcctataatcccaacactctgggaggccaaggtaggtcgatcatttggggtcaggagttcgagaccagcctggccaacatggtgaaacctcatctctaataaaatacaatagctgggtgtggtggcgcgtgcctgtaatcccagttacttgagaggctgaagcaggagaatcgcttgaaccctggaagtgaggttgagtgagccaagatcaggccactgcacttcagcctgggtgacacagtgagacatgtataagctataactgaactccctcagtcattatgcttagataggaccactgttgacccgggccgct

SEQ ID NO: 564324 - DNA, 218 bp, Homo sapiens
tcaggcatatgtagtgagtgctgtgtcaaggtcaccaggaagcttgggcagtctttcctatctgctcctggtgctgcggctctgcctctcccttgcttcccatttttctaatggggacagatagtgcctgtctgtgtcttagagagcctgcccctcgtaatctgggaagagcttgtagaggcaggaaatggcacatatcagtcccatgatgaggaccc

SEQ ID NO: 564325 - DNA, 138 bp, Homo sapiens
agtcagcatgtctctctacttcaaactagtaaattgacctgcgcgtgcagaggcgggcataacacagcaagacgagaagactctatgaagctattaactttattaagtgcaaactcgtacctcacatagacccacagg

SEQ ID NO: 564326 - DNA, 284 bp, Homo sapiens
ggtcgctcttagcgctggagttttccaggagtctgtccacactgagacactggagataacctaagcaatatgtggccacacaccttagcctctttcatatactttcctttgctccttggttgagcagggtctgtctgctcgcattagagaaactgcccagatgactcaaatcctgaagggatctgctttagaagaaaaaaggaatctaggtactatactcaactccatactagtaaaacaacctaatccaaataacacttaaaagctataatcacaatacaaac

SEQ ID NO: 564327 - DNA, 226 bp, Homo sapiens
tttttcagggaaagggggctttgtttttagggacaggcccgttccccccagtcccagtgggcctgtcccgggggggatgtactgtgccacccccttggggggcggcaggacatattttgttgcccacatgataaattttttcctgccataaaatgataattttggatatattaaactggttttttttgttgtccgtaacagttcaattcattaaagtttttgccta

SEQ ID NO: 564328 - DNA, 530 bp, Homo sapiens
tctcatggagactgtaacatgagatagcagtcttcccgtgctccacaattagtgatttgctttggtgcttaatttgaagtggtgaataagctaccttaaaccaattcctgctgcatgtactatctcatcctgattctcaagagtgtcaggaactgggtttcctcacagatactaccctatgattatttggtgagtaatactttatacaattgactctcccccaccaatcatacttgttccagtacaatggttacttggtttctccaacatatatactcgttttactcatcattggcctgtttgtttatttagaaactaatctggattcactccctctggttgatacccactcaaaaaggacacttctgattaagacggttgaaactagagatggacaggttggtatcttttaaggaaaaaatagggtaatctcagacaggagttgatatattttaaaatcagtgaatctgaatctcagatacagctggctaatttgagaggttcaggtttcattcatgcctactaaaaaa

SEQ ID NO: 564329 - DNA, 118 bp, Homo sapiens
gcgacggtcccggggaggataaatagagacccagtaaaatattcataagcagggcttgaattattgggttacgggtggtcttctattagactatggtgagctcaggtgatggatactc

SEQ ID NO: 564330 - DNA, 1895 bp, Homo sapiens
  misc_feature (1)..(2): n is a, c, g, or t
  misc_feature (9)..(9): n is a, c, g, or t
nnacgcgtngctctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccggggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcagggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgccaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttttgcttcaataaatttttggaaaacctcaatcgccccgaacgaaacacg

SEQ ID NO: 564331 - DNA, 757 bp, Homo sapiens
gctcggaccccggacctgatgtgtctcagtcctgaccggaagatggaagtggaggagctcagcgccccatgagccactaggtcgcttctctctgacccctgccacgagggggatactgagggaagatgatggatttgtgtgacagtcactaagagaacgttgacttcaacagtgagtgatcggatggcaaggtatccacaccacgggcatgaggagaaagtctcaatgtagataggcccccatctggatacaaagagcatctgagaataaagagcaagacggaaaagaggacactcattacaatgtaacagccaaggtggccaggcgggatctgtccagcatgctcgcgatcgccatgcacctgactagcagtggatcaccggacacacaatcgcttcaaagaaaggagctggaagctgggacaccaggggacaggggaacaacagccacgggaggcaggaataacgcgagaaggacgagaagcaggtcgaacgcgccctcacgtgagggacgacacgaaaagggaagagacttgaagcgagaacacctaaaaggcgcaccgccgaatacgtccccggcatacaacacagtcaagcatggagatccaccagcaactggacggcacccggacggaaacaccatacccatggacacagatagaacacaaaccagtagaaaggctagcacacagagaggaactcactccataaaggacccattaccatccctatacaagaaacagaaaagaccgggaaac

SEQ ID NO: 564332 - DNA, 1895 bp, Homo sapiens
  misc_feature (1)..(2): n is a, c, g, or t
  misc_feature (9)..(9): n is a, c, g, or t
  misc_feature (1386)..(1386): n is a, c, g, or t
  misc_feature (1394)..(1394): n is a, c, g, or t
  misc_feature (1397)..(1399): n is a, c, g, or t
  misc_feature (1410)..(1413): n is a, c, g, or t
  misc_feature (1415)..(1415): n is a, c, g, or t
  misc_feature (1430)..(1430): n is a, c, g, or t
  misc_feature (1441)..(1441): n is a, c, g, or t
  misc_feature (1445)..(1445): n is a, c, g, or t
  misc_feature (1457)..(1457): n is a, c, g, or t
  misc_feature (1461)..(1461): n is a, c, g, or t
  misc_feature (1465)..(1465): n is a, c, g, or t
nnacgcgtngctctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccggggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcagggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgccaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggagggncccgcggnggnnngggggggccgnnnngnggggggggggggggnggggggagggngggngggggggggggngcgngggnaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttttgcttcaataaatttttggaaaacctcaatcgccccgaacgaaacacg

SEQ ID NO: 564333 - DNA, 1894 bp, Homo sapiens
  misc_feature (1)..(2): n is a, c, g, or t
  misc_feature (9)..(9): n is a, c, g, or t
  misc_feature (113)..(113): n is a, c, g, or t
  misc_feature (121)..(121): n is a, c, g, or t
  misc_feature (123)..(123): n is a, c, g, or t
  misc_feature (128)..(128): n is a, c, g, or t
  misc_feature (132)..(132): n is a, c, g, or t
  misc_feature (137)..(139): n is a, c, g, or t
  misc_feature (144)..(144): n is a, c, g, or t
  misc_feature (149)..(149): n is a, c, g, or t
  misc_feature (151)..(151): n is a, c, g, or t
  misc_feature (155)..(156): n is a, c, g, or t
  misc_feature (166)..(166): n is a, c, g, or t
  misc_feature (168)..(168): n is a, c, g, or t
  misc_feature (171)..(171): n is a, c, g, or t
  misc_feature (176)..(176): n is a, c, g, or t
  misc_feature (178)..(178): n is a, c, g, or t
  misc_feature (180)..(180): n is a, c, g, or t
  misc_feature (182)..(183): n is a, c, g, or t
  misc_feature (186)..(186): n is a, c, g, or t
  misc_feature (189)..(189): n is a, c, g, or t
  misc_feature (273)..(273): n is a, c, g, or t
  misc_feature (312)..(312): n is a, c, g, or t
  misc_feature (332)..(332): n is a, c, g, or t
  misc_feature (336)..(336): n is a, c, g, or t
  misc_feature (358)..(358): n is a, c, g, or t
  misc_feature (368)..(368): n is a, c, g, or t
  misc_feature (394)..(394): n is a, c, g, or t
  misc_feature (401)..(401): n is a, c, g, or t
  misc_feature (421)..(421): n is a, c, g, or t
  misc_feature (438)..(438): n is a, c, g, or t
  misc_feature (442)..(442): n is a, c, g, or t
  misc_feature (444)..(444): n is a, c, g, or t
nnacgcgtngctctcgctccgaggtccccgcgccagagacgcagccgcgctcccaccacccacacccaccgcgccctcgttcgcctcttctccgggagccagtccgcgggagngggggggngnagggngatngggannntcggnagcgnangtgnnggaggggggngnggnggtgntngnannggngangttgggggggggggggaggcggggggggggggagggggagggggggggaggggagggggggggggggggggggggggggggggnggggggggggcgggagggggagggggagcgtgtaggggngggggggggggggggggtangggnggggggggtgtggggtgggggngggggggggngggcggggggggggggggggaggagnggggggngttgggggtggggggggggntgaggggggaggtgggnagangngggggggagggagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgccaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttttgcttcaataaatttttggaaaacctcaatcgccccgaacgaaacacg

SEQ ID NO: 564334 - DNA, 133 bp, Homo sapiens
caggcaaccgagagtgtaagttgaaatgtatggacataagtgactaccatgtagtaccaggactagagcaaggcaggctctccaccagacttaaagcattcaaccactctgcccccagagccgacactgacaa

SEQ ID NO: 564335 - DNA, 1924 bp, Homo sapiens
  misc_feature (1)..(2): n is a, c, g, or t
  misc_feature (9)..(9): n is a, c, g, or t
nnacgcgtngctctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccggggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcagggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgccaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccccttttaaaatttttttccttcttaaaagatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttttgcttcaataaatttttggaaaacctcaatcgccccgaacgaaacacg

SEQ ID NO: 564336 - DNA, 737 bp, Homo sapiens
  misc_feature (531)..(531): n is a, c, g, or t
  misc_feature (543)..(543): n is a, c, g, or t
  misc_feature (567)..(567): n is a, c, g, or t
  misc_feature (572)..(572): n is a, c, g, or t
  misc_feature (600)..(600): n is a, c, g, or t
  misc_feature (650)..(650): n is a, c, g, or t
agcggggctgctgcggatgtcggtgtgagcgaagcggcgcctgtaacacacggcggctgccgagcgcctgacccgggcctgctgccagagtcctgcacctgagctccggggccccacacccgtctacggtggccctgtcgcccgttgctactgaggcggcgtgctctgcattcttcgctgtccaggcctgccggctctggtgtcttgctggctcctccttgctctgcctgctccctcctgcttgcctgatgtcaccgccgccgtccgccgccacagccatggccgagtagtggtgaaagcggcggtcctccgggtctcccaatgtgatagtcgccgccggagccgtaaggtgctggcgtcccctcgtcgtgccgctgcctccgtcggagccccaaatatcagtgatacagtcaccgtgaagaaccccgagaggaccaacggacggaattcgccgtgccagagaatagctccgtccagcagtttaacggaacgaaatctctaacagcgttttaaatcacatactgacaactngtgttgatattngctggaaaattttgaagatcaganacctngagtcagcatggaattcatgatggactnactgttcaccttgtcattaaaacacaaaacaggcctcaggatcattcagntcagcaaacaaatacagctggaggaaatgttactacatcatcaacctcctaatagtacctctacatctggttctgctactgcaacca

SEQ ID NO: 564337 - DNA, 1873 bp, Homo sapiens
  misc_feature (1)..(2): n is a, c, g, or t
  misc_feature (9)..(9): n is a, c, g, or t
nnacgcgtngctctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccggggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcagggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgccaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggagtgtcggttgttaagaactagagcttattcctattccaaatctagtttacagaaaaatcttgtgctagaatactttttaaaaggtattttgaataccattaaaactgcttttttttttccagcaagtatccaaccaacttggttttgcttcaataaatttttggaaaacctcaatcgccccgaacgaaacacg

SEQ ID NO: 564338 - DNA, 1050 bp, Homo sapiens
  misc_feature (1)..(2): n is a, c, g, or t
  misc_feature (9)..(9): n is a, c, g, or t
nnacgcgtngctctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccggggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcagggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgccaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagttttgcttcaaggaccttcaagaggtcacttagatcccgagacagggtcagtccttaccttttaag

SEQ ID NO: 564339 - DNA, 1215 bp, Homo sapiens
gctcagcattcggggacgctctcagccttctcgtgcgctacggtcccagtcattccttctaaaatgtctactgttcactgatatcctgtgcaagctcagccttgcgagcgtgtgatctacatcgttacaccccccatagtggcatatgggtcgtgtcaaagcctatatctataggcttgtgatgctgagcagggagtgctttgtaacattgaaatcgatgtcatcataaggaactcacaaaggtgttgggatgaagggtcacgcaatttgtacaagcgattttgttgactccaactcgggcgagtcgaaatgcaacaggagcatcgacggagtactttgtccgttacgtccatatccaagaaggacaggacccaaatatatagggacaccttggcgttctggcaactagaaagttccatgcccttactctggttcccactcatggaggaccggtggacttttagggcctacttgatagacactctgtgcagacactgacgtcttcctgagtcttaactgcttccatgacggggcctgggaaactccgcttgagggaactctctgccttttgagatcaattcctgtctccccagaaatcaaatccctggagttctggcgcgtgtaatcttatacagaagttcctgaccaaggactcctgtgacccaggactggattcctgtggaagcattgcgaccactttattttcctgggaagagcctttctgagtttgagctttcccggccaaggcgtgcattggggtttgaccccttgggggatccgggcttagcaaaatacgcccagtaggcactgggctgttctgctcccattggagtctcatgagacctggagttgggagacaaagtacatgctcgcgggagtcttccttattgaacgtcggcgagggtggctcaccccaaggaaactggcgtgcgcttgtcctggttcccccggggtgggaattccagcattcatggaccggaatcgagataggatggcccaagctccagaaaaaggtatgcggataacgggtctccagaatggtaccagggccctttattgaccatggttgggaaaggcatttagggaacaagaaggtttacagggacgacccgggaaaaattcctttaccttggaaccctggttaccggaggcctttttataaaaccaaggcccctgagatatattgcgaggaaacgcggtgtgttagtgatttcc

SEQ ID NO: 564340 - DNA, 952 bp, Homo sapiens
  misc_feature (1)..(2): n is a, c, g, or t
  misc_feature (9)..(9): n is a, c, g, or t
nnacgcgtngctctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccggggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcagggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgccaaagtggaatctttgcagaagagaatcctttttgagaacctccacgcagaggaatccaggacctccagctcagatcaggacacatgtccaatcgatgtgatgttccagcttactcaggctgcctcgtacgtcgtac

SEQ ID NO: 564341 - DNA, 229 bp, Homo sapiens
gcgttctcctttaagtcactcagtctctaatggttcaccactaaagtggcccaggaaatgaggcgtgcagcagcagtggtgtgggaaagcacagaggagacaaggctgggacgtgctttatgggcttgtggcttaacccaacaaacagctgtcagagaacacagctcaagggggggcgggcagggtgctgttcttacagaactgcagaatggaagagccacactgttcc

SEQ ID NO: 564342 - DNA, 1002 bp, Homo sapiens
  misc_feature (182)..(182): n is a, c, g, or t
  misc_feature (316)..(316): n is a, c, g, or t
  misc_feature (925)..(925): n is a, c, g, or t
tcaataccggtacctgtacatgcaccgtggcttacaccactattttcgacacctgacttttctcaactcgatcactcatctagggggctatcttacttggacggttatctttatatgagacaccacgatgccttctcaacgcacatactaattagcttacacatactaatcatagcgatctntcgaccatgactactgattttccaattgcgttgctgacgcagactatgtcgcttagacacatgaccgctactcaccctttactaatacacgaatactacttctaaatctcatttacgcatgagattcatttctngtcattctacacatctaatgcgtacacctcaacacatctcgtgaaacaacttactctccatcgacccctatccatgatacatcattctcattctcattctctctatcgtcccacttatatcgttaacactaacaaagatttcacactaatgctcaaacttatatcttgcaccaaatgcctaaacgcagccaaactgtctcttgtcatacgaccaattctccgatatcatacaccgtaatatacgctccacagcatatacgtatcttaaagttcccacttcgattacatctactccatcctccttcttaccactactctcgtctacgtatatcaccatgtacattctattacactccttagaacccaaccacgtatcgtagcctactctctcgcactccttcatagagcgtcttctcgtcatctcacttccaatgtacactcgacgcctctacacgatatgaatgtctcctaatcaatggacggtctcacttatagatacaccactcctactacatcaatatcatactgactgctcacctctacatgccacacgtactctctcgtcgatcatgattctctgagtatccactgtatacttctatctactcnttcaccgtctatactcgattactcctcctctatacgccttctcaactccgttactatacaacatgtcgtcataccaa

SEQ ID NO: 564343 - DNA, 470 bp, Homo sapiens
  misc_feature (10)..(10): n is a, c, g, or t
  misc_feature (346)..(346): n is a, c, g, or t
  misc_feature (370)..(370): n is a, c, g, or t
  misc_feature (452)..(452): n is a, c, g, or t
  misc_feature (457)..(457): n is a, c, g, or t
cgcttttganattacagatttgcacccgacatcttcaaatggcgatctggacgtcaccatcgacgagcgcgatggcaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgaattatctgcaattacaccgcctttttattagggctggggcgcaatctcgggaactggggcgcagtgtcgctggatgtaacgcatgngcgcagtcagttagccgacgccanctcatgagggggattctattcgtttcctctatgcgaaatcgatgaacaccttgggaccaattttcagttaatgggttaccgntattngcaaaaggtttta

SEQ ID NO: 564344 - DNA, 154 bp, Homo sapiens
cagtgctagggaagaacacagccctcagctttagagtcagcagacaagcgcacatcagaggggaggggtttttggagggacggagggtacccccatatctgcagggtgccgcaaaacaacatgaagactcttccgccgggcgcattctgtgagg

SEQ ID NO: 564345 - DNA, 785 bp, Homo sapiens
gggtctccaagatggccgcttggggaaggaggcgtctggcccgggcagcagtggcggcagcgcccgagagagggtgagcttgtcggccacagactgctacatgtgcatgagatctacaatggggagaatgcccaagatcgagttggagtacagagctggagcgaggccctggaagcccagtacaagtacattgtgatggagcccactcgcatggtgcgacgagacgagcccgcgtggatcaccgtgggcgaacgtgccttgtaggcaagaatggcgtgcttggtgggcaccgccgtggccctcttcaccccgttggctgctgcccttagattattgcccactacatttccctgtcccgctggtgtgctgagccgtggcctgctgcacgcctctgatgggatctcctggcagtttttgacccttgctgcaagtagccaagtggagtacgacgctataaactgtcgcgccgtgctcgtgacaacactcacctcctccacccggtggtgctggtccggaaggacgacctgcgaccagaaagagactgcgcaatcacgatagcactggccgtctggggtgcaacgggcgtaaaggaagatttacggcactctatgccgtatgattcagccacaacgaggacgcgcagcaacacacccggccaacaagagacagcagagtctccagatcggcacactcgggagggcagcagagccggcaggttcggctagcatgccagaaaaaaacagtccggtggccagggttcagtcttaccagatggttccacccgg

SEQ ID NO: 564346 - DNA, 843 bp, Homo sapiens
  misc_feature (841)..(842): n is a, c, g, or t
gggggtcctaagatggctgctgggcgaccacttcctgacagctccagttaatgggactgccagcaggtagacatccttcgccggaatgtgcagcgctaaagttctgtgcccgggaggggcttctctctcttggggatggagtgtggcattgccgccagaaagcctgcagaattccgggttggtgcagccaagcaggaacggtgtacctttctagacccatcctcttgcaatcttggaccctaagaaacgatgtgccagtgcgctagtaacctcctggcctaaatgaaaggtgacgctgagtcaaactcggaaagatgaagctacgttggagaactctggattaatttacaggaggatacgaggattgagagcatcagaaaaacagaattcatagatttctcaaacagatgaccaaaaaattgaaacagagtcacatgtaatgcctatgaagagtgtcctttctgaattcccatagatttgtggaatacaattcaagaattgcttaaaaaatttttgaaagaaaagcaaactcaagatcaggggaaacgagaaagctccagaaagataattgcccagatgaacacgatacttagtgaccgctcagatgaaccaggggagggctacagattggagtcagatgattgcccgctgtaaagggacagtggagccggcctgaagaggtgacacgtggcgcgtggattggagcgggatagacatataccagctggaatccacgtccccatgaaccaggggatccgcccaaaactggtggcaacgacctgttatatcgatgcaccgagcgcgcagcacactttctctcttcttgtgtatgcgtcctcanng

SEQ ID NO: 564347 - DNA, 186 bp, Homo sapiens
ccggcagctatcggtcatatatgggtctagagtatattccatcagaaaaataatttccaaaacttaaggcctttaaaaaaataccagtacactgatgttgaaccattttaagtatatatatatcccacagcaaggctttaattatatggcatcttactttgggattgatttcatcctccaattctg

SEQ ID NO: 564348 - DNA, 129 bp, Homo sapiens
ctggcagttgttacggaaccttgggcgtaccacaaacccgccgcgcttatgggccctaagggggcgtgctgatgcgggttttttccttcgcactttgcgggtttaaaccccctaaacgtctcgttagct

SEQ ID NO: 564349 - DNA, 273 bp, Homo sapiens
aaaggggtcttttgtttgttcgtttctcttaaacaaggatcaaagagccccgcaaggggttccaaatagtgtttcaaaccggtccgcaagtccgcggattacatgtcctaagtgggtctctagtagttcgggccgctggccgcttggcgcccaggcgggtgggctccaccccagttctaagttgcgcccaccgcaggtcttttccgcagtctgggggggccaacccagcagcggttccccacggctggtcgttaaatatctgtacaacatgac

SEQ ID NO: 564350 - DNA, 691 bp, Homo sapiens
ggctgagaatgagaggaattgagaagcgagacggggacatgtgctttctgtgaatccgattcgttgtggctctttactcgttgttgagctacgtgctggagcctggtagacacgatagaccaggtaggtctgggctgagccatgatatccagtgagtcgtcgacattggatgaagcaaggtgatcgcctagagatcgatgattactggtagaccgtgtatttcagggcatcaatcgtcggaacctgagcggactcaatgatcttgctgcaaaattactgctggtatcagatgctgctgaatcgattctgtacgcattgacgacatggcccgggtccttgcatagcgtgactgtacgttatcatgcaggtccaagggtcatcgagcacagggagcgttggtcgcaatggcgcgcgaagctctgtgagcgcaacggacgatccgatatggcgttccggccagaagagtgctatgggatcgacgtctcgagattatcaactacgtaagtggccagtcgtggacgcacaggatgcatcgagtgtgccttcctctataggtgcagggaagcttggcgtcgttgcaagttgcaaagggaacatgacacggcgaccgggaaaagcatgggagaccgctacacagacgtgtcccgttaacaaagggaccgcaaggaaattatggcgcaacggtttgtac

SEQ ID NO: 564351 - DNA, 1756 bp, Homo sapiens
  misc_feature (1756)..(1756): n is a, c, g, or t
tccaatattgacaaaattcttgaaccacctgaaggccaagatgaaggtgtgtgtgatgtatgaacatttaaggcagttctgccttgcagctaacatggcacttgctcgtccaaacttccagagctgacatgccatccagcatacttgcactccaacatgaccagctaactgacaccaatggcattttatctttgctgcagcgtcataaaaactcccaacacagcagtcgtccatagctacatagcactccatcactcagcaccaccaccaccttgcactggctgcttgccatggtctttccttgcacatcagaccaatcacacatcatatttacccaagaccagcggcttcagctatcacaagcgcacatcgcatccttgatcagctgcacacacatcagtgcaatcgagatcatcgcccagttcagccgcatctctccaccagcacactcatctctctccaacaatggcgtctcaattatctcacatcccactcacggccaagcaatacatctctcgcattcgcaatccatcgcacacacaattgcacacccacatatctctttgcttgtcccatccaggctcttcacgtccacacgctcctacgtatgcaattgcacacatctacgacaatctcttggcactacgctccccacaacggccatacacaaccttagaatacagtacaccccacatctctatcacgcacactggcagtgcacacgtcaccacgaaatttccacaggtcaaccattgcggggcacacagctgccacagccgattgcacacgggcacacctccattacgggcacacccaacacgtggctacctcgcaattccaataatacaatatacaacccattctcatgctacctggtccagtcacttcactcccatttccaaggaaccacacactaccacgagtacactggtcaatacccaatcacttcaatcagccctccttccgcatcctaggctcatagcgcggcttctcactcggccaccatggcgactgggacgcctcatcggccccatcaatcacccaaccaactggcccgcaaaccatcacaccatcctcacaacgctcactttccacatagacagcctcggatagtaatttacacaccaccatagtcttgatcgaccaacgtcccacttgtgtcatacatccaaaactctcacacgacctcttaacccactcacctcctctagcctcagcattcacacactagccaattcggtagaaatcacacacatccacaagcatggccacaaggcgcacaggcgcgacacacacccacagggacacgagcacaacaccaacgcgcacacagcgcgcacgccacacgacgccagacgtaacagccacagacagccgacgcctggaggacaacaagcagacgaagaagagaacaaaaacagaagcggaataccagcagagagccagtcctaagatctacaggatccccacgtcatacaggacacgagaacccagcaagctcgcaacgcagccgcggtgcacccacggggctgagcgacgagcagcagccaatcacaccacgcagcagcctgacgagagccgacctcactcgaaacgacgatacgcagggaggcagtcaagcgcgcctcacgccccacacaacggaaaaccaaactaaaacagacaccacacgacaagcgacgtcgcgaacaaaccagagccgagacgcaggcactgcgccaccgtcgcgaacagaccggagcgaacaatcagatgn

SEQ ID NO: 564352 - DNA, 647 bp, Homo sapiens
aaaagaccccatggtgtgaggtttaaaaaacatgacattttataattatgttttttatcattataaagtgaagggagaatgttcaaggggttaataatggaaatcatgctcacagcttatttttttaaagatagtttaaaattaaatttatgaagaaagagagagattgaattacttagtatttagttaatatgaacttttatcacaaaatgccatagactacgtagcttaataccagaaacaaaattcttacagttctggaggatatgtgattaacgaaaacatgcaagacaagaatactataaatagcccaatatgattttaaataaatgttcaattcattaaaaaaataaaggtccacacaccatgccaattcttgcttaaggacaaggttatgaaccttggcaagtcacctccatggaaatattaatgtatatcatgcacaaggagtggaggatcatcactgggggtgattttttttccccaggggacattggaaatgtctggatgcattttttgttggcatgacttgggaggaggatgttaccagcattttatgggtggtcagccagaaatgctgctaaacatttgccaatgcataggacagccccttcaacaaagaaatatctcccctcaaagcaataggg

SEQ ID NO: 564353 - DNA, 184 bp, Homo sapiens
tcagctcggtaccgactgagatgtctgagcagaataagacacacttaagtatttttggtgatgggtgtctagattcttttttttttttattctttggcgcatggggattctacagttatcccagcaccattcgtggaaagattcatcttttctacttggaggtgtgttggtcccctgtgtaaaa

SEQ ID NO: 564354 - DNA, 172 bp, Homo sapiens
aaagtttggggggaacaaggtaaaaaaaattttttttttttggcaacaaatctttttgcctgcctttcagcgtggttcagaaaattttaaaaatcccaatagtaatcaaaacgttcataacctttgaacggaaggaaatgctgtgggccccagaactcccagaattttttta

SEQ ID NO: 564355 - DNA, 806 bp, Homo sapiens
ttcatgggcgtcggcagcgcaaaacgcaccgactctgccataggcccgggaagcgcttgggcgaagaggaggaggccaagggtaccgagactggagtggagctcggagagccgagagagcggtggaggcggatttcctgggcccggcctctggcgctaccatgtgcgtttggcaatgagtcaccgtggatcccatacgacgacctccgtgggccacctcagtagaaaaggctacatttgctggagttcagactgacgattggggccagttcatgcacatctgtgacataattaacactacccaggatgggccaaaagatgcagtgaaagctttgaagaacaaggatttccaaacaactacaatcataaagcaactccaacttaccttgtcacttattgacatgtgtgtgcagaactgtggtccaagtttcccagtctctgattgtgaacgacggaatctgttagcagaggaacttagttaagctactgaatcccagatacaactttggccattagacattcagacatcgaatcttgaatttcattaagacttggtcaacaggggcttcccaggagggtgtggatgtacagccgaagtccgaaagaagtatacctcgacctcggttaaagaaaaggcgttcaggataccgtcccatcgagaagcaggaggcgttgacacaggcaaggcagaagaagactggctaccaaatctcgagtcaagttcttcaaccaatctggcccttagggaaccagagttctaatctcctgtaataggctcccaagaacccgaatggtacattgggaccc

SEQ ID NO: 564356 - DNA, 262 bp, Homo sapiens
agagacagagagagatagttgagggaagcatgataaacaaatcacagtaagacaaaggaagaacctggggtgtttctaaccagtgagaaatcttcatggtggaatttcagaccttaggatggcctaataggcagggtacatgttggttagggtgactagcatatcttgggcctcttgaatcatgcttcataggtgcctcttccactcacattcaaattcctaattgtgggacaaaagaaaaagtccgggccgggcacggagg

SEQ ID NO: 564357 - DNA, 83 bp, Homo sapiens
tcaagcttctaacgatgtacggggacatggtgcactgagctgtaacttcttccttccctattaaaattagaacctgagtatga

SEQ ID NO: 564358 - DNA, 103 bp, Homo sapiens
aattttgtggggtctgtcttcttttggtaaatattgcccacgtgatattaggttggatgaagcacttcctaaaagtaaaaaatgttaaatctgtgcgtacata

SEQ ID NO: 564359 - DNA, 1301 bp, Homo sapiens
  misc_feature (191)..(191): n is a, c, g, or t
  misc_feature (195)..(195): n is a, c, g, or t
agttcgacggagactctcatataacatgcattagttcgttatatgagagtctgttttctttaatgtactgtaacttctcccatactctaccaatcctcctgcctcagcatccagactggctgtgattgcaggtgtgcaccaccacacccagctacatttttttttggtagagacagggtctcactatgttncccngtctggtctcgaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataatgtctcaagagaggaaggacaaaactgttacaaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggctctgtggctcagttaatcactcccacaactttgagctgtgagttttactggtggaaggaactttaacagggtcttccgtctggttcatttagaatttcaaagaactgaaattagttggaatggtaagcagtgaatagatgtgttgttagaatgattccatcacttatacattgtttaaaatgctaataaagtaacttgctttgtaaaaaaaaaaaaaaaaaaaaaaaaaaaaaaaaaaaaaaaaaaaaaaaaaaaaaaaaaaaaaagggggggggggacaaaaaaatactcccgcgaggggcagccaaatgtaatgagacaccgaattctcttttgggaaaaggagcgcccccgaagggggaggtatacaacacaacaggcgcgaccccgggcatacacacgcgggcacggaacaaagtggtaacagatacgttggagaagacctccctgcgggggacaaacggacaccacagagactacgccaggaaaaaacacgcgtgtacgtgcacccgcaatcggcgaagaatgcacgatatgaaatcg

SEQ ID NO: 564360 - DNA, 1361 bp, Homo sapiens
  misc_feature (46)..(46): n is a, c, g, or t
  misc_feature (251)..(251): n is a, c, g, or t
  misc_feature (255)..(255): n is a, c, g, or t
cgtggtggctcacgactgtaatcccagaactttgggaggccaaggncaggtggatcacttgaggtcaggagttcgagactagcctggccaacatggtgaaaccccatctctactaaaaatacaacagccgggtgtgatggtgcacgctcgtgatcccggctgctcagcatccagactggctgtgattgcaggtgtgcaccaccacacccagctacatttttttttggtagagacagggtctcactatgttncccngtctggtctcgaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataatgtctcaagagaggaaggacaaaactgttacaaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggctctgtggctcagttaatcactcccacaactttgagctgtgagttttactggtggaaggaactttaacagggtcttccgtctggttcatttagaatttcaaagaactgaaattagttggaatggtaagcagtgaatagatgtgttgttagaatgattccatcacttatacattgtttaaaatgctaataaagtaacttgctttgtaaaaaaaaaaaaaaaaaaaaaaaaaaaaaaaaaaaaaaaaaaaaaaaaaaaaaaaaaaaaaagggggggggggacaaaaaaatactcccgcgaggggcagccaaatgtaatgagacaccgaattctcttttgggaaaaggagcgcccccgaagggggaggtatacaacacaacaggcgcgaccccgggcatacacacgcgggcacggaacaaagtggtaacagatacgttggagaagacctccctgcgggggacaaacggacaccacagagactacgccaggaaaaaacacgcgtgtacgtgcacccgcaatcggcgaagaatgcacgatatgaaatcg

SEQ ID NO: 564361 - DNA, 1113 bp, Homo sapiens
ttggttttcttcccgtccacaggacgagacgtttactactgtgcccactcgtgcggtttctctatgcatagtgtgtcccgtgtgcgcccttccctatatgaagtccaagctggttttccctcctcgattacctctcgatggattaacaccacccctgcctttggcaggtggatcaccaccttgttgttagtatcgttctcctcaaggagaagtgcgaaacccgttgtactgtcgttagcgccacttggggataaaccggcgccgcgtttgcgaggaggtccatggacagcccgcgctgtcggatagcagaatatgggatattggataggtgggatttctttactccattctattggttgaacataaaccgctggttggttacccttgggggtttcgaagggggctctctgctacatgtgaattaatctccccttcacgctccctttaaaggtggggctcgtgcctgcctgtcgtctcctctttcgactataaagcctgccctttcccaccatagcgctcacccgaaagaggtcaatagattcccccatgggctcaaagtcctcgcgcatatagagaccttccattgacaaagtcattccccacacaagttcgtgagacacagttggttcatatgtgtcaccatgatgttgccatgccaaaggtcgacgagcctagtcttgtggctgaccacgcagcacctgatgtagcataaatccaagcaccatgtggcgcattcggttagtattctcctgcttctgggcgtagagctatcgtccctctctgctcgaggtcaaagatggaagatcggcacgccctccacctcacacacagatgctcgagatggtacgcatagtagaatagatggtcctgggacgcggtaggctcatcgcctgtcaatgcccagcactttgaggagagcactgaggacgggcggatcatgaggtcaggagatcaagaccaccctggctaacacggtgaaaccccatcttcttacttataaaataaaaaaaaaaattagccgggtttggtggcgtatgccgtgtaatcccagctactcgggaggctgaggcaggagaattgcttaaacctggttgatggcaggggcagtgagca

SEQ ID NO: 564362 - DNA, 222 bp, Homo sapiens
gccattgatgtggaaggatctacttctcctcacatagcagataaggttgaatcacgtattagtgacaaacagaggcctggacagaaggatgcaacttgtgtgcgactttgaggtcgtaattctaactccaagaggctctagggtaatgtggcaactctgaaggataattttggatttattgaaacagccaatcatgataaggaaatctttttccattacagt

SEQ ID NO: 564363 - DNA, 168 bp, Homo sapiens
cgtgggcacctggaatgggccacattggtgggtggggggtaacagagaacagatggtgtcacggaagtttctctaggagtaaatacatgtggatattcttaggtttcccgtctcctctcgccagctgacagctgtgttacgtgctgttgacactaattataaacatgt

SEQ ID NO: 564364 - DNA, 392 bp, Homo sapiens
tgcggggtaatctgagaaggaggaggtggctggtaaatattatggggtaaatggtacctatctatgcaaatagaaagaaccccttcattttcataaacccttctcaacaggcccagataggaccatacttagacaatgtaagctgtagcatcattcaataacccagtgaagcattcttgcaccaatcggtttcaatagttctcactaaacagaaccacctcttacatctactagcaggtgtaactgacaataaaatcctctcttatctacagttagatgtatattacaaagaaatggtttcaacgccctttcagaacactcgggatatgtatatcgataattatttgatatttagtgtacatctgcctccaaatcctttaaatgatatcatc

SEQ ID NO: 564365 - DNA, 388 bp, Homo sapiens
  misc_feature (58)..(58): n is a, c, g, or t
  misc_feature (60)..(61): n is a, c, g, or t
  misc_feature (90)..(90): n is a, c, g, or t
  misc_feature (159)..(160): n is a, c, g, or t
  misc_feature (211)..(211): n is a, c, g, or t
actcagaagagagagctagtctcccaggtctgctgatagagggtaacaaaatcaccanannaacaatctctaaacagagacagctataanaactaactacagagattaccagatggtgaaaggtaaacataagaatcttactaacagaaaccaagaccnntcaccatatcagaacccagcactcccacttcgcccagtccaggacaccccnacacacctgaaaagctagacctggatttaaaagcatatctcatgatgatggtagaggacatcaagaaggactttaataactcacttaaagaaatacaggagaacactgctaaagagctacaagtccttaaagaaaaacaggaaaacaaaaaaaagtcgtatcgatgtcgagcgatcg

SEQ ID NO: 564366 - DNA, 382 bp, Homo sapiens
agacaggcagtgaacccctgtgtttttatgccatatgaactgagaagtagacgcattctgtgtaatggatacacactgaggctgcaatttttgaaaagtcattgttttgacttccctatattcacatcgaataacgcttttagtctttgccctcagtactctagaaggggctatatagcctgtttttgtatttgtgggaaaaagactagaagctgggcaaaatgccaccaggaagactaacatggcgacgtgatcccaagggaaactgaggtctcacactgtccagcaacagaaggaggttgaattctggaggaggtttaattttttaaaaactcaaactaataaaagatgttcacaaatattaaatattcttatttggaaa

SEQ ID NO: 564367 - DNA, 260 bp, Homo sapiens
ccacccctgctacctgcgactatgctacacggcaccccctgctggattgagatacatctgcacggccgcattagtggttggataaagtacttactcaaatgggttcactcataatcctatttcatctgtatcttaaatggccccaggccatctgcctcttggaaaactaattgagccttgcatgtacttgaacggatggatgagtcagacacggattgagaactgacaaaaggagccttgataagtacttgacctctgta

SEQ ID NO: 564368 - DNA, 404 bp, Homo sapiens
ggatcactgcatgagatggcccaaagtgttccccaaaagtacgccatcacaagcatttccaggaccccagaggagatagagaaggaacttagagctcccgtctctaagactttttatactcttgcacctgagttatcaatcaagccttttatttgtaagagtaatctgttggcctctgtttcagatgttagggttgggaggaacctctaccttcatgggtttccattccagtgaagtcccccccaccccccagccaccgctgtccaagatgaagtaagactacagacagcatttccttggcttgtcctgagccctctccactcgcccagatggagtctgcctttctgggccatcatcttgaagcccagggcatgagccaccattgtccctttaatgatgaattc

SEQ ID NO: 564369 - DNA, 191 bp, Homo sapiens
cccccccccccccttttttttcccgggggcccttttttccctttttcccccaggggggaaccaaccccggggcccccttcccccgggggtttttttccccggggggtttttttgtttttctttccccgggggttggggggccccattaattttcccccaggggccggggtttttttttggggtttttttta

SEQ ID NO: 564370 - DNA, 263 bp, Homo sapiens
ctttggaaggctgaggtgaggggaagcttgaggcaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagtctggggacagaggaagaccctgtatccgctctaccatacacaag

SEQ ID NO: 564371 - DNA, 272 bp, Homo sapiens
tcatacataggtaccgactgagacgtcctctgcccctacgtgtactccttattcgactggccgtcccttctgggttactcgtctggctcagtccgggtctgacttggttcctcatgttagtatctctgcgcgtctgcgctacttccccagcacagaccgagtgctgtcctgccggtcctgacgcactgtccctgtaggccacgctgagtcatggtaagtcatgtcctcccacatttggcactggatcgtgcgattcttctcattctggtgtc

SEQ ID NO: 564372 - DNA, 911 bp, Homo sapiens
  misc_feature (32)..(32): n is a, c, g, or t
  misc_feature (63)..(63): n is a, c, g, or t
  misc_feature (66)..(66): n is a, c, g, or t
  misc_feature (85)..(85): n is a, c, g, or t
  misc_feature (113)..(113): n is a, c, g, or t
gaggaaggcgagagagaaaggggtggaccccntgggaggagccacgcacatggaaagacgatnggnaaggagcaagagaagaganaggggaagagaacacggggaaggaggangagaagggtaagagggaaggaaaggaggggaagttggggagaaggagggaagaaggaaaggaggaaagaaggagagagagaagaggggaacgaaaaaagcgaaagaggaggggaggaaggaagcaaggggggaaaaagacgagggaggaacgaaggagagcagagaggcgagagaggaagagaaaggggagaagaaaggaggaagaggaaggaaggagaaagagcaggaggagggagagaagagagggagggaagagaagaagggggagaggaaaggggaggagaggggggaaggaaagaggaagaggggggaaaaggaaaagggaaagagaagggcgaggaaagagaaaaaggagagagaggaagagagaggagagaaaaaggaagagaggggcaagaggaaggggaggagcaaagagagaaggagaggaggaaaggaggggagagagggggaaagaaggaggagaggcaaggaggaaggagggaggggggaaagaggaagggagggagaaagaaaggagagggaagggaggaaagagaggaagaggagagaagaaggaggggaagagggggaagggagggaaaagggagaggaaagaggaggaggaagggaagagaaagaagaaagagagaagggagagagcgggggagaaagggaaaaagagggggagaaagagaggagaaagagagagagaaaagaaggggaaagggggggaaaaagagggaaaaaggggaggaggagaagagggagaaggaaagagggaagagaagagaaagagagggaaggaagaaggggag

SEQ ID NO: 564373 - DNA, 218 bp, Homo sapiens
  misc_feature (109)..(109): n is a, c, g, or t
agacagccaatgctatgaatgcgcggacacgtcttgacggaaattaaaagtgctactccatgtgaacacacacaatgataacaaatgcaagaacaggccatggcacagntggctcaccacctgcacctttggtcaggcttgacggcgtgcagagtcaccctgaggtcagagagttcgacgaccacggctggccaaccttggcgaacagcccatctcca

SEQ ID NO: 564374 - DNA, 318 bp, Homo sapiens
tgcagtgtccatctccacattgatctcaccaccccacctggctcgcagtggtgtccatctcctcctctgtggttcttcttcagtgtaggccagctcctccttgcagtgttctcactctgcatctccatggtcgtgtctggccagtgtcagctcatccagcaccctgtgcagtgcattgatgtctggctccacactcagtgctgcatgtggcctgctctgtctcaacattggtgctggaagtcatcagcagccagatgggcattgtcaatccttgtaacaggatgttggcattgtcccactggtggatgtgagtgcatc

SEQ ID NO: 564375 - DNA, 646 bp, Homo sapiens
  misc_feature (63)..(64): n is a, c, g, or t
  misc_feature (88)..(88): n is a, c, g, or t
  misc_feature (97)..(97): n is a, c, g, or t
  misc_feature (159)..(159): n is a, c, g, or t
  misc_feature (237)..(237): n is a, c, g, or t
gcagtccaacagcacaaggcgggctatcacagtgatagggaggtggcaacgagtctgggcacnngggagcaccagttcggcgcatganatggataanacagggaatgggccgagcagctgcaaagatgggccggggcaagcacttcatcggagacttcntgcctccagacgagctggaaaagtttatggagaccttcaaggccctgaaggagggccgtgagcctgctactcagagtncaaggagttcaagctgactgtggagaacatcggctaccaaatgctgattaaaatgggctggaaggagggcgaggggctgggctcaaagggccagggcatcaagaacccagtgaacaagggcccccccccagtggacggcgctggttttggcattgaccggccggcggagctttccaaggaggacgacgagtattaggcgttccgcaaaaggattatgctggcctccgcttccggcccaaccccctgaacaatcccaggcggccttattattgagtgttttggaaatacatactttttgaatgaccacccgtccctggactgtggaatgttccggcctgcatttttgccccccccttccgttgtcccgagtgccgtgccgtgtaataaagtcccagtgctcatcccccca

SEQ ID NO: 564376 - DNA, 122 bp, Homo sapiens
tcttcccctgacaattaatttccaaattatactagaggaacgctcacgtgatacttcactgaaaacagaatagtgagaataatatatatgatgaccagattcagacatttaaatatcaggtt

SEQ ID NO: 564377 - DNA, 678 bp, Homo sapiens
  misc_feature (116)..(116): n is a, c, g, or t
  misc_feature (120)..(120): n is a, c, g, or t
  misc_feature (124)..(124): n is a, c, g, or t
  misc_feature (135)..(136): n is a, c, g, or t
  misc_feature (149)..(149): n is a, c, g, or t
  misc_feature (183)..(183): n is a, c, g, or t
  misc_feature (194)..(194): n is a, c, g, or t
  misc_feature (202)..(202): n is a, c, g, or t
  misc_feature (204)..(204): n is a, c, g, or t
  misc_feature (235)..(235): n is a, c, g, or t
  misc_feature (247)..(247): n is a, c, g, or t
  misc_feature (252)..(253): n is a, c, g, or t
  misc_feature (292)..(292): n is a, c, g, or t
  misc_feature (325)..(325): n is a, c, g, or t
  misc_feature (384)..(384): n is a, c, g, or t
  misc_feature (396)..(396): n is a, c, g, or t
  misc_feature (402)..(402): n is a, c, g, or t
  misc_feature (462)..(462): n is a, c, g, or t
  misc_feature (471)..(471): n is a, c, g, or t
  misc_feature (474)..(474): n is a, c, g, or t
  misc_feature (477)..(477): n is a, c, g, or t
  misc_feature (487)..(487): n is a, c, g, or t
  misc_feature (519)..(519): n is a, c, g, or t
  misc_feature (521)..(521): n is a, c, g, or t
  misc_feature (562)..(562): n is a, c, g, or t
  misc_feature (572)..(572): n is a, c, g, or t
  misc_feature (578)..(578): n is a, c, g, or t
  misc_feature (592)..(592): n is a, c, g, or t
  misc_feature (600)..(600): n is a, c, g, or t
  misc_feature (623)..(623): n is a, c, g, or t
  misc_feature (658)..(658): n is a, c, g, or t
  misc_feature (662)..(662): n is a, c, g, or t
  misc_feature (670)..(670): n is a, c, g, or t
  misc_feature (676)..(676): n is a, c, g, or t
aggaagcaaggaaggagtggggtgaggggaagaagaaggggtactgatttacccctattctaaatgctcctagtgccctgtaccttcccctcataagccttcattatcattgtgangatntgtngatgtaatatnntgattaatgtctntccttcactgacctagcagttctagcagggcagngattttgctgngttgcatncncagcacctagtctggtatgtggcattcagcntatgttgattgnatgannggccatgtgggtattcagagcgtgcgtgagtagtggggntgggattggggggggggtggcaggagcaggggnagtagtccgtgtcccctgtggatctgatacactgcccacactggcaacacacatacacntacagagaattntggctnagttagataattaacgtgtgcttggttgtgaaccaaaccactggttcttaaactgtcatnggatcaggngantgnagaattgaanagtggtgggtctggcctaatgtctggagcctngnagaggagtggatgagggcgtttgggatggagcaggcagccnttccctgctnctgggnctgtgatgaaggcnagttgaantggagtggtgcagccgtgcgtgnggctgtggcagagggatgtggtgggctgggggggngggnggcggggngggggngg

SEQ ID NO: 564378 - DNA, 675 bp, Homo sapiens
  misc_feature (166)..(166): n is a, c, g, or t
  misc_feature (170)..(170): n is a, c, g, or t
  misc_feature (174)..(174): n is a, c, g, or t
  misc_feature (185)..(186): n is a, c, g, or t
  misc_feature (199)..(199): n is a, c, g, or t
  misc_feature (233)..(233): n is a, c, g, or t
  misc_feature (244)..(244): n is a, c, g, or t
  misc_feature (252)..(252): n is a, c, g, or t
  misc_feature (254)..(254): n is a, c, g, or t
  misc_feature (285)..(285): n is a, c, g, or t
  misc_feature (297)..(297): n is a, c, g, or t
  misc_feature (302)..(303): n is a, c, g, or t
  misc_feature (353)..(353): n is a, c, g, or t
  misc_feature (360)..(360): n is a, c, g, or t
  misc_feature (381)..(381): n is a, c, g, or t
  misc_feature (393)..(393): n is a, c, g, or t
  misc_feature (399)..(399): n is a, c, g, or t
  misc_feature (459)..(459): n is a, c, g, or t
  misc_feature (468)..(468): n is a, c, g, or t
  misc_feature (471)..(471): n is a, c, g, or t
  misc_feature (474)..(474): n is a, c, g, or t
  misc_feature (484)..(484): n is a, c, g, or t
  misc_feature (516)..(516): n is a, c, g, or t
  misc_feature (518)..(518): n is a, c, g, or t
  misc_feature (559)..(559): n is a, c, g, or t
  misc_feature (569)..(569): n is a, c, g, or t
  misc_feature (575)..(575): n is a, c, g, or t
  misc_feature (589)..(589): n is a, c, g, or t
  misc_feature (597)..(597): n is a, c, g, or t
  misc_feature (620)..(620): n is a, c, g, or t
  misc_feature (655)..(655): n is a, c, g, or t
  misc_feature (659)..(659): n is a, c, g, or t
  misc_feature (667)..(667): n is a, c, g, or t
  misc_feature (673)..(673): n is a, c, g, or t
aggaagcaaggaaggagtggggtgaggggaagaagaaggggtactgatttgaaccctggagtcctaaggataatctaggaaccctcagacccaatccgatacccctattctaaatgctcctagtgccctgtaccttcccctcataagccttcattatcattgtgangatntgtngatgtaatatnntgattaatgtctntccttcactgacctagcagttctagcagggcagngattttgctgngttgcatncncagcacctagtctggtatgtggcattcagcntatgttgattgnatgannggccatgtgggtattcagatcctccttgatggggtggggggggcggtgtngcagaantggcgccaacacacatacacntacagagaattntggctnagttagataattaacgtgtgcttggttgtgaaccaaaccactggttcttaaactgtcatnggatcaggngantgnagaattgaanagtggtgggtctggcctaatgtctggagcctngnagaggagtggatgagggcgtttgggatggagcaggcagccnttccctgctnctgggnctgtgatgaaggcnagttgaantggagtggtgcagccgtgcgtgnggctgtggcagagggatgtggtgggctgggggggngggnggcggggngggggngg

SEQ ID NO: 564379 - DNA, 660 bp, Homo sapiens
  misc_feature (215)..(216): n is a, c, g, or t
ctgtgtcgttcaggtatactgtactataaaagctagaactagcacttaatgtcagagtagcagcagatgctctacaagttcctgtatgctctccacttatcagtatacagctcatcgagcatgtcgtagcgttttctacctccctatgcgtatacaccctttctctgagtctcatacactcagccgataacatttatgtggcgcagttactcatnntggcagtttgcatcaattcaactgcttcaatgatcatatcaagattcagagtatcagtaatagctgcatctagatcgtactgcttttccatatattcacgtcccagtctagggatgtgcagtcagctcttccagcctccagtttcagaggccttcaatgtacgtcctgataagtacatctgcccgctcattgttagacgcacataggcaggctacactgcaacatccacacagaccccatagctctcattgcaggagacaaggacagctgccagaccgtccagatttccaatggcctcacagcagaagtctataccagcatctgtcatatcgaatatatcttcttgaatgggtatctttaagtcctgagggttgaggctctcagtagcacccaattcctgtgccttcttaactttctccttgttgacatccacttcaatgatac

SEQ ID NO: 564380 - DNA, 799 bp, Homo sapiens
  misc_feature (1)..(1): n is a, c, g, or t
ntgttatctgccaccgtcttgcttaacctttttgtgtgttaccaccttcaccttaacggagggctttttacgccctccgggttttcccttccaccacttcgctgtttcttagcgaaccggaccgcgtggtcccacccgccccttgggttcgtgtcgattggctctatattaagggtgagtacacgcccattgggatcggatgtcgctcccctgtttccaaagcgtctttaggtggccacttccatctcgtgtcgacaaagttttgacacacatcctcgttggtcttcgcgctcgatgttcggcaccgctccttaagtagcttaccacgctttatgtgcgcgacgatttgcccagtgtgcaacttctccttgccatatgactgtgaggtagttgacattacatctgggtggcaccctgttcaggcttgtaatttatgctgcactctagtgtctcttcatagaaacacttgatgctcacccgttctaacgcaacattcaagacggctctctcagcatgaaaattagaatgttctggcctcatctcgacttggtcagaatgtgtggcaattctgatctgccttttcagaagtaggactatatcaattgaaacgtaagtatgggcctcttcttctatcttggcaagacttgtactctgttcacctcggcctgtcttcatttatattgctattatctgcctggtcccctgaggcgtctgggtctctcctctcccttgcagctttggatttgaagctgaggaactacgaagttcgatgatttaactccatggttatgcctgcatt

SEQ ID NO: 564381 - DNA, 563 bp, Homo sapiens
gtcagcagtcacacatcctctccattctctgaattcccacaaagactgttattgctggggctcataaaattatactccaaagtatgacgctttggcatccagagtgctttgaactaaaggagactgaaggccccagaagccaagtttccctctgaccttctcctgccttcctgtcttccaccccctacttttcccctgaagtgagtcctggaaaccagaattcttcttgcccaaagcaagccgtgacaccctggaaatatcactctaaccttccttgcctttccgtgtggcagctggccatgaagaaattctctgacctaccttgtttgatagcagatcacaagaccctggttccagagcggtcctgctttacaccgagggaaaggaatgtcatacagaaaggccaagaagaatctgaagagatgtccaatcacctttgcacgtggctgcccattcttcattgaacctaagcattaaaatagacagtttcccctgggtctttgggtcttcatttctgaagactccatgtcatgtaaaactttgattaaatgaatgtatcatgc

SEQ ID NO: 564382 - DNA, 152 bp, Homo sapiens
atttaacttatgttcctatgagaggttggagatcttggccttcatctgatttcattaatgttttgagtttcaaatgtagttattggtttcagtgtgattctgtcctcttaccttattgggtttaataatttttaaaagattataaaataata

SEQ ID NO: 564383 - DNA, 260 bp, Homo sapiens
tgcttgtctgctctgtagctctcgtctctctgtctctctctgttggcagatgtaaaactattattctcacgataagctttcactggccaggagcagtggcttatgcctgtaatcccaacactttgggaggccgaggcaggcaaatgacttgaggtcaggagttccagactggtgaaacccatctctactataaatacaaaaaattatccaggcgtggtggtgtacacctgtaatcccagctactccctgaggcagaagca

SEQ ID NO: 564384 - DNA, 121 bp, Homo sapiens
gatccacctgcctcggcctcccaaagtgcctggcattacaggcatgagccaccgtgcccagcccaaaaatgtaaagatatcttctgtttgttgatgctgcagaaatcacaaagcagtctca

SEQ ID NO: 564385 - DNA, 1173 bp, Homo sapiens
gctctcgtagtatgaaggacccgggtatatgtaggccctgtggttcgtcattctgaatattctgccaaatcataggccgcgacgcagtgctcgtacatacgcaagaagctaggtacaggacggtccatggcgcgagcgtagcttgacaaagcgtatatacccgtcgcgttaatgccgtatgagagtgcgaccgatgtagtgtctcctacgagaatataggcgccttcctgagtggatgaactggtgattttgttcgacaggctatcctagagttgaattctagaatttcggtgatcgaggtggtcctagagaaacgacgagtcaatctccctcatacaatcgtagaccgagacgaatcggacggacgaatatccaagcgaagcacgagcgctatatatgggttacctttagttgggtcctgccgagccgtgagagcttctagcagaggtagtttagtgcagaacggggtaacgaactttgcattgtagcaacttgagatgtgggggacattagcgttagaagaagctttttttgttgcggaaggtttacggtgtcaggggcacattggttaaccaatatagtctttttctaatggggctactatgtattgcaaggcacacatgatcggttgttgtggggaggaattgaaaaatgtgttacctttagagtggttcaatccgttgagaggcatcgggtggggtttggttgacaatttaaaatatgcctatcttaaggtaaggtggttgtcagttgtctaattttagtttagaattctacaatcagtagttattttctaaagagtgtaaccaattatctaaagacaagaaagacagtaaagagggaacgttggccacacaagacggtgggttcatatacaacaagggatatatggtaacacagagggcccgttctttcactttgtgtaacctttgttttagggaacacactttcggaccacccaagaggacaacattgggcaatacttgggtcgtcttaagaggagagcctggggaaggaatttgaattttgtggacgtgagcattaaagggttaagaaaacactatttgggtaacactctcggttgagagcagtccatgggggtgcagacaaactctcagaggtaattgacaggtggaagttttgtcgtacacacacattcgacaggaatcaatt

SEQ ID NO: 564386 - DNA, 1823 bp, Homo sapiens
gggagagcgagcatcgtgagctggctggatcgccgagcgcgagtgagggagccgacgtcggcctgtcgaccggctgctctcgcgctctctcccgtccgctgcaatcacggatgcctcggggccgcggggcccggtgcgccgccaccagggccagtccctcggcggtcatggccggtgatggtgtagctgctgtcgctgatgcgacgcgcatgggggcagtgcgcaagaacacaaccggacgccgcccgcgtgagtgcatgtgcgagagcttgtgaccagcagcagggtcgccacggcagcgattgtgagctgatcgcagacgggcatagccttgattgtgttgctgagatcttacctttgcactttgaaatttgtgcggaagatcagcatagccgtatatcaggcacaggcattttggcgatattcgacaagttgcatatgccaaatacagatgtgcaccgcatcattgcgcagggcacggccgcggtttcagaggattttccccggatccgatcctccttctaagagtgcccaggggaaagtcaatccccttgagcgaaaaggtgagaacgacacgtagatagcatattctacacaagtatgatggcgtcaccgggttacagcaattcaaacagccaaaaggagaaacggagacgagaacttggcaaagcttaacaagagacaataccattcattgcacatttgaccacaggaaagcaaccaacaacaggaaggaggggcacaacaggcccatagtggtggcagtgggttcaccaaagggaacgacgcgatttaggtctttttcaccaatggcaccattggttacccgccgtaatgggcaaatatagacagcagaggaagtaccgcgaaaaatggcaccgcgtggttacgcaaaccgttgcaacaagtcagtttataggagaccatccccctggaaagtatcaattggagtaacagagggatacaacgagcgcaacgagacatcttattgcgcgagttggggtttgggcacgtttttagaaggacagaacacagataaaggttggcgttaaccacttatttatcgtttccagttacaggcaaagtttaaaaagaggagggaacacacttttcggagtatagagcaaagaagggcccgcagtggcatgcgcactataagtttagtaacatttatagaaggtttatcaaaaccacacgcgtagtgcagtgagcaattaaacggattacagagcgatgtgagatcaaacagccgtactggaggcgagacacgcgataggcgtctgtattggagtagagcgacataataaagtattatatagagaagcagaaaccacttggaggtacggaccaccagaattgagttataaatagagtatacaagactatggccgacatatctagataaggagatataagaaaggcatgaggatcttagagaaaatagtaccatttataatgggcaccgagaagtacagcacggaggcagaggaagagcgaatagagagagaataatacagatccgggggagcgaagctaagcacacaacccgcgcgccgaggggacgaagcctaaacaggagaacgaaagcaccgcgaccgcagacgacgacgacacacacatcgagacagcaagccacagacaaacacatggaacacaagacagcaagaccacatacagaccgctgacaagtccacgaccagagacagagacgagagcaccacgaagcaagcacgagagcaggagcaacgacagcaaggaaccgaggtagagcagacgagaagaagtacgggaagcaacgaagcagcaagccacacaaacaagac

SEQ ID NO: 564387 - DNA, 750 bp, Homo sapiens
  misc_feature (494)..(494): n is a, c, g, or t
  misc_feature (531)..(531): n is a, c, g, or t
  misc_feature (559)..(559): n is a, c, g, or t
  misc_feature (681)..(681): n is a, c, g, or t
gagcggtctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaagtgttaccaccgtgtgacaccaaaaggcggaccgagacagtgcagaagctgtgcccaggggggcagctcccattcctgctgtatggcactgaagtgcaacacagacaccaacaagatgtgcgagaattctgnaggcagtgctgtgccctcccaggtaccccaagctggncagctctgaaccctgagtccaacacagntgggctgggacatattgtggccaaattttctgcctacatcaaggaattcaaacccagcatcaagtgacaatctggagaagggactcttgaagagcctggaggtttagacaattattaagatnccccctccagagactggttaacactgtgtgagataggggctctcaaggattggtggaaggcaccctgtg

SEQ ID NO: 564388 - DNA, 1030 bp, Homo sapiens
  misc_feature (1028)..(1028): n is a, c, g, or t
aatgggctttaagtttgtcctcaatgtttttgaaaattagagaatagttttttaacaaaatatttaaacaacattatcagttatcattttggtacttaataactcttagacatcaaggcagatggagttattgccatggtgttaggacaagctgattgtgttaaagcatgtgacacacctaatttcagaaaccagaggggaaatcgccgctcattaaagttcaaggatttgaagattatcatgaagaaatattcccccaactccaccatctgaatcactgaatgatagttactattctagacttttgaaggactgtgtcttcaagaggcccttgttaaaataattcctatttgtagctttgaccaccctcgctgggtgagaatctgcacagtttagagggaaaaagtgtggcacattgggatgaaagcaatcctagaagatagaactctgggagttcttggtccggctccaacatgcaatggccaagcaaccttgacctcttggtaccgtggagatgaatgtacctcccaacctagcccacagactgttgttaatgtcctataaaataataggcaaagtggtatatctattagtttgacctttacatttatagctctattcttggaacccgagtcccagccttgatagccaacaatcaatcatcccaatgtcaatgcccccatggcattcattgttgtatctatgtaccttcctccctagttactccaactcaaaattggagtcatctttattttctgtttctgatgttcacttggtgtcttgtcttttagctacagtactaccaccctggtggttcatcattatacatttaagctaattacatgttgtttggccatttcttctctttctgatccacctcatgtacatgtctaaaatgttctccttatacttctctctctttccataccattctctgtctccctgttgcctatgggataaagttctaagttctcattctggttgttaaggcccatcacaaagaagtttgtccagttgctacaccctcntg

SEQ ID NO: 564389 - DNA, 696 bp, Homo sapiens
ggggaatatacggtcgactgtgtcagagtcctaggaaagcatgctggttattacacggacactcatgggtgtattgcgaaccggatgctggttatatacctcatgcaagccctcaggctgcgtgaacgcggtgacgcatgctaagaatacattgatactggtatgaaatcaggagtcgtgtacaccatgggcctatttgagcttctagagtatgtcggactgcatactgcgaagttcattgaggatggctggattgaaatggatgccgtgaacccattacataagcccagtcaatacttaaatgagctgatggctgataacacgttcggtatgaagactggatatggatttaacaaattcatgtgatgagcagctttctccggctctgagaagaacacctgagagcgcgtttcagccaatgctcctagtgcctgctggaatgctctgtgctcagacatttgctcacacagtacagcctaataaatgtgcactttgatcgtaatctatctgagtgattattacgccagttacagcagtgatagattcttcattcagaactactaccgtctctagtcagttgcattctgggtatttgctaaacagatatacaccattggttgcctagagcacccatgttgtacgaactcttgtcattgtgaccagtggcctacattcatcggtgatcaccgtggtctt

SEQ ID NO: 564390 - DNA, 365 bp, Homo sapiens
aagagggcatgaaggcatccaggcactcagacggcaaaggaaccaccctacccatatggcctctggagggggcagaagaaagacagcaacctcatcctatattggacaaagcatgtgaatgctggcattcgctctcataggagacccatgtgcttccttgctcagtgcaaaactgatgattctacttgctgtagatgaatggttaacacgaggctagttacacagtgccattgtttcgacagtgaagcctccaaacctaagccactgggacggaggacagagaatgccagcagactcagtcgcccttcgtcatatacccaaaatccagaccttatccacaacccggggcttggcccggaaggtat

SEQ ID NO: 564391 - DNA, 1285 bp, Homo sapiens
  misc_feature (214)..(214): n is a, c, g, or t
  misc_feature (481)..(481): n is a, c, g, or t
gctctaccgggcgggatttgatggcgtgatgtctcacagaaagttctccgactcccggagacatgggtcccgtcggcttatcctgcctcggaaagcgcagacagcagggaatgatgggaaaggtgaagagcttcccttgaggatgacccgtccaagccggtccacgctcacagccttccttgggagtacgataggctggctatgtactcactantcgtgcggggaacgtcgacgatggctcggggattctcagaggctgtaaactaagaagcgagagtgagctgtgatggcctgtagagcaatggtatgagatcaccatcgcatggtgggcttgttgaggcatttgatgcggactaccgtgggaaaattctcctgccgatggtccctgcccggagtaactctttgtcaaggaacttggttctgataagctgagagcgtcaccacttacagtgcgacttcgagatcgcgagagaagaggtcngtttcctaattaaacgacacttcagtgtcaattaaagatcctgataagagaaagggaaatggtcctttaagcctaaaggtaccgtggcatatgacagactggggcatggccagtgcaagtgcctcgggccacaggtataggaccaccgtgggatggaaagagacctgtcatgtcgaggccaattgaattaggaaacgctaccttggccaataggatacgaatgcccgtcggttcatttggcacgccatttaggcgccaagactgacctgcccgtggcctttaacctttacttgggcgagttccccaagcatagggaaacaggggacgcccatggcgttgtgactggtggggagagaagtccgccacgagggattgttaaaaccgggagggaagccgtgcccacaccttggctgtgggcacacgggtactgtacaaactgcactatggggacgctgggggggacccccgcgacggacaaaagaagcgccgtcgcgcaatgcaccatagggccacttgtggatacacccccgtgggatggacactcacccaaagcgcgtagggtttcccgggcgggaccactgggcattttgcgaggcaatttcggaaatccacgaacaccggcatgccattacagcggagggggtttgggaactccaaagtgggagaccaacatggggctttaaccaacaacgaaagggggatggttcacacacccaaccggacacgggatagttgtcgatcaccaccgccgcgagggcaaaaggcccttggctcgccacagcgcagaaagaagcccctagaccg

SEQ ID NO: 564392 - DNA, 974 bp, Homo sapiens
cgcgcttaattgaccccgcgggggggtttttccaaaaagacagtgttatttcctcgccgcgtcgtttttattaggggcgcttgatcaaaaagccttttgggggcaaaagtggttatattcccgtcagagcgttggttacccgggggagaagctcttactcgggcgagtagggccgctctcttcggtgtgtggtccgcccaccctcagcgcacaacagactgtgcgaatacctgtggggtggggagacacactaacgctccgccccgtttgtttatgatatggaacacactctcgtggccccacagatatatgtgggtggtgccagactcaacaacgaaagagagggggttgtaaaccacaggaagagcttctgcgttggagagcgccccacccctttcaaggagcgcacactctctggtggcgaatcacacacttgggagacgacacacccaggagggggtgtctctctctctctgagacatttctgcacacagcacgggattcacacacactcaactctcttctctctcacacacactgtttgtatcagacccagttggggcgtcgggcgcaattttgtcccctctccacagcggccaccaccttttgtctaagaggctcatttttctgtggtttgtacaacagagatttgtggtgataagcacaacaagaggaggtgtggtgacactctctggcgcgcccaacatgtgcgcttctcaacagagagattaaagaaaccctgggacccaccacgacccccaatccaatgatcaccatagatagaggaatgatagaggatgacccctcttcttttgtggggaggtcctcctgcccaccacatctcatttcccccccccccctgtattttcccctcttccaatttcccattgaccacccctttaaaaggggggggccttgggggccccccccttttatgtcccacccaaaaaaggtcaccggggttcacacccaca

SEQ ID NO: 564393 - DNA, 332 bp, Homo sapiens
agagcacatgaggagagcgctctgatacagagaggggctgaggactgtgggaccgagagctagcagacgcactttaatgcattatagctcttcctgctggaggaggaggtggtggtgtacttgatggtggaactgccgcctccaacagagctgaggccacccccaatggctctgccactgctggaactgaagccacctccaacgccaagaccactgccataggagtagctgcttcctccacccaggcctaagccactgccgacaccactggcaccgccatagccactggagacggtggactgcaccacagagatgttgcctttcggagaaga

SEQ ID NO: 564394 - DNA, 157 bp, Homo sapiens
aaaaaccccccttttatacccggatcatcagtggaaaattgtttttcaagattccaaccaaaaccagcaattaaacttttttttccaatggttttgtttgcgagtaggccttgggggtccttgggaaaaaaaaataaaaaattttccccttccttta

SEQ ID NO: 564395 - DNA, 132 bp, Homo sapiens
aatattgtcctgactggtttgacttttgcacccatgagattatttggtttgatagactgccaatatcctgaggttcaaatagaccgtccgtcacaagtgtcgaaaggggccagcattcttgagagttggatt

SEQ ID NO: 564396 - DNA, 808 bp, Homo sapiens
  misc_feature (70)..(70): n is a, c, g, or t
  misc_feature (79)..(79): n is a, c, g, or t
  misc_feature (108)..(108): n is a, c, g, or t
  misc_feature (110)..(110): n is a, c, g, or t
  misc_feature (119)..(119): n is a, c, g, or t
  misc_feature (163)..(163): n is a, c, g, or t
  misc_feature (219)..(219): n is a, c, g, or t
  misc_feature (254)..(254): n is a, c, g, or t
  misc_feature (258)..(258): n is a, c, g, or t
  misc_feature (260)..(260): n is a, c, g, or t
  misc_feature (269)..(272): n is a, c, g, or t
  misc_feature (278)..(278): n is a, c, g, or t
  misc_feature (280)..(280): n is a, c, g, or t
  misc_feature (297)..(297): n is a, c, g, or t
  misc_feature (327)..(327): n is a, c, g, or t
  misc_feature (344)..(344): n is a, c, g, or t
  misc_feature (375)..(375): n is a, c, g, or t
  misc_feature (378)..(378): n is a, c, g, or t
  misc_feature (382)..(382): n is a, c, g, or t
  misc_feature (413)..(414): n is a, c, g, or t
  misc_feature (416)..(417): n is a, c, g, or t
  misc_feature (423)..(423): n is a, c, g, or t
  misc_feature (454)..(454): n is a, c, g, or t
  misc_feature (534)..(534): n is a, c, g, or t
  misc_feature (536)..(536): n is a, c, g, or t
  misc_feature (542)..(542): n is a, c, g, or t
  misc_feature (549)..(549): n is a, c, g, or t
  misc_feature (552)..(552): n is a, c, g, or t
  misc_feature (555)..(555): n is a, c, g, or t
  misc_feature (557)..(558): n is a, c, g, or t
  misc_feature (562)..(562): n is a, c, g, or t
  misc_feature (594)..(594): n is a, c, g, or t
  misc_feature (605)..(605): n is a, c, g, or t
  misc_feature (608)..(608): n is a, c, g, or t
  misc_feature (628)..(628): n is a, c, g, or t
  misc_feature (637)..(637): n is a, c, g, or t
  misc_feature (653)..(653): n is a, c, g, or t
  misc_feature (668)..(668): n is a, c, g, or t
  misc_feature (678)..(678): n is a, c, g, or t
  misc_feature (680)..(680): n is a, c, g, or t
  misc_feature (686)..(686): n is a, c, g, or t
  misc_feature (734)..(734): n is a, c, g, or t
  misc_feature (746)..(746): n is a, c, g, or t
  misc_feature (794)..(794): n is a, c, g, or t
gagccttagccgacggcaaactggacactggaccggcagccgccactgagactcctcccccgcattgccngctgcttcncttacgtcgtgttccgctcgcgcactgcncntgtctccgnggcggccccacgtagcgctcgttagcagtggcacaagactcttncagagcgatgatacgaaaccagtagcaagtatctccataaatctgtagtgtatgangatgatggaacgccgaggtcacgaagtaagatgancccncngctttggtnnnngataangnggaagaagatgtgtctngtgaacctgaagcttcaccgagtgcagatncaactatactgtttgtnaaaggagcaacgcattttccagcatatcacnttntgcngttcctggtaggctttaccaacaagggtacnnannattttnttgttgaatccttagatgcctcattccgttntcctcaggtactaccagcttttatatccatgaagtttcacagtctcttgcctctgaaacactgtagtgccaccccaggananaggcancttgttnagnacncnntcantcctgcagagcccatgggcggacgaccatttngtttggtcatnaanctgaactacaaagatttgancggcaatgnattccaagatgcagtnttcaatcaaacagtnacagttattnanagagangatgggttagatggagaaacaatctttatgtatatgttccttgctggncttgggcttctngttattgttggccttcatcaactcctagaatctagaaagcgtaagatncccatacagaaagt

SEQ ID NO: 564397 - DNA, 452 bp, Homo sapiens
  misc_feature (367)..(367): n is a, c, g, or t
aaagagagaggagaggaagagatagaagagagagagaagagaaaagagagagaagcgaaagatcaatgagttaggctgaggggaggtaaggttgtgcaagtctcagtagaaaggtttttaacaaataacatgaggactaaaactttcaagacaacagatgtgtggggtttttaatagataaagctgcatttgcgttgtgtcaggctcttattaataattaagagaatgaactaaacatataatttagttgctacaactctttactggaaagttgcctaattttgcttttaaaacccatgaaattaattaaattttaacatttaagccagtcatcaatgttacaatgtttcgcccagcatgtcagtanaataatatgtttagaattctagaaccacttctaaaacacttgttgtagaactgtctatatactctgaagtttttttcaaagctga

SEQ ID NO: 564398 - DNA, 1074 bp, Homo sapiens
ggggcctcaccacccctcgtttgcacgcacgcacgttcattctccgtcctcgcgccccttttcctacactttcctcttctccccgcaccggaggagccgctctttccgcgctggtgcactctggggcccgaggtcgagccctgccgctgccgccgctcgcctgcacggacacgcgacgacgacggccgcgaccggacgcacgaacacaagcggagtcgccaccggagagaacgtcgactccctagcagcagccgccgccagagaggcccgcccaccagttcgcccgtccccctgacccgttcacaaatgcagcctgcattctgcaaagtggatacgatcgaagggactatgtcttcattgaacttaacgcgctcgcaagacagctaacggatgttaatgtaaactccgacaaaactccaagaccaaacatacacacgcactcgccagcgcacacgctgaccacactcacacaccactccaccactcgacacccgaccctccccccaccagcactcgacccccaaatgaccccccacgccccactccacccacaccggacaagactcacaccccactgaaagccaaaccccaccaacgccccacaacacgcgacaaccacactggcccacacggcccaacacacaccgcacccgcggcccacacagcacactcggcctcccccccgcccaacaaccaaccacccccgccaccccgacctggcccaccaccgacccccactcccacacactgcgctcactccccggcaaccaaaccacccgcaaccctccacacccacaccaagaccgaccgtgcagcacacaacagaacgcacacaacgagacaaccaaacacaccacaacccacccaccagcaggtgaagagagacccacaaggcaccaaccagagcgacgacgcaacgcccacacgcccagacgcgacgacccgcgcgcacacgcgcccacacacacaccgcgccgcctacacgagacccagagaccccagctccgctgacagacaacacacaacaccacacacaaccaagccaggcacgcgaccaaccacagacacggcgaa

SEQ ID NO: 564399 - DNA, 321 bp, Homo sapiens
  misc_feature (40)..(40): n is a, c, g, or t
  misc_feature (167)..(167): n is a, c, g, or t
  misc_feature (205)..(205): n is a, c, g, or t
ctttgctgggttgctgaaaaagaatcccaattggaaactncaaaacctgtggggtccaactgttgcctcctgccatcctctctggctggcaaagcactggtgctcccaggaccctcctcaagttggggttctaatccccctcccatcacagccggcctcgttgcctntctgcatgcaggcttgctcctgtctcaccctgtggccnacagcctctgggctttcccacactgcacttctctcttcccatgtcttcctccccagggacttcctatcctggccggccccctcagcttcctgcactctccacaagcccttcccacc

SEQ ID NO: 564400 - DNA, 481 bp, Homo sapiens
  misc_feature (31)..(31): n is a, c, g, or t
  misc_feature (33)..(33): n is a, c, g, or t
  misc_feature (99)..(99): n is a, c, g, or t
  misc_feature (347)..(348): n is a, c, g, or t
aaagtgaaggaatatataatgaaatatcagntncttttaatctatcataagtatgtgagcataacttagtattttgaaatagataaatgaatactgccnacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatgctggcccttattaatgtgaaattcttgtggatctgcgaaaaaagaggaagacttttctttcggttttaaaaaaaaaaaaanncaagcttatgcatgccggccgaaattcgagctcacttgggcaaattgccccaaaagggagggggataacaaatcaactgcccggcggtttaacaacggcggggattgggaaaaaccccgggggtacccaactt

SEQ ID NO: 564401 - DNA, 212 bp, Homo sapiens
gtctagaggatcccggcaccaccccgctacgtggataatattatggagaagtagtctagttgaagcttagggagagctgggttgtttgggagtggctcagtgtcagttcgagactaatacgtgcttgggctaggcacctaactctagttgggagtcatagacttagcataaagcgtgcgtaacgtggtgatgcggaatcccgaggcacgacg

SEQ ID NO: 564402 - DNA, 777 bp, Homo sapiens
cacgcgtcgggactgtgctgtgatcacatgcctttggaccacatttgtgttctgttcttagagatcgagctcctcagatggatacctgaagcctttgctatccggaaacgcgcggtgagggttcgctagggtagggcttagctagtgctacgggcttacgtagggtagcgggtagtgaggtaggagctagatagggtagcggttagccggtcgcggtgtagtgagcggtaaagggttcggataacgtagggagctagtaaggtaggcgtgaggtaaggaacggagtacgtgatggtaggggtcggagtcgtaagggtagagatgcttaagtgtgtcgtccagttcgggtgtagctaggatgcagtgttacgctatgaggtacgtgcgattagcgctacagcaaagagcgatgccacacaacgggcaggggatttccaagcgttgtgccacacaatatcgggggaacctcggtagaattgactccgatcgtactcccctagaatacgcgcggatcgaaagagagaaaacgaaacgcagtgactcgtgtgcaagatacgtgttccaaaggtaagagcctaaactgcacagcgacatgatgggttcacgggttggccgaaataaggctcccacgaggaggcccttaggcgaaaacccgtagctatagtcatcgggtagtggagattaacgaaggcgatcgagaagcctggcgcatccgttatttaccgccacatagcggggtttagagcaaaaattccgtccgtccgggctatacgtggt

SEQ ID NO: 564403 - DNA, 114 bp, Homo sapiens
gaagaacgcagggaaaggaaattaaattattgcaagccaaggaggatttcaaaaaaatgatggaggaggcaaattttattccaggagcaccttttaggtattttgcagccaggc

SEQ ID NO: 564404 - DNA, 309 bp, Homo sapiens
aaaggtggttgtaattgcggaagaggctatgggcttctagcagataccagtaacatatttcttgatctgagctagtgatacatgagtgtacacagtataataatttattctaggtgtatatttatattttaggcatttatttataatacgtaatcttattattttcacaatataaagcttaaattctttcagaaaatactactacattgacttgtatggtccattaaccttacggcagatacgaggttgaagcatttgggtaggggtataactgagcaggatttttattgtgtaagtatactgaattag

SEQ ID NO: 564405 - DNA, 319 bp, Homo sapiens
ccctggtgcctgcatccctgccgtctctagttccagccatggctgacacgctgcaccggtacatgcttgcctcacgcttcagcgagtgtaagcttcacgacttgttggcttccccctagtgttaatgccagccggtgcaccgcgcaaccactctcacaggcttgttgcagcctttgtctcagactcccagcagtctctcagcgcaccaacttgcggtttctccaggtcacaagcttttcccaagcaggctggagcctcgctgggcgtgcctttccttggggcatgtgctgagacaggatacatgtcaaggattggggtc

SEQ ID NO: 564406 - DNA, 806 bp, Homo sapiens
  misc_feature (59)..(59): n is a, c, g, or t
  misc_feature (61)..(61): n is a, c, g, or t
  misc_feature (71)..(71): n is a, c, g, or t
  misc_feature (87)..(87): n is a, c, g, or t
  misc_feature (90)..(90): n is a, c, g, or t
  misc_feature (94)..(94): n is a, c, g, or t
  misc_feature (96)..(96): n is a, c, g, or t
  misc_feature (102)..(102): n is a, c, g, or t
  misc_feature (105)..(105): n is a, c, g, or t
  misc_feature (107)..(107): n is a, c, g, or t
  misc_feature (120)..(120): n is a, c, g, or t
  misc_feature (158)..(159): n is a, c, g, or t
  misc_feature (166)..(166): n is a, c, g, or t
  misc_feature (178)..(178): n is a, c, g, or t
  misc_feature (191)..(192): n is a, c, g, or t
  misc_feature (194)..(194): n is a, c, g, or t
  misc_feature (198)..(198): n is a, c, g, or t
  misc_feature (203)..(203): n is a, c, g, or t
  misc_feature (206)..(206): n is a, c, g, or t
  misc_feature (222)..(222): n is a, c, g, or t
  misc_feature (250)..(250): n is a, c, g, or t
  misc_feature (259)..(259): n is a, c, g, or t
  misc_feature (271)..(271): n is a, c, g, or t
  misc_feature (286)..(286): n is a, c, g, or t
  misc_feature (297)..(297): n is a, c, g, or t
  misc_feature (303)..(304): n is a, c, g, or t
  misc_feature (320)..(320): n is a, c, g, or t
  misc_feature (322)..(322): n is a, c, g, or t
  misc_feature (332)..(332): n is a, c, g, or t
  misc_feature (343)..(343): n is a, c, g, or t
  misc_feature (352)..(352): n is a, c, g, or t
  misc_feature (412)..(412): n is a, c, g, or t
  misc_feature (438)..(438): n is a, c, g, or t
  misc_feature (451)..(451): n is a, c, g, or t
  misc_feature (463)..(463): n is a, c, g, or t
  misc_feature (465)..(465): n is a, c, g, or t
  misc_feature (491)..(491): n is a, c, g, or t
  misc_feature (568)..(568): n is a, c, g, or t
  misc_feature (620)..(621): n is a, c, g, or t
  misc_feature (623)..(623): n is a, c, g, or t
  misc_feature (628)..(628): n is a, c, g, or t
  misc_feature (630)..(631): n is a, c, g, or t
  misc_feature (657)..(657): n is a, c, g, or t
  misc_feature (661)..(661): n is a, c, g, or t
  misc_feature (675)..(675): n is a, c, g, or t
  misc_feature (726)..(726): n is a, c, g, or t
  misc_feature (728)..(728): n is a, c, g, or t
  misc_feature (759)..(759): n is a, c, g, or t
ggggcccggaaggaaactgcgaggcgaaggtgaccggggaccgagcattttagatttgntnggtagacctngtgcaccaccaccatnttngctntnaggctngtntntttttggacactncctttttgggttttttacccagcttttaccaaggcctnnccttttnttaagaattttnttacgaagaattnntngttntttanacnttgtagggaattttcnaccaaaacaagaatttggttttggcgtnggagaactngccaagaacttnaagaggcagcatttnaaccattgatngaaaanntttttttttttttttngnttggaagatngtttttttttngaggggctnttttttgtttttgagcatttttttttttttgttttggactttttttttagatttgagctntttaaaaggctttttttttgctttanttttttaaggatngaattttttttncnttttttttttttgcagggagtttttnttttcagctttttttttttttgcaattagcagaacgccttttttttttaacttttttttttgaggctcttgggtganaattggtgtgacctttgcagccatggttggagctggaatgctggtacgatcnntnccatntnnccagagcccaggcccaaagcatcttncttngttgctacattctngtgtgatgggtgcagtggtggctcctctgacaatattagggggtcctcttntnatcagagctgcatggtacacagctggcattntgggaggcctctccactgtggccatgtgtgcgcccagtgaaaagttt

SEQ ID NO: 564407 - DNA, 1055 bp, Homo sapiens
  misc_feature (1055)..(1055): n is a, c, g, or t
tgggggctgctcctggcgagcgactgagtcgtccgtgagggaaaaatgaggcgaggcttttcccagagatcgtctcaagctgatggcagcttcggtcgcggttaaggggagtagtccacggttttggcagaaaccctggtgtgcaggttcgcaagcccctgttcaaccatgctcctgagccctgaagagcagaaaaccttgacatgtgggacccttgctgcgacaaagtgaaggcttgtctgccccccaagaaaattcaccaaaccgggaaacccccctggaaaccttgggagctatataatcttggtagccagtgaaaacgagcgggggcttggcggggaccggctgtttcccctccccggtgagttcctgggcacagtgtttgcggagttatcaaggtgactcagccatcattgtagaaaaggccactttgttggagcattcagaaattgcgcaacggtttgtggtatcaggacctccacttcggtgaatgttggcctaatttaccaaaaggcacccttttattaggtacccagaacaattgtggtggcgctttgctgacgaagtatacgggaccgaggttgcgtggcaccagaaggaattgcttaagagaggcggggacatcaacctttccagtgggttctaaaccaaaccaaggcgcccgtggggcaggccatgccttccaagaacctcggattgaaacagcgaacttaacaaatggtgcccattgaccagacagggttgggtggtagggatacataacggggaaacccttcaggaggaagtcctatgaacttacactgcgacggcatttaaacttgggtcttatcgaccactgtgtacaccttactaagctcctttgtcaagagccagcataacaatggcccatccacaaaagaggaacgcatctttggaaaaagaaccggaccatggctttggcaacggcttttaccagcgcgacattagttcgttgcagcttgggcaccaataccctccgggagggtggacggggcacagccatcactccccatatcttggtgtatcaaagacacaan

SEQ ID NO: 564408 - DNA, 197 bp, Homo sapiens
taaggatccccgtggtccagtacggatgtgggggtgggctggggcagactggctggatttgaggcagtgacctaaccccggaagtggcagaaaccccaaccccccaatgctgacctttcagtgcatgcagctgtgccaatgacaggaggctacagggaactgaggctctccatgccgggcccatacggatgtgcggg

SEQ ID NO: 564409 - DNA, 317 bp, Homo sapiens
  misc_feature (245)..(245): n is a, c, g, or t
  misc_feature (265)..(265): n is a, c, g, or t
  misc_feature (307)..(307): n is a, c, g, or t
  misc_feature (314)..(314): n is a, c, g, or t
gcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgttacaggggctcttgggggttcggcttcagctcaacatgggnttgacatgggtggggcacantgggcgcccagttaaggaggaggaggaggaggaggccaaagntgttccnttt

SEQ ID NO: 564410 - DNA, 477 bp, Homo sapiens
  misc_feature (160)..(160): n is a, c, g, or t
  misc_feature (251)..(251): n is a, c, g, or t
  misc_feature (265)..(265): n is a, c, g, or t
aggcgatctagaggatcccggagctggttttctctaaacctactttaagaggttcatggcaggcgcagtggtcatgcctgtaatcctagcattttgggaggcgagaagggtggatcacctgaggtcaggagcacagacacgctgggcaacatagcgaaanccagtctctactaaaaataccaaaattagctgggcgtggtggtacgagaagggtggatcacctgaggtcgggagttcaagaacagcttgancaagatggagaaancccgtccctaggaaaaattcaaaattagccgggcgtggtggcacatgcctgtaatcccagctactagggaggctgaggcaggagaatcgcttgaacctgggaggcgtaagttgcggtgagctgagatcatgccattgcactccagctgggcaacaagagcaaaactccatctcaaaaacaaacaaaaaactcttatctaatggtcatgccac

SEQ ID NO: 564411 - DNA, 978 bp, Homo sapiens
gcggagcttgcagtgagccgagatcgcgccactgcactccagcctgggcgacagagcgagactccgtctcagaagaaaaaaaaaaaaagagttccctttccttaagttaagtctagttcaagacaggagatttaacctattaaattggcacataaacatactggtaattaccatatttagaagtttgacagcagctcgtattggggagcacaaaggaaggggccagtacctttgaaacttagacaaacggatttactgatcttacagataggtgatcaaactaacctaatggggtcctgaacgaaactgcttgacttgagacacaggtgagacggtcacaggcaattacacacgtggttaatctcctggaacttgtagccacacaagccattaacattgactgataacgagaaacagttgcttcactacagcaggctgggatggggctcaagcatatggcgatgagctgaaactttaccacaaattaaaggggagcatcactggtgaatgggtgggtacaccaccacacctacacaaccaccccacaccacaacactacaacatcaccacagcacccgaacgaccaacatcccacccatccacaacactctccacacacacccacacccactctctctcgtcccaacctcacgccctcaccaaggaaacctgtgaggtacgtaacagtggaactgagcgctgccgtgggggaggtgcgcgaaacactagcagatgctgactattgtacagtcgctaaagcctaactactcatatcaccaacactaatagtagctcatcatactactacacttcacccacctatacatcccaatcacccacacattataccatcccatctgctcgcatgctccaaataactgaacaaacaaaaaattcattctcatattataccaaacggactacataaaatctctttattccaccagaatccgtccctctcccataatataccactat

SEQ ID NO: 564412 - DNA, 582 bp, Homo sapiens
gaagccacatggcatcccggcctcgcccaggcattcgcctcggtctgaaggaagggaacaggaggtcattgagttcagggctcagacgcagccgctcagcacaggaggggtggacgggaaatgagagcttctctggtagcagggatccctgccattctgcagcccggcgaagtagcggtgcggctggagctcctgttcccagcgtcttgccagaggtggccacttcagccaagcccggagaagtgtgggcagaagcagtgaaggttctttctgtgggtgccctgcccacgccctccttgcctggtcctcccggcctggatccatggctgactctgcctggaggccatttgtgcctgcatatgtgctgccgacaggatgggcaggccgcaagtggggttaggtggggtggtacggtcagcacggtgcagcggtgcagtggcaaggggggctacttgtgtggcataagctagaggagccgtgccgccttgaatgccgagctaaatctgtgccactctcctccccagactatgaattcctggagatttttgtacatgcactgattacacgtgggactgatatttt

SEQ ID NO: 564413 - DNA, 758 bp, Homo sapiens
tatgggtccagagcgtatacaagttatgcagaaggtactgtgatcttgctgccagctcgtactccatcagacgatccacgccatagagcaaaaggatatggcattgaggccagcagactgtcgggtgcatcgaaaaggagatcaatggatgagtttggcgagtatggcatcgtggtcgacgccgtcgaccttctctccctggattgctgataatatattgcttcgatgggtgttacatatccactgaatcgctttgtagatccgttcaaatctcttgcctgttacatgcagatgacatttgaagccagctgacatgttactgaatgcaagtcattcattgctgggatcccactgataagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagttgggcctctgagctgggcagcttcacctggaaagtgacagagttgctcatccttgcccctccctgtctctggatttttatcacggtttaccaaagtcttctgagtccccctgagatgggtggggcctcacctgtgctgaggagcctctgtggataacct

SEQ ID NO: 564414 - DNA, 537 bp, Homo sapiens
ctgacgagttccctgggaggtacataagagggatcatgttaaggcggtgagtaccctgcccgagtccctaggtaagccaagacagaagtctcactgtccgccattgccatgtgtaccgtagaatcacttgcaggcgctccctacactagaaactcctcgcctaccagcagcccgacttgcgagcttaggtctccatccagcgtagagtgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacgtggtgagtgctaacatggaccagggagccacggacttccagatagaggccgccatcagcaaaatctttggctcggaggcagcctggaaggtgacagatgaa

SEQ ID NO: 564415 - DNA, 423 bp, Homo sapiens
atagagttaggtcctagccttatctattagctcttagtaagattacacatgcaagcatccccgattccagtgtagtttcacccatctaagatcaccactgatcaaacagggacaatgcatctaagcacgcagcatgtgcagccccaaaagcgcttagtcctagccacaccccacacggtgacacagacagtgattaagcctttagctaataaacgcaaagtttaactacagctatactaaaccccagggtttggtcaagtttcatgccagccaccgcggtcacacgattaacccaagtcaatagaagccggcgtaaagagtttttagatcaccccctccccaataaagctaaaactcacctgagttgtaaaaactccagttgacacaaaatagactacgaaagtggctttaacatatctgaac

SEQ ID NO: 564416 - DNA, 374 bp, Homo sapiens
gctcctaacctgtgatgagtaaagaatgtcactttctaacaggtccaggagccccaagttatcttgggacctcaagaagagaggaatttacccaactcataggtattggagggtacaaacccattgctgggcttgactttaaaaagtcttttctgatattccttatggaacagaattccatcagagccaattttaaaagcatatgtgaaaaataattattcttgctgtactttatgcaaataatcaggccaagtataagactaaagtttattttgcaaacaatcctattatgatttgtttttaacaaaaatgaagactggagagtttcaaaacttatcacacttgtcattaaattctagttttattagttgtta

SEQ ID NO: 564417 - DNA, 106 bp, Homo sapiens
ggatttgctggtgcagtacaactaggcttaatagggacatgcttataggacgtagttggagcccggagacgtcctactgtactctcactttcagcttttaaacaaa

SEQ ID NO: 564418 - DNA, 853 bp, Homo sapiens
tccccaacttctcctccgacccctaacaaccccctcctaatactaactacctgatcctacccctcacaatcatggcaagccaacgccattatccagtgaacatatcagaaaaaaatctacctctctatactaatctccctacaaatctccttaattataacattcacagccacagaactaatcatatttatatcttcttcgaaaccacattatccccacctgtggtatcatcacccgatgaggcaaccagccagaagcctgaagcaggcacatacttcctattctacaccctagtaggctcccttcccctaatcatcgcactgatttaacatcacaaaccctaggtcataaacattctatactcatctcagtgcccaagaacttatcaaatcctgagccaacaacttaatatgactagcttacacaatagctttctaatagtaaagatacctctttaggactccattatgatccctaaagccatgtcgaagccccatcgtgggtcaatagtattgcgcagtactcttaaaactaggggtaaggtataatagcctcacactcattctcaacccctgaaaaaaataggctacccttcctgtataatcctatgaggcatattataaaagtcatcctggctaggacaaagacctaaattgcactgtatcctcatcagcaattgcctcgagtacagcattcatcaaacctggaagtcacgggaggattcatatggcaaggtagccctagtaatgcacgacccaaacgaggcagggacaactctaggtaatccccaagtggtcagacgacgtaccataaggagctggcagcggatcccggaaagagcttaaggacacac

SEQ ID NO: 564419 - DNA, 741 bp, Homo sapiens
  misc_feature (62)..(62): n is a, c, g, or t
  misc_feature (728)..(728): n is a, c, g, or t
tatagaggaccccgcattgtgttttgcagctgagaccctagggccagtcaaagctgggctcnaacctcactgctcactgttagccatgtgatcccgaacaaatgattgagcctgtctaagcctcagttttcatatccttaaaataaggctagtaacaatgagtgccttgaggaactaatgcccataaaatgctttgtctagggaatactatattcaatgaatggcagatattatcaataaccattctctatttttattgtggtaaaatgtatgacaaaattcaccattttaatcattttcaagtgtacagttcagtggaattaagtccattcacattgtggtacaaccatgaccaccacccatctccagaatgtattcacctttccaaactgatcctttgtgcccattaaacactaactctccattcccctctccctccagtcctgggtattcactattccactctctgcctctatgaatttggctactctgggtacatcttataagtggaatcatacactatttgtcctgttgtgtctggcttttttcacttagcatgatgtcctcaatgatgttgtagcagtatcagaatttcattccttttaaggctgaaaatattccattgtatgcctgtatatcactttgtgtttatccaattcctccatcaacaacatttgggttgttctaccttttggctattgtggctaatgcagctgcaaaaacaatgncggggatcctcta

SEQ ID NO: 564420 - DNA, 460 bp, Homo sapiens
  misc_feature (441)..(441): n is a, c, g, or t
  misc_feature (450)..(450): n is a, c, g, or t
ctcatgggtatgtgatggagaggttaaggtactgcagcattaaaaagacatgaatcattcataaatttactcaaataatcttattctttgcactttaattcctcaagagatgttaaataacccattggctactttttcttttggtgttcataaatggcaaatcgccagttggcttctaacctaaaatttcagaaaaggagccctttaatctttgctaattacagaaccagttgactccaatcttcctgtcacatgggaataacttggagtataagtttttaaaaaagaaaaaaagatgtggttggagggcttatgcttcctctgatctttgacttgtttcctatacattttttgaatatacttttattctttactcttctttcttcctgttttggaagaattattggagtaattttcaatgtatgcatctaccactctggnagatgcagncacacaggca

SEQ ID NO: 564421 - DNA, 931 bp, Homo sapiens
ggactcactgtccagtaacatcccatcctgaagactagtttatcatgagtgaaagtggggagtcagtgtgaggtcctagcatcactgtaaatcttcactctcaagggtgcaaaagccagatagagactcttgaagacggtgaacattttgaaaatagtctgtcatggctgggtggtcaatggatgattgtcagatggaccattttcttcgaggctggacatggttgaagggttcatcacattggttagatatttgcttttgatgatggatatacctgcataatgtactggtaataggaattggaatatatcttagtactttacgtcttccctaatgtgcttcattgggtagggtacatagtgtaaatcggagcaaagctattagtgtacgttgtcggttggcgtgacaaactcgtccatagaagtctgaatggtggtggcaccgtcaagattcaaatctgtcttcctaatgaatattaagagggatacacctatgggtatagccctgactggttctattatttacgcagaagaggttcaatgaggagaaatcgcgctttttgaaccaatcctagttcaagtggaaagtctgttgaccaatgtggttgtccattctcgtcgggggatacctatgtaatattctttgtgggacatggccagttaccaaagcctttccatattttacctcataagagtcttgcatgttgctgggagaatacttgtgaaggggagtctaccaaaactgtggtcattatagcaacaacggaagggcggattcagttacctttggaaggggtaagcaagcaggttggtcattttacttggtatattcaagccaacgtcagggggttaagaccagtcccgggtaagcctctacactgctggtctgcgagtccccctcctggttacgaaacgggacattactttaatcg

SEQ ID NO: 564422 - DNA, 143 bp, Homo sapiens
cctacgggcggtgcgtcgtggcgcctcgtgagccatgcgtccctctgctcgcccccgcttccgttcggctcgctacctctgtgtcgcttgcgcgtgccggccgcactggtcgcgtgtcctgtctcttctcctctgcctctggg

SEQ ID NO: 564423 - DNA, 823 bp, Homo sapiens
  misc_feature (176)..(176): n is a, c, g, or t
  misc_feature (227)..(227): n is a, c, g, or t
  misc_feature (251)..(251): n is a, c, g, or t
  misc_feature (268)..(268): n is a, c, g, or t
  misc_feature (277)..(278): n is a, c, g, or t
  misc_feature (293)..(293): n is a, c, g, or t
  misc_feature (312)..(312): n is a, c, g, or t
  misc_feature (330)..(330): n is a, c, g, or t
  misc_feature (342)..(342): n is a, c, g, or t
  misc_feature (345)..(345): n is a, c, g, or t
  misc_feature (352)..(354): n is a, c, g, or t
  misc_feature (358)..(358): n is a, c, g, or t
  misc_feature (376)..(376): n is a, c, g, or t
  misc_feature (392)..(392): n is a, c, g, or t
  misc_feature (401)..(401): n is a, c, g, or t
aggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcnaaacttatatgtgtaactgaacgcgcatgtaaggtatggtttatttatttnttttttttttggaggaaatttaantgctaaagaaacaacgnaattgaaannggttcaggaaaaaanagatcaggaagttgtatcnaggtacaaatcttttttnaaataagtattntgntggaggnnngaangaattgctggcaattaanaagaatagagctaatnatgggcttncatcattcatccatgttatttatggagcacctacttatatgggtgctcaacacttgtactgcaagctaccttaattccccaagagtggtgccttactctgtttcctgatatggtctcccaatcagtgtgtgtaaccatacctgttgttttatcagccatgtgtagggtggctgtgtcttgtgcatcatccataaagaagttaagctttgtggctctggataaaatgtgtgttcctgtaacaagacgggtcacgtagggatggaaacacgacaaaccataatttttcacacaattggtcaacttctagacaaagcgctcggttctggtacaccaattttatggattcccttgtccatttgcgggaatgcctgaaaaaatctcaaaaggtatatccggttgggacattggactctaatcggcac

SEQ ID NO: 564424 - DNA, 112 bp, Homo sapiens
ctctacaggatccctgcgctatatcagtacgagagcttggacgcagcccaggccgactgtgctacaatgaggggttttcccttgggtggaccagaccggaaatatccacggg

SEQ ID NO: 564425 - DNA, 138 bp, Homo sapiens
agcggatccgtgatgtattgccaacacattaacaacatataacctcattcacacgagaaaacaccctcatgttcatacacctataccccattctcctctatacctcaagcccgacatcatttaccgggtttttctctt

SEQ ID NO: 564426 - DNA, 521 bp, Homo sapiens
cttagtctccccagtaactgggattacaggggtgcatcaccgtgcctggctaatttttgtattcttagtagagacaggtttcaccatgttggtcaggttggtcttgaactcctgacctcaggtgatctgcctgcctcatcatgcctggcctctccctcatttttgaaaggaagtttttttggggaaatagtttctctcaacattctgactctatttattcttcagttttctggcttcccttaactggttttgtgagacttggcctaattttcatccttctttaatcgggcttttctcttggtctgcttttaagaggctctctttgtatatgtctttctgctgtatgtttttatgaggatttctttttcttttcccagttggaattcattggacttttgaatttgaaggttatttttcaactatttctcttcatatctaatctcctgcttaaccgtactgtggaatttagggacaataaattggattgggtattggattatttcttggtttatgacacttat

SEQ ID NO: 564427 - DNA, 252 bp, Homo sapiens
cgcatgtccgcccatgatgcgaccgtgcacgcgcaccaagcttcgggtggacccggtctacttcatcgctcctaagccactggcatgtctggtgaccctggccagcccacctccccgccgagttcacccctgcggtgcacgcctgcactggaccaagattcctggcttctgtgaccgcaccgtgactgacctacaaataccgttaagcatggagcctcggtggacaatgcttctcgccccttggattacccc

SEQ ID NO: 564428 - DNA, 844 bp, Homo sapiens
ggacagatgaggcgagaggaggaggaggaggaggagaaggctctgggctcctctccaaaaaaaaaaaaaaaaaaaaaaaaaaaaaaagtgggcggcgcgcgccctcgcggccccgcgcgaaaaagcttttatatagaacacacattcgcggtgtggggcgcgcgcgcgggcccacaggagaggaaagaggaaacacgagtgggccaatagcggtgttcccatgaggagagaaccgcgggggcacgagaacacataaggcgcgcgcggggatttctccacacacacaatatataacaacacgcgcgcgcggcgggggggacaacaacgcgcagaggcgtgtgttctcgtgacacacacatatctccacagatatggggaaagatctctgcgaggagagggctcctcccatatatgagcggggggagaatctcttatatatacgacacgcgaggggagagtctctacacaagagaagaagagaagcacctctgcaataatatattttccaaaactatatatacgacgacacgcgccgaattgtgtggttggtgtttagcacccaccaggactcgagccagcagcagacgccagacaccccaggcgcccacgcacacaccaccctcggtcctcgaacccacaccacaccatccacagagcacaccaccgcaacaaagagggcaatcacccacacagacggaccccaccgaccgcacaagcacaacccccagcacaacgcacacaagaggaccaagaccactgcacacaaacaacagcatcaaaacacacacgctggccgcgaacacaatcagaacgtagagcacctaaaacaacgccaacaaaatgg

SEQ ID NO: 564429 - DNA, 1184 bp, Homo sapiens
  misc_feature (1)..(1): n is a, c, g, or t
  misc_feature (5)..(5): n is a, c, g, or t
  misc_feature (503)..(503): n is a, c, g, or t
nagtnaagtacgacagttacgcgtcagtagatgacgcatggatttggtccttcttgtttccgtgcagtatatgaggtcgaactcttttcgtcggcatgacaggagctgcttctccactgcgatgttcctcgtattgtggtttctctttctctccggcccgacctgttttttttctccgttggcccctctgttggtcgccccgtgtctcgtgttcttagcgctgacgcctgctgattcgccctctgcctcgcatgttttcccccgccctgtgtgcccgttgaaacctaggccccctcgtggtctctggccctcgagtttgggacatccctggtgaccacgggctgtttgtcccacacctccgccatttttttgtccaaccgacactcccagagtcccgggtgacctggccttcgatggcacctttcgccaatgggacctccatgccggttaagagccgttcaccgtattgcccggcccccatgccttaatcatcctggcacacnctggaggggccgcctggatggagaggatcatggccccccagctttacgtcctgttatgagaaaggccggtaccccttccccgtgagcatttccgtggcccaaatccgtgtctatgggaccctttgagactgggcccctgcccaacggggtattctcgccttcaggactctgccttcaggaacccgggtctgtagagggttcttctggagacccctgaaagaccggtccatcttcctttagactccaacccttggccaaatcacccttccctcttaaccacgggagaatcaccttcctcttaggaccttaaagctaggcgtcctttccccccaaaaatgtcctcgccctcattctgagaatactgtctttcccaaatggcttaagatgtggccccccccaccctctcttgccctcccgggcaccattgattggtccctgtcttgggccaggttttgatgagactgttgaaattgaatccaatgtgaactccagggaactggggaaggctgagcctcctctttggtgttgccggtaagataaccgaccgggctggtgaaagtcccccagatgcgccaggatatttggtttccagagtaaggactaggtgccacccacccatgactgactatccatccaaatgtttgtaacttaaaattttttatgaaggataatgaatattta

SEQ ID NO: 564430 - DNA, 1694 bp, Homo sapiens
  misc_feature (190)..(190): n is a, c, g, or t
ccacgcgtccggcaagactccatctcaaaaaaaaaaaaaaaaaaaatttccacaacattaggtttaaaagtagagggctaaagttaacaccccttcttaagccatttgtgtttctcagttactttcctaggagtgtggttgtgcatttgtgggaaatgtggaattgtgttaaaacctgtgagtgccttanggagccgttattgcgtgacctatttcaccgtggcggtgggttggggttggaagaggaaggaggaggttatgccagggaagaaagggttctctggtgccccctgtgagtttagaattttagtccagaatgtggttctaacccattgtgttcctattgttattgccatttttaaattgtggtgttataaatattggggtgttatttacaagcggattaacacaaggttctttaatgtggcctcacaagtttattgtttacaaaatatacgaatgtgttagtgtggaatctcaggtctcccctttttggtgaaatgtggttcccatattgggggtaaagatttttataggcgaaaaggccgctgtgtctcttctccgtgggaaggttggacccctttatattatagtctccccaccttttcttgtgggaagcctataagaaaccgtctcgctatatatactttataggctccaacgtggggggggaatgtgggcgtgcacacacgcacggggacgaacacgcacggacacgcgggccgacaagggggacacgggggcccctctatctgggcgcatagatatatttcttccccattgtttccttacgaaacaagacaagtggcggtctctcaagcgacgtggcatttataccccacacacggggtccctcaattatgtgaacgccaatttttttttaacgctcaacaaagtgttggccccctgtggtggctccactaattggtgtgggggccaccagacaacggtttttttctttatcacttcttctcggggcaacaacacatttctttataaacccgtcgtttttcattggcacactatacttctctgggacaggcggggttggacagacaaactgtgtgtgtgcgttgtatatttaaacaacaacctttatacaagccaactaataacgtgtgggtgcccaagaggcgcgcacgagaggagggcacacaaattggagccccggtgtttgtaataccccccacacaacacatttttagtgtggagaaagggcgctgtacaaggcagaggaggcgagacatacacccaaaggtgtttctgtaagagaataatcttctcgcgaaaccaactctccggttgtgttcacacacatggtgttgggtagtaaacccccccatcttcttgtttaacaacaaatacaacacattggggggagggcagtcagtagaaagtagctcccctttgatggagccgccacccttttatgagggctcggcccagcccagtattgatgttaacacacaaagtgagacccgcatggatcgagggggcttagtgaattcatatgaaacataggatcgccgcgtgagtactcacaactgtgcgtgatgaagacgagatatcaactgccatcacgtgtaataagaagataaataatatgtagtaacttattgagagaacaacacaaacacaatcaggcattaatacagatagtaactgtatgcactcatttccgcatctcagatatg

SEQ ID NO: 564431 - DNA, 833 bp, Homo sapiens
  misc_feature (31)..(31): n is a, c, g, or t
  misc_feature (75)..(75): n is a, c, g, or t
  misc_feature (88)..(88): n is a, c, g, or t
  misc_feature (90)..(93): n is a, c, g, or t
  misc_feature (99)..(99): n is a, c, g, or t
  misc_feature (111)..(111): n is a, c, g, or t
  misc_feature (122)..(122): n is a, c, g, or t
  misc_feature (124)..(124): n is a, c, g, or t
  misc_feature (148)..(148): n is a, c, g, or t
  misc_feature (153)..(153): n is a, c, g, or t
  misc_feature (156)..(156): n is a, c, g, or t
  misc_feature (172)..(173): n is a, c, g, or t
  misc_feature (175)..(175): n is a, c, g, or t
  misc_feature (192)..(192): n is a, c, g, or t
  misc_feature (202)..(202): n is a, c, g, or t
  misc_feature (232)..(232): n is a, c, g, or t
  misc_feature (240)..(240): n is a, c, g, or t
  misc_feature (248)..(250): n is a, c, g, or t
  misc_feature (252)..(253): n is a, c, g, or t
  misc_feature (255)..(255): n is a, c, g, or t
  misc_feature (282)..(284): n is a, c, g, or t
  misc_feature (287)..(287): n is a, c, g, or t
  misc_feature (298)..(298): n is a, c, g, or t
  misc_feature (397)..(397): n is a, c, g, or t
  misc_feature (471)..(471): n is a, c, g, or t
  misc_feature (503)..(503): n is a, c, g, or t
  misc_feature (521)..(521): n is a, c, g, or t
  misc_feature (602)..(602): n is a, c, g, or t
  misc_feature (696)..(696): n is a, c, g, or t
  misc_feature (735)..(735): n is a, c, g, or t
  misc_feature (741)..(741): n is a, c, g, or t
  misc_feature (755)..(755): n is a, c, g, or t
  misc_feature (831)..(831): n is a, c, g, or t
ttcaaacaagcaacgacaacaaaatagaagnaattaaactattggcatatttaacagcattgaacagaattctgnatcctgtaaaaancnnnncttatntccccatgtggntatatgccaancnctatacacacatatccccctaggngggcnaanccctattctggcaatnntntcctctacccaattctncttggctatntctgtggatagtgtttggtgtgtgtttttntccatttnccataacnnncnncncctggccaattctaccaaagcgttttnnnggngggggtgtggngggggggggggggggggaagacatttatctcagtttttcacctgagcttttgtacaaggcaggcaaattgcctcctgacctcaggcagatgtttaagtnttcaccaactaagaaagctctgttattctggcctgggtgcttgctccagactcaggaacatctggtcaagacangcatcactgggctggggaattgtgtgtctccngcatcatctccgactctnttgtagttccttccttccctccctcactcttacatgcagacacagacagacacagtttggttgggacatgcagtggcagcncctggtgtataacatctttcacacaccttgagtttatctgcttgctgcctttgactgaacctgaaatggttggcctttcagcaagtaccttgtntgtttcctttatgtattggaggagaagggcaaagggaanagggtntgggaaatggtgangtggggaagaagcaagaagggtgggaattacaatcctcaaatggagtagtttttcatttttgttttcctaaaaaanag

SEQ ID NO: 564432 - DNA, 602 bp, Homo sapiens
  misc_feature (44)..(44): n is a, c, g, or t
  misc_feature (224)..(224): n is a, c, g, or t
  misc_feature (234)..(234): n is a, c, g, or t
  misc_feature (239)..(239): n is a, c, g, or t
  misc_feature (264)..(264): n is a, c, g, or t
  misc_feature (269)..(269): n is a, c, g, or t
  misc_feature (274)..(274): n is a, c, g, or t
  misc_feature (313)..(313): n is a, c, g, or t
  misc_feature (326)..(326): n is a, c, g, or t
  misc_feature (473)..(473): n is a, c, g, or t
aggataagctctttaaagcaaaggctttattttatctctcatcntttgttctcctagcgcaatgtaaaaaagaatagtaatatcagaccaggagggaggaatggcttgctggggagcccatccaggacactgggagcacatagagattcacccatgtttgttgaacttagagtcattctcatgcttttctttataattcacccatatatgcagagaagatatgntcttgttacnttgtntccacatagcccccaaatagtaagntcttnctagntaatcctagatgaaatgttaaagatgctatatgatacanctgtggccatgantgaggaaaggagctcacgcccaaagattgggctgctctcccggaggccaaacccaaaaaggtttggcaaagtcaggctcagggagattttgccctgctgcagacctcggtgtggacacccgctgcataaagctctccttgaaaacanaggggtctcaagacattttgcccacctattagcttttctttatttttttaactttttggggggaaaagtatttttgaaaagtttgtcttgcaatgtatttataaatagtaaataaagtttttcccctta

SEQ ID NO: 564433 - DNA, 629 bp, Homo sapiens
atctattctagactccatataactatagtgtcacgagctcgatgttgtatcagtacatcccgatggtgcagccgctatgtaaaggttcgttacgtacaacgattaaagtcctacgtgatctagagttcagaccggagtaatacagcgtcggtttctatctactgcaaattcctccctgtacgaaaggacaagagaaataaggctacttcacaaagcgccgttcgccccgtaaatgatatcatctcaacttagcattatacccacacccacccaagaacagggtatgttaagatggcagagcccggtaaatcgcataaaaacttaatcaaaatcaaagacaaacaaaatgcaccacaagaaaaaataaccaacaacgaagggcggcgcagcataaccagtaattcacccacagcagcgccctacagctaccaggcaacaaccgacggatatgtcaacaagacgcccggacccgaagaatgagacaccgcaaataccacagccgcaagggacgaccgcatacaacaacgagcggtacaaggagaacaccagcaccacctactacctctcgacgcacccccatctcggcgagccacatggcgacccaccacaaaaattactccgagcaccaa

SEQ ID NO: 564434 - DNA, 249 bp, Homo sapiens
acatcgatacgactttttttttcctccttcttcttcttctccttagttctttcttctcctcctcctttcttcttcttagttcttctccttcttccttctccttcttcttccttcgtcaccgtcttctccttcttcttactttcttcttccttctccttccttcgtcttcttctccttctcctcctccttccttctccttcgttcttcttctccctcttttctttttcttccttcttcttcttcctcctc

SEQ ID NO: 564435 - DNA, 620 bp, Homo sapiens
  misc_feature (100)..(100): n is a, c, g, or t
  misc_feature (162)..(162): n is a, c, g, or t
  misc_feature (197)..(197): n is a, c, g, or t
  misc_feature (254)..(254): n is a, c, g, or t
  misc_feature (278)..(278): n is a, c, g, or t
  misc_feature (494)..(494): n is a, c, g, or t
  misc_feature (523)..(523): n is a, c, g, or t
  misc_feature (525)..(525): n is a, c, g, or t
  misc_feature (533)..(533): n is a, c, g, or t
  misc_feature (571)..(571): n is a, c, g, or t
  misc_feature (595)..(595): n is a, c, g, or t
  misc_feature (605)..(605): n is a, c, g, or t
  misc_feature (612)..(612): n is a, c, g, or t
gactgcaaagaaggagtaggaacaaagaaaagcagagagagagagatgaagagagggaggaattacgtggtgaaggatgaagtgaacagcggtgcttggnatataagccagccctcaaacaagggtaagtgttactatccttattattattattaaggctantgtgaacactaaatgatataaattatgtaaattanctgataaggttcctggcactcagtaagtgttagttcccttccttcctcccttcaggngaggactagggagtaagtactttnagtaagttagttctcctgggttgaagggagggaaggaaaagctccaaggaggagagtgcctgtactgtgggtggtgtccttcatcagtacttcctgggagatatgcggtgtgacagctcccaccaactctctctgcctccctttgtacccctacgtcaggactccatcagcaaaggcctggatggagcagaaagcaatgatgatgggaaagccagnccctctctacgggttgaggttcacttggncncatagtgngaacactattctacttccctctcagtatggtggagtanggccctggagggcctgggctagcnaggtgcaatnctagctnggctctgt

SEQ ID NO: 564436 - DNA, 406 bp, Homo sapiens
tttggcaaaacaaccggagaaagcactttgattgataaaggggcccaggccagatcctgggtcacaccaacatgttgaatactgcccagaggaaaatgctcaaccagagaagtatgaacaaacacgataaggcagggcatgtaatcctcaacaaaaaatgcatttcatggaaggagtggtcaaccatttttttttttacagaaagggcctgcttctgttgtgcacgctggattgcagatggcgtgatcatggttcactgcagcctcaccctaccggactcaagccatcctcccacctcagattactttgtagctgggaccacaagcatgagtcacaacgcccggctaatttttctattttttgtagatagggtctcactatgttgcccaggcaggctggtcctgaa

SEQ ID NO: 564437 - DNA, 952 bp, Homo sapiens
  misc_feature (61)..(61): n is a, c, g, or t
  misc_feature (65)..(65): n is a, c, g, or t
  misc_feature (67)..(67): n is a, c, g, or t
  misc_feature (72)..(73): n is a, c, g, or t
  misc_feature (110)..(110): n is a, c, g, or t
  misc_feature (576)..(576): n is a, c, g, or t
  misc_feature (811)..(811): n is a, c, g, or t
  misc_feature (828)..(828): n is a, c, g, or t
  misc_feature (847)..(847): n is a, c, g, or t
  misc_feature (859)..(859): n is a, c, g, or t
  misc_feature (887)..(887): n is a, c, g, or t
  misc_feature (891)..(891): n is a, c, g, or t
  misc_feature (899)..(899): n is a, c, g, or t
  misc_feature (908)..(908): n is a, c, g, or t
  misc_feature (918)..(918): n is a, c, g, or t
  misc_feature (928)..(928): n is a, c, g, or t
  misc_feature (940)..(940): n is a, c, g, or t
  misc_feature (945)..(945): n is a, c, g, or t
gccagagcagctctttggaaactagggcagcagggttaggaggccggaggccctggggtcnccgncnagccnnacaggcaccgttttcagatgtccacttctcattgggnacatcaatcttttaactttgggggtcacagttttagccacctttcggggggtgactggagcagtaggaggtgtggggtcattttatgaatataataaaatggagctgactgtggacgaggactaagtgtgggggagaggggacgatacagggtgtgtgtctgggagtgcctgggggacagggaccccccggtggtcctatggcaggatgagaagggagggacttggctcccccagagcccggtggaagctactgttctctccagtgtctcgagcgtagccaaaataaggttgggaggctcccggcctgtctgctgtggtctgagctggctgcaagcccaggtgggggagcgagtctgggaagattggctttgactctctgttgccagaggagatgccatcccagcacggccccactgtagtccaggctcgtggtggcagcgggggcaaggggaggggcaaggctgnccccaacccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgatagaatggagctgggtctgagcctcccaggcttgagctccgggagtncttgtgcggtgagctgngcagctcctgggtaggtcnggcaccagcggncctgtgtggcgagtcctcagaggagtgntganaaggtccngtgtagtcntaggtcacantgctggcggntcagccggggtnggcancagaccg

SEQ ID NO: 564438 - DNA, 224 bp, Homo sapiens
aatgtgtcattgcactccagcctgggcacagagcacgactcagtctcaagagaaaaaaaaaaaaggttaaaaaatttaaaatgcaaaataagaaagaatcgaacggggtgctggtcttacttaaaacactggcagagctctcgtgtgtgcctagcatgtaagtcagatgcctctggtcgtttggagacagagtctcctaccgtcccccaggctggagtgcaggg

SEQ ID NO: 564439 - DNA, 428 bp, Homo sapiens
ctccataatgtgtgcccaggctggagtacagtggcaagatctcggctcatagcaacaaccacttcctgggttcaagcgattctcttgcctcagcctcccgagtagctgcgattacaggcacgtggcaccatgcccggctaattttttgtatttttagtagagacggggtttcaccatgttagccaggatggtctccatctcctgacctcatgatccacccgcctcggcctcccaaagtgctgggattataggcatgagtcactgcgccccacctttgttttttttttttttttttggaaacggattctcactccgcaacccaggcgggagtgcaggggcgcactctcagcccagggcaacctcggcctccgggcctccaagagatcctccaatctcagcccccaggtcgcggggattaggggcacaca

SEQ ID NO: 564440 - DNA, 350 bp, Homo sapiens
gagagagagtgaagattagaatagtagagttccttccattatgttccctgaaaagggcaagagggagaggataacccagtatagatagagatctgtgttccctttacttaatctccatcttctgtttctatgtaaatgagaaatgctggggaaggaagaaatctatatgtaactgaagtggactcactgtttcctggcaggtggcagtgccaagccacctgcctccagcctcttgctgtttttagcaatgggatttattgctgttctcatcctaagtccatagcctgggagaacccctgaggcatgagtgggagctgctctgtcactgctgtcactttccactgaggtcc

SEQ ID NO: 564441 - DNA, 900 bp, Homo sapiens
cggaaaagttagccttccatgaccgaagttgacgagtaatgatgacacattatgatctagattcatggtatacaaataacgagaattatcctgaaagaacggatttcgtgatgcttctgatgctttagataagataaggctaatatcactgactgatgagaatgctcttatttctggaaatgaggaactaacgagtcaaaattcaatttgttgataatggtagatagaagctggtgtatgttggcagataccgggtgtaggaatgacctataggaaagagttggttgacaagacctgtggtaacccatagtccataagtctgggtggacatagcagagatttttaaatcaaatatcgacttgcaagctacaggaagatggccagtcaacttctgtaattgattaggtcgagtattggtgtcgggattctatccacgctcttccttgtggcagatcaaggttagttgtcactgttcataaattaggcaacagcgtataccacatcacatctgggattctgcactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatatatggagcagcaagactgaaacctgttgaggagcccattggaggaagaagaagcaggcaaagaagagaaagaagaatctggatgatgaagctgcagttaaaggaaagaaagaagaggaaaaggaaacaaagaactaaagagttgaaaaaatctgtctgggactgggaattactgaatgatatcaacaatttgggagagaccatcaaagaaggtta

SEQ ID NO: 564442 - DNA, 135 bp, Homo sapiens
tttcgcgagcgcgggccgagcatgagtgtggtggcggcggcgagatcttggctcgggttgaggagttggtatttgtgtggaaggaggcggggcgcaggaggaagggggaagcggagcgccggccctgtcgggctc

SEQ ID NO: 564443 - DNA, 289 bp, Homo sapiens
  misc_feature (26)..(26): n is a, c, g, or t
  misc_feature (45)..(45): n is a, c, g, or t
  misc_feature (70)..(70): n is a, c, g, or t
  misc_feature (102)..(102): n is a, c, g, or t
  misc_feature (225)..(225): n is a, c, g, or t
  misc_feature (264)..(264): n is a, c, g, or t
aattcgcggccgcgtacgactacggnctgcgagaagacgacaganggggggagagttcggttgctgcggnggggcctgcacgttgactgtgggaaactcggnaacaagctcacatcttcctgtgggccttctagcaacagggatgagtctgcagtggactgcagttgccaccttcctctatgcgaggtctttgttgtgttgcttctctgcattcccttcatttcncctgatggcaagaagattttgcaagtcccggctggtggnagttgttagtgttcctatggcccct

SEQ ID NO: 564444 - DNA, 87 bp, Homo sapiens
gcctgggggaaccccccccaaggccggggagggttggtttttttatttggtttttttaattttgaaaattaaatgtttaccctttta

SEQ ID NO: 564445 - DNA, 123 bp, Homo sapiens
ggatctgacttatgacaacatagaccctttcttcttagtcttcatcctgaaaatggtttacaaaaaatgtaaagattagccagcatggtggcacacacctgtggtccagctgctcaggaggca

SEQ ID NO: 564446 - DNA, 190 bp, Homo sapiens
acgctctctctgtgggggtggcagactgggagctggccggcaggggtgcagtgtggtgagacaggacggccgaggggaccggtggaggcggtggttcctttggggggaaaggcactagcagtcgggtcgggccccggggtgctgtccttggctccgcgtccagtgcccgacacatttagaggcaccacgg

SEQ ID NO: 564447 - DNA, 381 bp, Homo sapiens
  misc_feature (15)..(15): n is a, c, g, or t
  misc_feature (79)..(79): n is a, c, g, or t
  misc_feature (95)..(96): n is a, c, g, or t
tgctaaccccagttngatgtaggacctgtctgtggagaggacacagaggggtactggtcagcggtggggggaggtgcangcccagtgtaggctannggacgcgtccgcgggctacacaggcggcctacgatgagcgttcagctaggccataatcgctatcactttgtggcccgaggccatatcacgagcacccgtgcccacggtgccttgtacagagaggagctgacaggagggatgggtgggtgtaaatacagggtctagccatgcacatggggacaggcagctttgccttctcaccatgggcagttagatgagcaactggcccaagtcatttcccaccacactttggaaggtcattctatatagcacaataccccaaac

SEQ ID NO: 564448 - DNA, 1053 bp, Homo sapiens
tacctgtaccctttagtaaggacgagcttgtgccctccaccgaccccttaccaatggcgtgatgctgtgtggagtcgttggagtgggccatgacaccccttggcgggcaaggagacaaacagccacactgtgctgccggggaagagaagaagaaggaacgggccagacacacaggtgctgtcgtgcggatgcggaaggattccgttcctgcagggggcggagggatattgacagcacggtaatttccggaaaagtcctgaacctcagtcgaaaagccttgcaagaaacaataacaaagtgggaggaggaagcgattctggggtttctagtgttgaacggatcttgtccgccgaagatgcgcttcggcctctgtcaggggacttgacacgggcttagtgggcttcagcacagcttactccaccggttccccacggggaccccccccccaaggcagaacgctgcaatgagaaacgaacagataggaccaggaggcgaaaaaacgccgagcgagaaaacacggagcaaacacggaaaagaaaaaggaccgagatataagagcagcagacgggaaacgagagaacacagaaacaacggggcaccagattagcacagcgacagaaatcaccgggcaaaagggaacgaacacacacacacgggacacaacgtgacaacaacacaggccgaaccaaaaggaacagggaaaacacacaaataggccatgaaacaaataacaacagcatacacgggagcaacaaacccaagacgccacaggacgagagaaattgaacccaagcatgccacagataacacaaagtgacgaaatgggcgaaaaaggaaccagcggcaaccccaagcatcggggccaactagaacgagaatcgtagcagagaaagcacccagtggcaacaagcaacacaccaggacatgaagacaagaacaaacatgtagccacaaggcaggtaggcacaggacaaagaaaacaacgacaaaagaggaggagagagaaaggcgagaacgaagagacccaggagagaacgagaagaacacaagcgc

SEQ ID NO: 564449 - DNA, 359 bp, Homo sapiens
ctctacacggattactaaaaatacaaaaattacccgggtgtggttggaaggtgctgtaatcccagctacttgggaggctgaggcaggagaatatcttgagacctggaggcggaggttgtagtgagccaagattacaccaatgcactccaggctgcgtgacagagcaagactccatctcaaagaacaaaaaaagaaacattaagagaataaaaaagtcacactacagactgggagaaaatatctggcacacaaagaacttttatctagaatatataaagaacttctataactccatttaaaaaaataatccagggactttttccctcataagtcccagattgcggtgtttggggtaccga

SEQ ID NO: 564450 - DNA, 1189 bp, Homo sapiens
  misc_feature (198)..(198): n is a, c, g, or t
  misc_feature (311)..(311): n is a, c, g, or t
gatcttgcccggcgcgagctgcgctgtctctgtgctagcctcgctcttctccctcttcccttcgtccctacttccgactccgggcgttatcagagagtgcgagtccatctgatcgcgtacgtgcatacgagcgatgccgacacatagagcccgggcgaggtagagtccacgtatccaatctcagggctctcacgcgtnagccgctgctttatgtacgaagcgccgggcaacatgcgccgagcgcagaatgcatgtagaaaggacttgctagctcgctcgttctctccacggatcgacacccatgacgacangattgggatctcattgtcgcctgcgtacaacaccatgaaccttttgtgtgcccacgtgaactccttgtgaggcctacgtccggggtatggagcgcgcacgtctccctgcgctggcctcgcgcccatgcgggcccagatgacatcggggaccgggtgattgcggaccacagggaagttgcccgacccacccgggttcccttggtgggcctcatcgaccaatgtctcccccttgatggcatcaggtaccatcgcctcatgcgctgagaacgcgaccatacctgacataacgttcactctgcacatggtgcgcatctcgaggtgtaacctcgaacatcgatctactcagatgctgcgcgagaatccccgcgatctgagaggagtcctttggattcgtctgccctcccctcgtgcggaacgcccccgctcaggtccaaacccatgcgccatggggacccaagcactccaaaatggcgatagttgggggtcaatgtcgttgaggcacattgggccacaagccccaacatggccctatgtacatcggcttgccatggactgccatgttggcacgcgttctcggttcgcacccacgcgggtggcattgccactagcggtgggttgggtgagccctgtttggcgccgccaacctttgcgtgagaggccagagagaacccacttggcctagaaccaacactgtcgcgcgaacgagtgaaagtgaatgcccaaccccggatgaacccagaaaactttcttaccccggttcgtttgagcatccttgcggcaggccccggaacaaattgggtaccgccccttgccaataaatcggtggtcctccctttggctcgggtggaattaacgggagccgagtagggggaaattcc

SEQ ID NO: 564451 - DNA, 250 bp, Homo sapiens
ctttccttgacctatcgcggcgcccgcggctctctctcggactcgcggcgtcgctgtcgaacctcacgaactgtgtgttgtccacgtagcccactgcgatgaagcggggctccccgtggccgggccgggacatggcggtgtagaaatacctcatggagtgggagccggcccaggtctcggtcagggccagggccccccagagcagcaggaggagggttgggggtgccgtgacccgcagggtacggagctc

SEQ ID NO: 564452 - DNA, 982 bp, Homo sapiens
tctgctgcagaacattaatggagttgctttattcgggctcgtgtgttgtgatgctgtaatcagaacatgcttccctgttattccagcttgaaatgcaaattcaccatcgggctcatttctaatcgtcgcagtgtttcctgctttgggccagcaaagaagcctgatgactgcatagggtttgcttaggcaatacttagacgcaccgtgtttgtgactactacagcaatcaccatagctacgagatgagattttactgtcttatttaaattttatgaatctgtctgttttttacactaattttcccaataaagccaacttggtctacaagacgccacatcccctattatagaagagctaataaatttccatgatcacacactaataattgttttcctaattagctccttagtcctctatatcatctcgctaatattaacaacaaaactaacacatacaagcacaatagatgcacaagaagttgaaaccatttgaactattctaccagctgtaatccttatcataattgctctcccctctctacgcattctatatataatagacgaaatcaacaaccccgtattaaccgttaaaaccatagggcaccaatgatactgaagctacgaatatactgactatgaagacctatgctttgattcatatataatcccaacaaacgacctaaaacctggtgaactacgactgctagaagttgataaccgagtcgttctgccaatagaacttccaatccgtatattaatttcatctgaagacgtcctccactcatgagcagtcccctccctaggacttaaaactgatgccatcccaggccgactaaatcaagcaacagtaacatcaaaccgaccagggttattctatggccaatgctctgaaatttgtggatctaaccatagctttatgcccattgtcctagaaatggttccactaaaatatttcgaaaactgatctgcttcaataatttaat

SEQ ID NO: 564453 - DNA, 154 bp, Homo sapiens
attgaaaatactgaatcctgggtgacatggatacatagccaagtttgagaagtgctgttctgtagacccggtcctctcgatgcatttccctggagtcctcacaggtgcactgtagggcacccgttgtgtgtgcacacaattctgcaagtgctgg

SEQ ID NO: 564454 - DNA, 172 bp, Homo sapiens
cctagaagcgtgtcaaaaatacttttctgggaaaatggacgcggtaccctcgtggcccggtacggtttcggactcacctggaagccgtcgaccaatcccccgacgccgacgtgctggacccggtgccccaacgccggtccacacatccgcctcaggacgaggtcgatccgcg

SEQ ID NO: 564455 - DNA, 333 bp, Homo sapiens
aataaggatgtttcagtcatgtgctaggaactttgttgtcacatatgtataaatcaagggtgtccctggacttcggcctccctggacttttggcttccccacattaaaagaattgtcttgggccacacacaaaatacacgaacaataatgatagctgatgagctaaaaaaaaaaaaaagaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtctacaaacatg

SEQ ID NO: 564456 - DNA, 1000 bp, Homo sapiens
actcatcaggaagcgcggggtcggtaggagacaggacggcttaatgccagaccggtgagttggacggtgtccgatctcgagattgggatccagcaaggccttctcagccagtcaacacgcacagacaccattccagcagagatttgatgcccggcaagaagattggcctctcagtatgcccggctcaaactgggagtcaaggatgcccgggcagaagcttcatgccgaacaggttgccggatttcaaactcaaagggaatgctgcaggatgccagagagatgttgaactcatcgcacagcagcagaccacgagtgccccagaagacacccgacaggtatgctgatgcccgggagaagatcagcttgacacgaggagttcccctgctgccttcataaaacgcacccattgggacagtgacccactgactctgaagctcaccaaaaccatccaggttccacagacagaaagccatggcaacacttcatacccatactgccggaatgagactcaatgtcgtcaataaccaccaggccaaaccagaatccatcatgacctggatgacgatgacgatggtcatagcttccgttccctactaaacagatgacagatcagaagcgccaagagagagcatatacgtatcacaccgcagtgggaatggcgcatataaccagatacccaagcataaaccagatgtcccaaggccgatccatattcacacacagtggatcagacattatgaaataccaggatccatgccactcccattaacatcctaatacggcaagcaacgaagtactttgaaccgacagcatggtttctgggcataacgtggaagaccttactggaaagatgcaccacccaaaaagaagctttagcacatactcgcctacacctcggattcctacaagccgtgatggtaccggacccacagaaaggaattggacaacatacactgaccgtctagaaatcatctgacgagagcacaattgtcaaagtata

SEQ ID NO: 564457 - DNA, 300 bp, Homo sapiens
tttttttccccccccttttggggattttccccccgggccaaaaatttggccggggcccccaatttttttgttcaaacagggggggccccaattgggttttttggggcccccccccttttttttttccttttagggttttttggggggggggggggttttcccccgggaaaaggggggggggaaaaatggggcctaattttcttaggcccggggccccgggggtttggcccccagggggccccttgggggttgcccccccccccttttggactttttaattaaacccttttggccccccca

SEQ ID NO: 564458 - DNA, 830 bp, Homo sapiens
gctctggcctgcgtcaggcgcctgcgtgctgggtgagcgcacgcgaggcggcgaggcggcagcgtgtttctaggtcgtggcgtcgggcttccggagctttggcggcagctaggggaggatggcggagtcttcggataagctctatcgagtcgagtacagccaagagctgggcgcgcctcttgcaagaaatgcagcgagagcatccccaaaggacatcgctccggaatggccatcatggtgcagtcgcccatgttgtgatggaaaagtcccacactggtaccacttctccttgcttctggaaggtgggccactccatccggacaccctgaccgttgcaggtggattggagttctcatgagacttacggatgggatgacacagccagaaagtcaagaagaaagacgggaaagaatggaggagtgacaggacaaaggccaggatggcaattggatagcaaggcagcagaagactctgggtgactttgcacgcagcagtatgccaagtccaacagaaagtacgtgcaagggggtgtactggacgacacagatacgaaacagggccaggtgccgccgtggacccaaaggaacgcatggttggaaacacggagaaaagaccacaggcatagggccattgatgggacacagctgggataacacaatccaagggcatggcataggtcaaaaggaaacaaggagaaggagctaggcgttacacggacccgaagataacacgcggcgagatccagtcaaagggcaacaaggctccctggctacagagggacaaacacagcccctgaagaaacgagaaccacaggagcacagagtgaagca

SEQ ID NO: 564459 - DNA, 603 bp, Homo sapiens
atagtcccagcactttgggattccagcactcaggaggctgaggcaccggctggatcactggaggtcacgagttcaagaccagcctgggcaacatggcgaaacctcagctctactaaatgatacaaaagttaggtgggcatgacaggtgcctgtaatcccagctagttgggaagctgaggtagggagaatgactgggaagttgggaggcagaggttgtaagtgagctgaaatggaggcatggactcgaggctgggtgacgaagagcaagatttgtcaagaaatataggatgaactaaatgaagggagagagaacgatcgaaagaaagaaagaaagaaagaaagaaagaaagaaagaacccgaacagaaacggaagcaatatgcgtgctcaaaggagaaaagttccatctgaggttggggaaagtggctcacatctataatcccagcacttgggaggcggaggtgggaggatcacttgacccaggaatttgagaccagcctgggcaacttagcaaaacccagtctctacaagacagtttacaaccaacattatctgggtgtggtggcacatgctatagtccctaatactcaggagctgagggtgg

SEQ ID NO: 564460 - DNA, 203 bp, Homo sapiens
cccgggagtgtgttttagtggatgctgggatccttcgcttgcccttgagtgggaagttgggctccaatgtagatgacgaaggtgcggacaccgccattggtccaacaaaggctgttcttttccacctggcccaggaccctgtgggccagcggcgcctccccgtggcatgaaccccgcagggtactaaaccctgaaccacctga

SEQ ID NO: 564461 - DNA, 338 bp, Homo sapiens
cctttttccccggcaaagaggtgtggggggccttaaaggggccccccaaacaggcattttcccaggggggttttaagtttttgggcccccttctcggttttttgggacccctgggcccgggggttccaggggttttttaaattgttaaaaaaccccccccccccccccggggttccccccttccccccccaaacgggccccccgggtttaaaaaaaaaaaggggggtttttcccccggggggttcccccccggttttcggccccccaccccttttaccccttttttttttttttttccccaaaaagttttttttttaaaaaaaattttgggcccccca

SEQ ID NO: 564462 - DNA, 911 bp, Homo sapiens
agaacaatgtgctatgtgaatgagtaacgtcaagcctgtcgctgactagtttggagtgttccccttccactgagggcagtcgatagagctgtattaagccacttaaacatgtcacgttttgacaaaggcaagcacttgtgggttgtggtcttgtctttgcattcagtcttacgaatacttttgccctttgattaaagactccagttaaaacaaattttaatgaagaaagtggaaaacaaggaagtcgaagcaaggagactatgtaacatgtaggaagtaggaagtaaattatagtgatgtaatcttgaattgtaactgttcttgagtttaagtaactctgtagggtaattagtaacatgtgttaagtattttcatagagtatttcaaacttggagcttcatggcagaaggcaaaccctatcaacataggaattgtcccttaagacaagagaattaagaactcctcaatccagcgtatgttcatagttgaacaaaagtagagcctgacgggatctttactagttataaggatacagaactctttcaaaacctttgtgaaattaagcctctcactataccagtataattgagttcttcagtggggcagtcattatccaggtaatccaagatattttaacacatctgtcacgtagcaacttggactgtacctgtccccaatccatgaaccaagaccattgaattcttggtttgcaggaaacaaatgattacctaaatcttcgactacagtcaggcaaagggactcatttctatctctcctccatgggacgacaaattggataagaagtagaaactgtgaggacaaaatttttgcctaacaattcgtctagtaacatcacgtccttccctgacactgtccaattaagcaatatggcctttcaatcaaggttccca

SEQ ID NO: 564463 - DNA, 191 bp, Homo sapiens
agaaaactctagcatgatagagtaactcacagagctgagcatatgttagctggcgcatttaccaaacacaccttttgtggaatatgcaagtggatttagggacttctctgagaatttcgttggaaacgggataaacctcgcgtaactgaagaggaacattctcagaagttcttggtgatgttggcattcaa

SEQ ID NO: 564464 - DNA, 3243 bp, Homo sapiens
gctgtgggagccgtcagtggctgagctcgccaagcagccttggtctctgtctacgaagagcccgtggggcagcctcgagagccgcagccatgaacggcacagagggccccaatttttatgtgcccttctccaacgtcacaggcgtggtgcggagccccttcgagcagccgcagtactacctggcggaaccatggcagttctccatgctggcagcgtacatgttcctgctcatcgtgctgggcttccccatcaacttcctcacgctctacgtcaccgtacagcacaagaagctgcgcacacccctcaactacatcctgctcaacttggccgtggctgacctcttcatggtcttcggaggattcaccaccaccctctacacatcactccatggctacttcgtctttgggcccacaggctgtaatctcgagggcttctttgccacacttggaggtgaaatcgccctgtggtccctggtggtcctggccattgagcgctacgtggtggtctgcaagccgatgagcaacttccgcttcggggagaatcacgctatcatgggtgtggtcttcacctggatcatggcgttggcctgtgctgctcccccactcgttggctggtccaggtacatccctgagggcatgcaatgttcatgcgggattgactactacacactcaagcctgaggtcaacaacgaatcctttgtcatctacatgttcgtggtccacttcaccattcctatgatcgtcatcttcttctgctatgggcagctggtcttcacagtcaaggaggcggtgcccagcagcaggagtcagccaccactcagaaggcagagaaggaagtcacccgcatggttatcatcatggtcatcttcttcctgatctgctggcttccctacgccagtgtggccttctacatcttcacccaccagggctccaacttcggccccatcttcatgactctgccagctttctttgctaagagctcttccatctataacccggtcatctacatcatgttgaacaagcagttccggaactgtatgctcaccacgctgtgctgcggcaagaatccactgggagatgacgacgcctctgccaccgcttccaagacggagaccagccaggtggctccagcctaagcctggccagagactgtggctgaaagtaggagtctcctgtccccacacaccccagccacagcccccaccaggagcagcacccgttgggatgaggtcatgcaggctccctcagtgttcttttctttgtttttaatgaattcatgaaagcaaaatgaggctccccactcaatggggacagcttgacaaagggcatccatccaccaagaccatcctcaacctggagtccccaattcccggggggccagcgggatctgtacccctccctcagcttgtctatcaggaacatgacaagtgtcccggcttagggctaaatgtctaggacagaatggaacacatagtagctgattaataaatgctagctggatgaagggaggaatgagtgactgactgagtggatatatgagtgaagggattaatggaagggaacatggatgtcctcaggtgcccaacctggcagatccagtcatgtctggctggaatctataagcagttttacatacctgccctggttttctctgcccccacccccaccccagttggatctcccaaatccagggccctgatagaatatggctgcttcaaagacagagagatgaggggagggaggggggagggagagagggagggagggagacacagagagggaatatgtgtgatgcgtgtgtatgtgtgtatgtgtgtgtgtaaacactttgtatataaagagtacagctggtagttatgttacaagtaacaccgactaatataattaattaaccatcctaatggtctctgcttgttagtgactgcttgggaattaggcagggcccaagcactcagataaggtatttccctcagcctcagtaggcttttgcaaatgacccaggccttcaggcctgtgcagggctagagctggattacagagataaatgacagtgacagcaacgtgagctgcagcccttaggactgagaaagcatcgagaccaggggtctccggcaaggcctaggtcctcccttcagtatggaaaccttgcctcatgtctctcagcctccttggcctgtggagatccagcccttcctcttggcttctggatacatttgctcttctacaccagcaaccaagtggcaacagttccaggccagtatggagttttagaagccatgccaatatgcccaccttcagggagcagctgagtccttgatgccacccttgttctgaagagttcagaaacacagtgcaagacatgaccaggcctcatccttaggatgctcatggatccagttcttagctcccttgttggatatgctgttttccttggcctttggtcttttctttatcccagagggttttggctttaaggccaacaggaactatggggtaccgaattgggcagctcagtctgcatccctcctctatagaaccacagctgggccctcagcaggcccaactctgcatggggacagaggcattaaaagctcagctcctacacttggtggcagtggtggtctgttgctctcaagctctttcaaaatggatggaaactgggacgcttccctgacccctggttatgaaagactagactgtgtggggacaaacagtccagagtcccggggaatgtgatagagcagctccatcatttttagaaacccaatttgaggcagtatagagagatggtgacctctataagcctctgtatctgcaaagaggagcttagacctgcccttgaggggattatatgagatttaagggacttatgtggccagcctacttcctggcatgctgaagacattggcacactctggtattctagaccttggctcagagctgcctttactaggatactgtcacttagcaaaagaatgggatggagcctcagatgtggagtgacaccatcttccaagaaggaaagggtgccagggtctgggatgaaagccctttggtgctatgttgggcaagggcgagtgccagcaaggggttatttgcttgctctctccatcagtgatgaggttccatttggtcacaagaaattcaccccaattgctgaaacagaggctgactattggcttataggcatgaaaccccactcccctccacttcaggctggctagattaaaagctcagacctgtg

SEQ ID NO: 564465 - DNA, 3884 bp, Homo sapiens
gctgtgggagccgtcagtggctgagctcgccaagcagccttggtctctgtctacgaagagcccgtggggcagcctcgagagccgcagccatgaacggcacagagggccccaatttttatgtgcccttctccaacgtcacaggcgtggtgcggagccccttcgagcagccgcagtactacctggcggaaccatggcagttctccatgctggcagcgtacatgttcctgctcatcgtgctgggcttccccatcaacttcctcacgctctacgtcaccgtacagcacaagaagctgcgcacacccctcaactacatcctgctcaacttggccgtggctgacctcttcatggtcttcggaggattcaccaccaccctctacacatcactccatggctacttcgtctttgggcccacaggctgtaatctcgagggcttctttgccacacttggaggtgaaatcgccctgtggtccctggtggtcctggccattgagcgctacgtggtggtctgcaagccgatgagcaacttccgcttcggggagaatcacgctatcatgggtgtggtcttcacctggatcatggcgttggcctgtgctgctcccccactcgttggctggtccaggtacatccctgagggcatgcaatgttcatgcgggattgactactacacactcaagcctgaggtcaacaacgaatcctttgtcatctacatgttcgtggtccacttcaccattcctatgatcgtcatcttcttctgctatgggcagctggtcttcacagtcaaggaggcggtgcccagcagcaggagtcagccaccactcagaaggcagagaaggaagtcacccgcatggttatcatcatggtcatcttcttcctgatctgctggcttccctacgccagtgtggccttctacatcttcacccaccagggctccaacttcggccccatcttcatgactctgccagctttctttgctaagagctcttccatctataacccggtcatctacatcatgttgaacaagcagttccggaactgtatgctcaccacgctgtgctgcggcaagaatccactgggagatgacgacgcctctgccaccgcttccaagacggagaccagccaggtggctccagcctaagcctggccagagactgtggctgaaagtaggagtctcctgtccccacacaccccagccacagcccccaccaggagcagcacccgttgggatgaggtcatgcaggctccctcagtgttcttttctttgtttttaatgaattcatgaaagcaaaatgaggctccccactcaatggggacagcttgacaaagggcatccatccaccaagaccatcctcaacctggagtccccaattcccggggggccagcgggatctgtacccctccctcagcttgtctatcaggaacatgacaagtgtcccggcttagggctaaatgtctaggacagaatggaacacatagtagctgattaataaatgctagctggatgaagggaggaatgagtgactgactgagtggatatatgagtgaagggattaatggaagggaacatggatgtcctcaggtgcccaacctggcagatccagtcatgtctggctggaatctataagcagttttacatacctgccctggttttctctgcccccacccccaccccagttggatctcccaaatccagggccctgatagaatatggctgcttcaaagacagagagatgaggggagggaggggggagggagagagggagggagggagacacagagagggaatatgtgtgatgcgtgtgtatgtgtgtatgtgtgtgtgtaaacactttgtatataaagagtacagctggtagttatgttacaagtaacaccgactaatataattaattaaccatcctaatggtctctgcttgttagtgactgcttgggaattaggcagggcccaagcactcagataaggtatttccctcagcctcagtaggcttttgcaaatgacccaggccttcaggcctgtgcagggctagagctggattacagagataaatgacagtgacagcaacgtgagctgcagcccttaggactgagaaagcatcgagaccaggggtctccggcaaggcctaggtcctcccttcagtatggaaaccttgcctcatgtctctcagcctccttggcctgtggagatccagcccttcctcttggcttctggatacatttgctcttctacaccagcaaccaagtggcaacagttccaggccagtatggagttttagaagccatgccaatatgcccaccttcagggagcagctgagtccttgatgccacccttgttctgaagagttcagaaacacagtgcaagacatgaccaggcctcatccttaggatgctcatggatccagttcttagctcccttgttggatatgctgttttccttggcctttggtcttttctttatcccagagggttttggctttaaggccaacaggaactatggggtaccgaattgggcagctcagtctgcatccctcctctatagaaccacagctgggccctcagcaggcccaactctgcatggggacagaggcattaaaagctcagctcctacacttggtggcagtggtggtctgttgctctcaagctctttcaaaatggatggaaactgggacgcttccctgacccctggttatgaaagactagactgtgtggggacaaacagtccagagtcccggggaatgtgatagagcagctccatcatttttagaaacccaatttgaggcagtatagagagatggtgacctctataagcctctgtatctgcaaagaggagcttagacctgcccttgaggggattatatgagatttaagggacttatgtggccagcctacttcctggcatgctgaagacattggcacactctggtattctagaccttggctcagagctgcctttactaggatactgtcacttagcaaaagaatgggatggagcctcagatgtggagtgacaccatcttccaagaaggaaagggtgccagggtctgggatgaaagccctttggtgctatgttgggcaagggcgagtgccagcaaggggttatttgcttgctctctccatcagtgatgaggttccatttggtcacaagaaattcaccccaattgctgaaacagaggctgactattggcttataggcatgaaaccccactcccctccacttcaggctggctagattaaaagctcagacctgtgaccccttgtgtctctcttctgtgttgacttcactcacaggcctaacctcagaggtgtctgtagcagtcccaggccagacacccttccagaaaggggctttccttccctttataatcgtggtgacaggtcagattcttattgggcagacctaagttacctgattatccttaagccaatcatcatgtctaagacagagattcatttgattggccaggctgagtcacttgtttacctctaagtcaatcaacaggcctgagatggagagtcatcttctgattagctagacctgggtcacctgatcacctctaagccaacacttatgtctgatatagggctccctcatttgtaaatgttgttccccacaacttacaaggataaaagtttgactcccacatagttaggaagccttgtagggattgtttgttccccaaaaagcaaaagggggaaccggatcaggaccagcctgaaggggtgtggaattgggaagggcgtaacaaaaggtcccggggtcatggcataaagggatccatggggcgaactttggtggtctaagctatgggcagaaagcctttgaaggaaataaggcggtgaacccaaacaggcgaagacggggggaaacagcgtcagcagaaaccaaaagg

SEQ ID NO: 564466 - DNA, 362 bp, Homo sapiens
  misc_feature (138)..(138): n is a, c, g, or t
  misc_feature (150)..(150): n is a, c, g, or t
  misc_feature (155)..(155): n is a, c, g, or t
  misc_feature (158)..(158): n is a, c, g, or t
  misc_feature (162)..(162): n is a, c, g, or t
  misc_feature (164)..(164): n is a, c, g, or t
  misc_feature (175)..(175): n is a, c, g, or t
  misc_feature (181)..(181): n is a, c, g, or t
  misc_feature (184)..(184): n is a, c, g, or t
  misc_feature (190)..(190): n is a, c, g, or t
  misc_feature (199)..(199): n is a, c, g, or t
  misc_feature (202)..(202): n is a, c, g, or t
  misc_feature (221)..(221): n is a, c, g, or t
  misc_feature (228)..(228): n is a, c, g, or t
  misc_feature (246)..(246): n is a, c, g, or t
  misc_feature (253)..(253): n is a, c, g, or t
  misc_feature (272)..(272): n is a, c, g, or t
  misc_feature (280)..(280): n is a, c, g, or t
  misc_feature (286)..(287): n is a, c, g, or t
  misc_feature (291)..(291): n is a, c, g, or t
  misc_feature (306)..(306): n is a, c, g, or t
  misc_feature (352)..(352): n is a, c, g, or t
gaagttcatctatttgaaataagacaccttcgggggaaaaaattcctgtgaaaattttttttcaattcagcaaacatttgaaaatttatgatgggcaagttaaattgttgatttcagtacaagattttttaaatcagntgctacaaaaantgatnggntttngncacttcatttnttcacnaanggaganagctttacnctntgctttaatagatttaagngggcccnaatatttactaaaattgntagtttnccgttcagaagtataatanaaataatntttagnnggtnttttttaaccattgnaatttttccctttttccctccccctttccttcattgaataaacctntgttcaaaga

SEQ ID NO: 564467 - DNA, 216 bp, Homo sapiens
ccttggtgtagcagaacgccacgcaggaggccgggcggaagtgcgccagcaccttggtcacggcgtcatgcgctcttccggggagatctcgtagaagcgttgttcgatctggtcgtcggagtggaacgcttcggctttcacttgctgaggcgcacgcatgaacttggaggccagttgcttgatgctcaccgggtaagtggccgagaacaggcaggg

SEQ ID NO: 564468 - DNA, 1535 bp, Homo sapiens
atgtcgctcgtattggtcgtgttttcagcacctttgcttcctgggggggcgccgaagcagtcggtttgtttcgtgcgtgtgttccctgggggggggctctattttctgcgcgatatttcggttgtagagcgcgtctccccgccgtgttggctacccactctttgtgcggggcacaaattgtgtaggcgcggcgggagcttccggcctagagagggggtgccgccctctttctcagatgggtggggtggcccccacaacattgggtggtgttgtcgcctcgccccttttcgtgtggcgttcttttgtccgtccgcgctgcgttgtgtagttgctccagcacacccgcaggtgtggttgtgtggggcgtccttggtagtggtctcccctcctccgtctgtgggtgagtggttctccgggcgcgtagttccatctatacatcttgttggtcgccgcacgtgtatgagccgtgtgtgtggtggtcgccgccccccctgtgtgtttcatgaatacgtcggctgcgtgctcttcggcgtggtaggtggacgatcttgtttttgtgatcagcagatatgatagattatctgcgcgactggggtggtgaccgccacccccccacacagatacgggtggggttgctaagaatagtggtagtaagaaggaagagtgttcatcctaacgaagagtgttggggggcggcaagatcttggttcgtcataatcataagtgagagttgggccgcagatagtggttggctatcatcacactgctgtaatgcttctgagtgtgggtgtgctgcagtggcacacagctccgtcagagattgttctcgtcttggcgtgttctcccctcgtgtgtgggggagaatagtgtgtgcggcgcgccgcgccctgctctgtttgtgagagtcctctgtgtgtctgagagcgactgttcttctccccgcgagagggggtctgtctctctctagtgtgctctttgtagagagcgtgtgtgtctctccccccacagtagtgatgcgctctggtgcgcgatatctcgcctcttctccacagatatgtctccgctgtggcgcggcgcgatatctttctctctctgtgggtgctccgcccgcgcctgtgcgcccgtgtcgcgccactctcgtctcgacgcccctgtgttgtgcgccactctcgccgcccaccgggcgcggccttttgcgcacttgttgtccctctcgcgcccgcgagagagtctgtgggctgctggggggggggcgctctgtctctctgtgcgctcttcttgtgttctcccccacagagaggcgtgccttctgaggggcggagcgcgacgactgttcttctcggagagagggcctcggagagtactctctgcgtcccactatgtgtgcctccctcctctatcttctcgcgcccaccctggacccccagacaagtttccacacacaatgtttttttgttttttttttcctctttttttttctttgtttgtgttttagaaaaaaagttttggggtaaaaaagatggtagaaatcttta

SEQ ID NO: 564469 - DNA, 3840 bp, Homo sapiens
  misc_feature (10)..(10): n is a, c, g, or t
  misc_feature (16)..(16): n is a, c, g, or t
  misc_feature (41)..(41): n is a, c, g, or t
cccccccctncccccntattggtgttaccagattgaggtcncagacatgttggcacagagggccccaatttttatgtgcccttctccaacgtcacaggcgtggtgcggagccccttcgagcagccgcagtactacctggcggaaccatggcagttctccatgctggcagcgtacatgttcctgctcatcgtgctgggcttccccatcaacttcctcacgctctacgtcaccgtacagcacaagaagctgcgcacacccctcaactacatcctgctcaacttggccgtggctgacctcttcatggtcttcggaggattcaccaccaccctctacacatcactccatggctacttcgtctttgggcccacaggctgtaatctcgagggcttctttgccacacttggaggtgaaatcgccctgtggtccctggtggtcctggccattgagcgctacgtggtggtctgcaagccgatgagcaacttccgcttcggggagaatcacgctatcatgggtgtggtcttcacctggatcatggcgttggcctgtgctgctcccccactcgttggctggtccaggtacatccctgagggcatgcaatgttcatgcgggattgactactacacactcaagcctgaggtcaacaacgaatcctttgtcatctacatgttcgtggtccacttcaccattcctatgatcgtcatcttcttctgctatgggcagctggtcttcacagtcaaggaggcggtgcccagcagcaggagtcagccaccactcagaaggcagagaaggaagtcacccgcatggttatcatcatggtcatcttcttcctgatctgctggcttccctacgccagtgtggccttctacatcttcacccaccagggctccaacttcggccccatcttcatgactctgccagctttctttgctaagagctcttccatctataacccggtcatctacatcatgttgaacaagcagttccggaactgtatgctcaccacgctgtgctgcggcaagaatccactgggagatgacgacgcctctgccaccgcttccaagacggagaccagccaggtggctccagcctaagcctggccagagactgtggctgaaagtaggagtctcctgtccccacacaccccagccacagcccccaccaggagcagcacccgttgggatgaggtcatgcaggctccctcagtgttcttttctttgtttttaatgaattcatgaaagcaaaatgaggctccccactcaatggggacagcttgacaaagggcatccatccaccaagaccatcctcaacctggagtccccaattcccggggggccagcgggatctgtacccctccctcagcttgtctatcaggaacatgacaagtgtcccggcttagggctaaatgtctaggacagaatggaacacatagtagctgattaataaatgctagctggatgaagggaggaatgagtgactgactgagtggatatatgagtgaagggattaatggaagggaacatggatgtcctcaggtgcccaacctggcagatccagtcatgtctggctggaatctataagcagttttacatacctgccctggttttctctgcccccacccccaccccagttggatctcccaaatccagggccctgatagaatatggctgcttcaaagacagagagatgaggggagggaggggggagggagagagggagggagggagacacagagagggaatatgtgtgatgcgtgtgtatgtgtgtatgtgtgtgtgtaaacactttgtatataaagagtacagctggtagttatgttacaagtaacaccgactaatataattaattaaccatcctaatggtctctgcttgttagtgactgcttgggaattaggcagggcccaagcactcagataaggtatttccctcagcctcagtaggcttttgcaaatgacccaggccttcaggcctgtgcagggctagagctggattacagagataaatgacagtgacagcaacgtgagctgcagcccttaggactgagaaagcatcgagaccaggggtctccggcaaggcctaggtcctcccttcagtatggaaaccttgcctcatgtctctcagcctccttggcctgtggagatccagcccttcctcttggcttctggatacatttgctcttctacaccagcaaccaagtggcaacagttccaggccagtatggagttttagaagccatgccaatatgcccaccttcagggagcagctgagtccttgatgccacccttgttctgaagagttcagaaacacagtgcaagacatgaccaggcctcatccttaggatgctcatggatccagttcttagctcccttgttggatatgctgttttccttggcctttggtcttttctttatcccagagggttttggctttaaggccaacaggaactatggggtaccgaattgggcagctcagtctgcatccctcctctatagaaccacagctgggccctcagcaggcccaactctgcatggggacagaggcattaaaagctcagctcctacacttggtggcagtggtggtctgttgctctcaagctctttcaaaatggatggaaactgggacgcttccctgacccctggttatgaaagactagactgtgtggggacaaacagtccagagtcccggggaatgtgatagagcagctccatcatttttagaaacccaatttgaggcagtatagagagatggtgacctctataagcctctgtatctgcaaagaggagcttagacctgcccttgaggggattatatgagatttaagggacttatgtggccagcctacttcctggcatgctgaagacattggcacactctggtattctagaccttggctcagagctgcctttactaggatactgtcacttagcaaaagaatgggatggagcctcagatgtggagtgacaccatcttccaagaaggaaagggtgccagggtctgggatgaaagccctttggtgctatgttgggcaagggcgagtgccagcaaggggttatttgcttgctctctccatcagtgatgaggttccatttggtcacaagaaattcaccccaattgctgaaacagaggctgactattggcttataggcatgaaaccccactcccctccacttcaggctggctagattaaaagctcagacctgtgaccccttgtgtctctcttctgtgttgacttcactcacaggcctaacctcagaggtgtctgtagcagtcccaggccagacacccttccagaaaggggctttccttccctttataatcgtggtgacaggtcagattcttattgggcagacctaagttacctgattatccttaagccaatcatcatgtctaagacagagattcatttgattggccaggctgagtcacttgtttacctctaagtcaatcaacaggcctgagatggagagtcatcttctgattagctagacctgggtcacctgatcacctctaagccaacacttatgtctgatatagggctccctcatttgtaaatgttgttccccacaacttacaaggataaaagtttgactcccacatagttaggaagccttgtagggattgtttgttccccaaaaagcaaaagggggaaccggatcaggaccagcctgaaggggtgtggaattgggaagggcgtaacaaaaggtcccggggtcatggcataaagggatccatggggcgaactttggtggtctaagctatgggcagaaagcctttgaaggaaataaggcggtgaacccaaacaggcgaagacggggggaaacagcgtcagcagaaaccaaaagg

SEQ ID NO: 564470 - DNA, 551 bp, Homo sapiens
  misc_feature (248)..(248): n is a, c, g, or t
  misc_feature (442)..(442): n is a, c, g, or t
  misc_feature (465)..(465): n is a, c, g, or t
agcgggggctgtgctcgcggcgcgcgtgcgaccgcgcgcgggcaggttcggcttgtccgcccgtatggccgcgcgtgcgtccgcggctcggtcggctcgcctcgttgcagctgctgatgggctgggagcgtcctgcgcctagcatagtgggttgcttggatgcggaagcttagcagggcggacgactcgaggcgtcgctgaccatccactgcgattcacgctgtgtaacacctccgtgggaagtaccntacagttcagcaccatctgagcggcagagtccctcgtgcctcgcatacgttcggagtgctagttcatcacttcgcgtaggtatttgagagagacagagtcgattcgctacccattggtaggcaaaagctcttgattggctagggtccctttgttccaacagcaactagcgttcgcgttggcgtgcgacatcatngagaaccttgctgacctgtatgnctttgagcgcagacgaagcaacgtgtggtagaccgcggcgtaaccctcgagtgatcaggtctagctcgattcagaaaggagcgaac

SEQ ID NO: 564471 - DNA, 319 bp, Homo sapiens
ttgtcactgcttcggatgaggtagacgtgttgatggtggcagctcgtgaccagtcttaccgatggtgggtattgtgggatgtgtgactagagtagttcataaggatgtagtcagtgccatggggagccaggagcggtgggtgatgacatcactggttcttcaggtgcttgggacacctccaggagtaatagcccacgtcagcgttgactgtcaagcgggcgatgtcaaaagtctcaatgacgttgctgtcccatttcttgcggtactcaatgtcgtgtaggacgtcgtagagtgtctcggctggcacatcacagcactc

SEQ ID NO: 564472 - DNA, 1459 bp, Homo sapiens
  misc_feature (524)..(524): n is a, c, g, or t
ttggggacacacttctgtatgatgagcgcctcccttccttgatggtagaacagctttataattcctgccgctttgtaagtgccgtacgaaaactgtctcttgcagagagaggcgacggatgtaggaaaatctctttgctggggggaacaacaacagaccccagaacgctgtttccctcctgggggagaggttttcacctccttccttccgccgctggagaagtgatccttctagagaactctttttaggagagactacaaaaggggggaacagaaaggacacccccccctttgtgtcttggttcctttaaggatgagaagactcggttgccaaaaaaatgtaccccaggaaaatggcccttcctttttgttgggaacgtctcttattttgtcaattggggggggttttaaataggtgtccccccaaggttgtcaaacccccccgtatttgggggaaaatgatgctcaaaaaaattcgtccccaatgtttttggtataatgtatcgcccccccgctggggaacgngtgggggaacaacaccccccacccaatgcgttttgtagaccccctcctggttccccccaacacgcccctgtgtaaagaatagttgtaacactctctagttgtacaacacatttttagagaatgttggccccaccacacagcatttggggccccaggagaattactcatttcgtttgagacacacccacacacattcgtgtatatttgtggaaataaattcggggagatgttttgtgacatatataaatacgcaatagctctaatatttttatgtgtgaaatatagtttcggtcacacagtttgaatggtgtgtgtgaataatttgtccacacccccacttgtctcacacacacccactgtggtgataagagtccccccaaatattctcagagaaagacttgtgagaggacactgtgtctctgtgtcacacactagagacacacttgtgaatctcacacgtgtgaatggggatattaacttagagggcctcggagagggggtgtgcccgctcttcttctgagagaaaaatagttagagagattataataataattctcttcccggggggctgtgtgaatatccactaatctctagatttatccaaataatattttaaggatccattctctggtgataataaacataatatttaaaatattaagccaagccacaacattagggagaggagaaatagcgccaatattttggaggggatacccttaatattgcgcatatccggtttagggggataatattttccaacctcttgctttataactctgataatggggtgtgttttatggaacattgttaatagtttatattgaatccaagccaggatttcccagtccagtgtattgctccatttactggaccacaaaaggggaaataaacgaaacaccgaaaaggggaaattaactgaccttttataatga

SEQ ID NO: 564473 - DNA, 622 bp, Homo sapiens
gaggcacgactcatctttccgtacagggctctgcctgcccacagccccagcccacaccatgggcttggacctgacggtgaagatctgcgggccacgaattccaggtgtccctgagcagctccatttcggtgtcagactgaaggccccgatctaccccgaagatcggcgtgcacgccttcccgcagcgtcttggctgtcccacccgagcggtgtggccgctgccggaccagggtcccccttgcccgcccgggcctgggccccggcagcacggtcctgctggtggtggaccaatgcgacgacctctgagcatcctggtgaggattaccagggccgccgccagcacctacgaggtgcggctgacgccgaccgtggcccccctgagagccgccagtgagcgggctggagggtgtgccggacgacctgttctggctgatcttcgaggggaagacccctggaggacccgctccccctgggggagtacggcctcaagcccctgagcaccgtgttcatgaatttgcgcctgcggggaggcggcaccgagcctggcgggcggagctaagggcctccacccagcatccgagcaggatcaaagggcccggaaattaaggctgttgttaagaga

SEQ ID NO: 564474 - DNA, 283 bp, Homo sapiens
  misc_feature (5)..(5): n is a, c, g, or t
  misc_feature (36)..(36): n is a, c, g, or t
  misc_feature (83)..(83): n is a, c, g, or t
  misc_feature (115)..(115): n is a, c, g, or t
  misc_feature (144)..(144): n is a, c, g, or t
  misc_feature (174)..(175): n is a, c, g, or t
  misc_feature (178)..(178): n is a, c, g, or t
  misc_feature (182)..(182): n is a, c, g, or t
  misc_feature (189)..(189): n is a, c, g, or t
  misc_feature (197)..(197): n is a, c, g, or t
  misc_feature (205)..(205): n is a, c, g, or t
  misc_feature (209)..(209): n is a, c, g, or t
  misc_feature (220)..(220): n is a, c, g, or t
  misc_feature (230)..(230): n is a, c, g, or t
  misc_feature (232)..(232): n is a, c, g, or t
  misc_feature (242)..(242): n is a, c, g, or t
  misc_feature (246)..(246): n is a, c, g, or t
  misc_feature (250)..(250): n is a, c, g, or t
  misc_feature (273)..(273): n is a, c, g, or t
ctccngagcagcctgcaccttctctcctcccatccngcaacagtctgaaagtacgcggaggacgggaccggaagacgagaganggctggacatcctgcccaccgtgtcccagccngggcagggagggaccatggcccgcaggtncacggggccccgatgtgcacagctgccacnnggngggnggtctcngggagatnggcagtcnggtngcccgtcctcngtgagtgcananactggcgggnacanatcncggccttcccgggttctcccggncccacgggtc

SEQ ID NO: 564475 - DNA, 119 bp, Homo sapiens
tgcaatgaaaataaatgttctttattaggcagaatccagatgctcaagggcctccataaaatcccccagttaagaagctggacttagggaacaaaggaacctataataaaaattggaca

SEQ ID NO: 564476 - DNA, 115 bp, Homo sapiens
gcacggagcatcagtaagggagctcagtaagcgtcagtaatgcggagcaatctatgccacctcctcgcctcctcttcttcctcaacacaacatacccccagcaggcgtgaccgct

SEQ ID NO: 564477 - DNA, 535 bp, Homo sapiens
  misc_feature (1)..(1): n is a, c, g, or t
  misc_feature (75)..(75): n is a, c, g, or t
  misc_feature (79)..(80): n is a, c, g, or t
  misc_feature (84)..(84): n is a, c, g, or t
  misc_feature (86)..(88): n is a, c, g, or t
  misc_feature (99)..(100): n is a, c, g, or t
  misc_feature (104)..(104): n is a, c, g, or t
  misc_feature (108)..(108): n is a, c, g, or t
  misc_feature (117)..(117): n is a, c, g, or t
  misc_feature (119)..(119): n is a, c, g, or t
  misc_feature (121)..(122): n is a, c, g, or t
  misc_feature (125)..(125): n is a, c, g, or t
  misc_feature (127)..(128): n is a, c, g, or t
  misc_feature (131)..(131): n is a, c, g, or t
  misc_feature (135)..(136): n is a, c, g, or t
  misc_feature (141)..(141): n is a, c, g, or t
  misc_feature (169)..(169): n is a, c, g, or t
  misc_feature (173)..(174): n is a, c, g, or t
  misc_feature (181)..(181): n is a, c, g, or t
  misc_feature (187)..(187): n is a, c, g, or t
  misc_feature (190)..(190): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (242)..(242): n is a, c, g, or t
  misc_feature (254)..(254): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (315)..(315): n is a, c, g, or t
  misc_feature (321)..(321): n is a, c, g, or t
  misc_feature (337)..(337): n is a, c, g, or t
  misc_feature (359)..(359): n is a, c, g, or t
  misc_feature (368)..(368): n is a, c, g, or t
  misc_feature (370)..(370): n is a, c, g, or t
  misc_feature (377)..(377): n is a, c, g, or t
  misc_feature (413)..(414): n is a, c, g, or t
  misc_feature (516)..(516): n is a, c, g, or t
nttcttttttatttcttttttattcttttcttttcgccacttcaattgcccccaggtgaagatggtttgcggctnttcnncttntnnnttttctgctcnngggntgcnctggggtcncngnnagnanngtnttcnncttgnggtgtgtgttgttctagtgtatggtgtnctgnncctgggncttgangtncccgtggagatttcttcttctgangcnggngtggaaaccagtggctgtggtngggccagaggtncttgagggggatctgatccagcgggaaccagcatgggcgcatttcgtcgctctcnangngngttccntgggtgctgtttgttncgacgaaatgaaagtaaatganaaaaggctngnaaacganctcaaacacgatctggcccaccttgtgcagggcgtnnactgtaagaacgctcttctcctgccgccccctcctagccccatcctcgatggtcttttcttcttgcactttgcccccaaagccattccaccggccggccccnaagcctcgctttttcatgc

SEQ ID NO: 564478 - DNA, 249 bp, Homo sapiens
agggaattcgtgctggtgctaagggaattcgtgctggtgctctccaccatcacactctgccctacctacctacctacctccaccatcacactctgtcctacctacctacctacctccaccatcacactctgccctacctacctacctacctacctccaccatcacactctgccctaccagtagatggtgtaaacaggactggcctcagaccaccctgcattctgattcaataggctggggtaccgagct

SEQ ID NO: 564479 - DNA, 541 bp, Homo sapiens
aatgctttgcacttgactatactattatctggatatacccgggtttatttgtccatttacttactgaaggacatcttggttgctccctagtttggcaatcgtgaataaagctgctataaacatcaaacatctgtgtgtgtgtcttttgtgtggacataagttttcagttcgtttgggtaaatagcaaggaacacagttgctggatcatatggtaagaatacctttagttttgcaagaaacctctaaactgtctttcaaagtgatggtaccattttatattcccaccagtaatgaatgggagtttctgttcacattctcaccagcatttgatattgtcactgttaatgggttttggccattctaataggtgtgtagtgttattgttttaatttgcattttcctgattatgtgactttttttcatatgcatactcgccatctttatatcttctttagtgaggtgtccgttaaggtcattgtcctgttcttaaagtcaggttctttgttttcttattgttgaggtaatccgtgaggggggtacc

SEQ ID NO: 564480 - DNA, 494 bp, Homo sapiens
tgtggagaccaggctgagacaggtggctggtcaggtactcggggggcagctcagtggtggaagtggcctttccctccgctttcctgtgggcacaaggaatgctgcaggtcaccatgcgctgacaccgccctgcccccgccaaagctctcaaccacacctctgcgggctcctctaagtgtccccacagagggaggacagtggttccacagccacaggtgtccgaatggccacactccagagcagagcagggcaggactcgagggcatcacaccagccacaagggctcgggtgagtccctcagggtaagccccagttcctctcctgaaaatggacattcaggacaccagcccggcctgcgaaggaccttcctacggcactcgggaaaccaaacacagcaccgccactgtgggacgggccccacccaagaaggggcaaacaggtcagtgactgtcatgcccagtaagctcttccggggcgccccaggcagtccaagg

SEQ ID NO: 564481 - DNA, 225 bp, Homo sapiens
gcgcatgactcgacaaacagtccttctatcttcacacatctgctcaacatcagtgaagccctgcagcagtgttgtgacctctcccaggtctggtaccagagaatactgcctggagtaagccatgggccgacgaatccagttccccatcgagagtgtccatgccctgcattctaccggaccatatcctggaaaacaaagaacctaccattatggcgtatgtcctct

SEQ ID NO: 564482 - DNA, 1217 bp, Homo sapiens
  misc_feature (174)..(174): n is a, c, g, or t
ggcttcgctgtctccttggaccactgcaccatgtgtgctagctccgacgtacccggcgcgctagcggcggccggcccacgatcgtgtgtatgccttctcgggcgctgccacgctggaccgcgcgagggtagcctgtgagcctggtgctccctgcggggctaaggtagctacttnatccgagaaattgtgggcgtccctcttgaaggctaccgactggtctcgggactacacctcagtatgaacccgaagacttgcaggcttggtcgcccttctgcgaaccacctgtgtggactcttgagttgagtagcctcggggtcttccccggttggctaatggcaatgttttgggggcattcaagcgagaaaactggccaagagaaaccctgagacgaagactttcttgaaacttttccccctttcaaaagggtacccgattccccggcgacccgtcggaatgggtgttagaggggttattccggaaggacgcgcaaaagcgtttttcaattggcctgtccattttccgcaagcgaaaatggattgtccggaatggggtttggaagagccgtggatagtacagtgggagcgttgaacctgaccaaatccccccattccctttccttgtttccggagcgctttttaccctcttttgccctgtagggcgaataggggacatcccccttttgatcacccaaaacgagagcaatccccgccgctcgagaggcccgagtaaaacaggaataatccggacccttccagaacactgggggccgaccacactttgtcaacttcggaaagcctccaggtagagccaccccccactagttaggaaggcgttccgaaagtttccaaagcggccgtttggtgggcttcacagttccgcacgtgtagaggttagtcattgggattccagggccactagcaaacccagttaatacttgggagttatatgcgatacccgtttgcggtggcaaaacaccgttttttgtcatggcgaatggcaaacaggtggctcctccctccttttggacgagtgtggttgggtggtgcgcccccttttgtggaacgcgggcggagatggcactttggtcccccaactccatttaaaaccgggacccaaaggcgggtacttcaactataggatcaccccgtgacccccgttgcagtttgctcgcccgaatgtgaaactcccgacaggttgttgtgcaatccaaattcctg

SEQ ID NO: 564483 - DNA, 1214 bp, Homo sapiens
  misc_feature (503)..(503): n is a, c, g, or t
gcgtgggtggagcgttccactgagtctacttcaggacacagaaggcccatgcttgatgggggaggaggagggacgtgggcatttgggagcaccatggaggaaagtggatacatgcgtggttctcaaaacttaattgcctttccatttcttacctagtcaggcctttgacacaaactctgagtagaaagaagcctgataaagttgagggcacttgatacacctccctgtgcccccagaaggttcttggacgagaagtgcaagaatttggtgaacacgggcggtgggacgcgtgccggcgccggattgtggcatggagctgtggccatcacgatatcacgtgcctgctacagctctgctagtggatgccatatattactggatactcattgtatgaactagttaccagacgggactgcagtcgattaacgatgcccaggaggctcccgaattcccgaagagacgtgatagtaggcacatttgatggaggattcggtcgtcgtagncactacttttcgatacagtagctagacttgtgatccgtagcggtgtaattggctaagtcctaactctgtcctatcaagagactggcgataggatactgtctggctatgcacttgtgccaagatgacacggttgagttgtggcctagcagtcacgggccatcctgaccactagtgacggaggcgagaatcacgaccaggttgatcccaccgtatacctaggtgacacgcttgggacgtggaaggaccgatctttggcctaggtcccccataaaccctggcccccttagggacggcggtaaagtaagggactcgcccctcgtgttccgatgcactactaccccgggtggcagggggacctaggcgaggcgaatcccacaagctaagttgtaagaagggtgcggaacaatctgtgaccactccacaagatcgggcgacaccaagggggctcccataccaggctatgaagttgacaacacggtcgcccgctttcactcctggtttgacaaaggttttctcgatcccattgcaccaggcgctggctgcaccagacctggtgcgcaaggatttgcaggccgttcggcctgaccgccaacagcggccttttacacgcctggaacaccccgcacgactggcgtaaggaatgcgggcatgtgctggggcacccaaaggaccccctcacttagaaagcaggggcttcccgggttacggaaa

SEQ ID NO: 564484 - DNA, 365 bp, Homo sapiens
cttttcccaggggggaacctttggggtgttttggtgaaccccttttttaacattggtccccggggggattccccaccctttgggggccccgggatttttaaaaaaaaggttttggttttttcccccctggccggttttaaccaggccttttggtttttttgcacaggggttttttgggttccctttcggaacttttaacccttttttggggggcggggaaatgggttttttaattttgccaggggttttttgattttttttcccttttaaaaaaagggggggttggggggtgtggccaattccccccctttttttttcccgtttttgcccaataaactttttttccttttgggggggccccccca

SEQ ID NO: 564485 - DNA, 202 bp, Homo sapiens
aaagcggaccaagaccacagaggactaaatcgtggaacaaacgaactttaatagcggctgcaccatcgggatgtcctgatccaacatcggaggtcgtaaaccctattgtcgatatggactctagaataggatggcgctgttagtccctagaggtaacttgttcgcgttggtcacagttatggggatcacattgatgtatagt

SEQ ID NO: 564486 - DNA, 144 bp, Homo sapiens
ggtactttagatctattggtcgcagagagaagaacgcagggtgatgtggcgggcaggacaggcaggagggaggcaggctgcttgcccgggacgagctgccgtgctgtctgtagactcaggaccgtggtccagaactcctgtgcc

SEQ ID NO: 564487 - DNA, 102 bp, Homo sapiens
ttatgatgccacccatcataatgagtatatcaaaacatcagaaaataaccaagtgtggtaaagatttggaatcctcgttcattgctggtggcatcgataaca

SEQ ID NO: 564488 - DNA, 1501 bp, Homo sapiens
ggctttgttgggtgagcttgtttgtgtccctgtggggtggacgtaggttggtgatttggcaggatcctaggtataccagcaaacaaatacaaaaagcatatactaacataaaaacccgtgaaccggcaaaagcagacatcccaagatgaaggaagcccaagatacgaccagacgaaaaagatgaagagccaagaaccagggaaaagtgaaggcaaaccccccaaccagcagaaatcacgacggaggacaacatagcatgaggaatcagagccgaacgacaaacaaaacaacgagcatgaccagaaaaaagacaagccaacaccagagaccgaacgcacgagatgaggaatgtaaatgcaggagacagagcggaattagaaaccgcaagaaccagtcgattacgcatgcgaggcgaggtgaaggaaggatcgtcgagaatgacgaccgaggagacaaagagagaatgaaaggttcccacaggatacgcaaggagataacagacggacaagaggcatgacccgatccccaatcgcaggcgagaagagccagcagacgaaagaggcaggaggcaagagcggtggcaaatagaagaaaagtagtcagcagcagcaaggagcgaaaacatatctaacaagacccttgaaataagaattagcgagtcgcgcaagcagggcctaataagagccccaaagctttacggaaaatcgagggagcgaacatttcgaaaaccgatagagatcgagaccggaatagagtggaatccgcaaaggaattcagattttaaagaataggtcccgattgcgactctaccgagagaatttagcagagtatttccacaaatttgaacttagcaaaagaccgcattggggctataaacacaatggctcgaaaattaatttcgagaggtaaatgacaggaaaaaagcaaaattcacgcagcccagaaaggcaaaagggagaaagattgagcgcatagctaagagagccgacagaggctcaacgcacaagtctctaggacaaaagaacggaaagcgcctgcgagcagctagaaaggcgaaaatagcctaaacgaaggcatgaacgcaagacaagaagagagaggatacgagctgcccggggcgaggccgaatagagcccgagggaggcctaaaacagaagtggagcgctggaggggcagaagacaaatactcagtgtacacgtgaagcggacacccgccgtgaaaggccccatatggggtagagagtgcggaaaactcacgaggcggggaagaacgtccccgaagaagagtccaccctgagacgagatgagtcgagacttaccgaagacgagccggagtggtagagagcacccaacaacagacagagaaacactcaatagaaaaccacacaacgagacaacagcgcagcgagtcatacaaaggagcccgtaaatgtagtaagagatacggagaacggagcaacggagcacggagacaggagataggaagcacccgcgcgacata

SEQ ID NO: 564489 - DNA, 427 bp, Homo sapiens
agcggggaatcacttgagcacaggagggggaggctacagtgagctgagatccctccactgcactccagcctggaagacagagtgagagtgcagtggcgcaaactcagctcacagcaacctccctttctttcttttttttttttggaaaggaattctggctttgtggcccaggttggagtgcgggggtgcgatcggggctcagtgcaccctctctctcgtggggttcagggtagattctctggcttcagcctccgtgagtatgcgggaataccggggggtgataccacaaggccaagcataattttctcatttaattaagagagtgggtttcacaaggtgggcaaggcgggttctggacttcggggctccaagtgatcaaccaacttcaacttcctgggaattacgggattaagcaacaaggccaagc

SEQ ID NO: 564490 - DNA, 592 bp, Homo sapiens
tctgtacattaaagtggacctgtggagtgaaaacgctggtgataatatttagcccccgcagattcacacctttggaatactctgtggcccctatcacactggttccccccacggctcttcgcataattatttttacaccccgcccccgcgtatttgcagagtggtgtgttgccaccacccacaggagcccacacttgtttttctaccaacatcttctcggagtttaccctatatgttgggtctcccacacatatgtttcacaacacctcgttagaaatttcaccaaaagctcgccacctttcttctctcacacttcctcgcaccacacaataatattttctttttaaagagacatgcccccaccccccccccctctatggatgtttttacacgagacacaatagtagagagaagaccacacacgagtcctccttctcacctgatctctcagatttctctgccccatatatccccaattcgagacggattggtgtgccccctttggtcacccacccctctctaaaatatactgaagtcgatctattaccattttccaccgccccccgatcaaaatagacacacacaatataac

SEQ ID NO: 564491 - DNA, 225 bp, Homo sapiens
  misc_feature (37)..(37): n is a, c, g, or t
  misc_feature (182)..(182): n is a, c, g, or t
  misc_feature (217)..(217): n is a, c, g, or t
aattcgcggccgcgtcgacagaagacgacagaaggangggcaggggggacagagtctcgctctgtcacccaggctggagagcagtagcgcgatctcggctgactgcaacctccgactccccggttcaagcttcttctgccccaccctcctgagtagctgggactacaggcgcccgctgccangcccggctatttttttgtacttttttagcagaganggggtttc

SEQ ID NO: 564492 - DNA, 112 bp, Homo sapiens
gggtgtctccccacctcgctcacattatgcctacacgaacaccgacacatcaggtcctttgcagaagcgaagtcagggttcttcaagtcacaaagggaagcgcagagtaatg

SEQ ID NO: 564493 - DNA, 192 bp, Homo sapiens
atgtagatactgtggcattgatgatgcttatatccgggggggcccgatcctcggtacagctgtcaagagccgtccttctgacggatgcaggtcctgtgtctagcacgtgttagcctaggataatccgcaaatagcgagagctatgtcggtccaaagtagcacctcgttcttgcgaattacaccaaagcaagg

SEQ ID NO: 564494 - DNA, 620 bp, Homo sapiens
  misc_feature (331)..(331): n is a, c, g, or t
  misc_feature (362)..(362): n is a, c, g, or t
  misc_feature (373)..(373): n is a, c, g, or t
  misc_feature (414)..(414): n is a, c, g, or t
  misc_feature (455)..(455): n is a, c, g, or t
  misc_feature (464)..(464): n is a, c, g, or t
  misc_feature (597)..(597): n is a, c, g, or t
cctgtaactcaaaacaaaggaactcaccactgtccctctatcccatcaacagagagcaccatgagtgattctagggccccatgcaatggcttacggagcttattatgaggattggaataaatcctgagtgacacagacaggattcagcaacctgagagagggcatctagaaacatgagcttctgccatgtgaatggtctctgctatctttcaggtggtaactgtgtcgaggctaggagggagatgacaatcctgtacagctcatctactttgtaggaggatcaagatggagaaagactcagtgcagtcaagtcttcggacctgattaacanaatggacctccagagagcagccatcatcttnggttaccgaantcaaggtgtcattgcccagcgtaagtccctgaggtgttgtngtctgtcctgtgctgtgctgggcaccaaagccaggctcgtnctgacagtnagctctgaatgtaaagcattccgatgtgtgtataaccctgatggtgaagtgccagttgttaaaattcattcaccaagaccttctttatttggatttcaattgcttgtaggtttagcctccactgctgtttttnctacctagcattttgtaggtggg

SEQ ID NO: 564495 - DNA, 714 bp, Homo sapiens
cgcagacggaacaagatgactcagtacatcacggagctctccgacatggccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggtatgcagacctcccatgctttgttcatggcaacaacttcttagggaagggatctaaaacagaagccaacctgggcattgcaagaccggaagaggaggcttgcccagtaatgtcactgaatgactggattttccatgcatgatgccaggactccactccatttctgtgaactcgactgtaccatagtgaagttcagacatctgtctttcaaaagctaccctgatgattccagtgtggaccaactactgctccccaatgcgacccctgccaacaaaccccacgcataaataaaataaaataaaataatacaaa

SEQ ID NO: 564496 - DNA, 101 bp, Homo sapiens
ctctcaaaaactgctttgtagatgtcttgtgtacattcaagaattgcactttcctactatgacagagcatgctctaaaccctctaattctagaatcttgca

SEQ ID NO: 564497 - DNA, 454 bp, Homo sapiens
cgcagacggaacaagatgactcagtacatcacggagctctccgacatggccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtc

SEQ ID NO: 564498 - DNA, 135 bp, Homo sapiens
cttgacctcaagatctgcccgcctcagcctcacaaaggtgctgggattacaggtgtgagccaccatgcccctgccaacagtgattctttacagtgggttagggccttataatgaaccaagctgcttcacctgtgt

SEQ ID NO: 564499 - DNA, 865 bp, Homo sapiens
ggttaactagtgatttctacctcaaccgcgagagctatgcaaggacggtgtgtaccaattcgcgcccgtgacatggtgcccgccggcctgccggtctcccacccctggatcggcagaggccaggacggacgggagttccactgtgaatcggtggcacgcgccgaggatgctgacactggccagtctgctacgtgtcgatagttcgtagataaagtctttatccagttcgttaaatacagtataaacaattctgacttatacattccatctaagtggtaaaaggcaacttattgagcaacatataaatatctatatatgagagctctatataaagacacgtgtctgcagggcgggcccgcccaagcggattcgccacagcctgcccgggtgctatctcgtccccaggccgcggctgcttccacccgcttggtgctgactagacgctgacgacggcctgaacccgttctcggaaacgccgccggccggttcccccgacgcgctgctcccgtaccaaagtgaggcccgtcgccacacattcctcggaggcctccccgggctgagcccccttcctgagcgcctggcgccgtgccgtgagcttcttcacttttaccccggcattgtgaacccccgaggagtgttcaccctccggggcgtgggttgccgccttgctttgtgagcggcctgcgcggtgccgcgctggcatgtgtgcgcgtagcttctgtatgacggcgcggcccttgcccccgtgcttactttgctttcccggggccatgttcgagatccctggatgggcagcctgggggccttgggttcgtcgggaacccctatggggggctactacggggataatcaagtgggctttcgg

SEQ ID NO: 564500 - DNA, 219 bp, Homo sapiens
acgccagcgtgtccgcgcgcatccaggcctttgccgagcaggcgcagttccagctggtggaaaccttcgccgagcgcctggctcaagtgttgatgagtgaattccagattccctggctgcacctcaagctgaccaagcctggcgccgttccggctgccaagggcgtgggcgtggagatcgagcgcggatgtcgctaactcaggtttaccttggtcttgg

SEQ ID NO: 564501 - DNA, 660 bp, Homo sapiens
ggggcggagcgggatcgagcctcccgaggctgcgcatgggcccgcgccgcgcgcgctgtcacccgggcgcgcgggcgtgagcgtcatggctttgccggggccctgcgggcggccatgcgcgccggcgctggaggccctgctcggggcggcgcgctgcggctgctcgactcctcgcaatcgtctcatctccgccggcaggacgccagcgcccgcggtcccaccggcccgcggcgcccgccgccggcccctgcgacctgacctgctgctcttcgccacaccgcaggcgccccggaccacaaccagtgcgccggggccgcgctcggcgaccgcggtgaagcggaggctggacctggaaactgaccatcagtaactggcgagagcaatgggccagctcggggcagaggccgccatccagtgaacaggtgtgaacatccccggggtagaagtcaacgctatgagacctcactggaatctgaccaacaagcgcttcctggagctgctgagccactcgactgaccggtgtcgtccgactgaactgggctgcgaaggcagcagaaacgtgcagaagcgagcgccatctataaatcacaacgtccttgaagggcatacaatcaatgccaagaagtccaaaaacaaatccagtgaataggtcagcaaaca

SEQ ID NO: 564502 - DNA, 907 bp, Homo sapiens
  misc_feature (245)..(245): n is a, c, g, or t
  misc_feature (401)..(401): n is a, c, g, or t
ggaggaagatcgggtgtgatggtctttcgggagtaccgactccggatgtatacggagaggagaggactgcaccatgcggatcaggagacgacagcgtaccggagatccatggctcgtgactagctggagtgctgtcacacggtagagatgacagtcgagttgaactgttcttgtgcctggcaccccaagatcggcagagctcgagttgtggtgtgcaccaggagacgtgggctgaattgcacatngtgggaaggttgaagaggtgactgagaagggagctggacgtgatcacatgtagacacacgtaggtcatttaatcaagatgagagcgcaccaatcagttgaccgaggtcgcacttatgtgtctgcctgtgcaatctatcaaacggactcatgggtantgctactggagaatcatgacggggggcaattggatgacgagggtgacccagctcatccccaagactaagatccctggccaggggcgctgagcgcccatgcagtgtcgggttcagccccgattgcacgactcctcgccaacctggctcgggctgactcagacgtgcgaagatctggaggacgtccaacttgcgtccctgcatgactggagctagaagggataaaagagcgggaaccccggggagtcctcccgcggctggatgtggggctgcgccttctcgggggactcccagtacatcgtcactgcttcctcggacaacctggcccggctctggtgtgtggagactggagagatcaagagagagtatgggggcacccagaaggctgtgtctgcctggctttcaatgaccagtgtgctgggctagcctgtgacccctcgggactgctggtgcaggtgggtggcagctggagggacccatgcagcacccaggtcagagcagaccttccc

SEQ ID NO: 564503 - DNA, 204 bp, Homo sapiens
gtgtatccgaattcgatgagttgtgcgattcagcctggcctcgttcgaaggttgtcttggccagagagattgcctcctcgtgggctgttggcgatctcgtagtggacagacggaaaagttcatgtgccaggcccaggcggagtggggttgcgtgggctggcatctcgcttcttgctagatgtccagtggcctcctggttaggct

SEQ ID NO: 564504 - DNA, 165 bp, Homo sapiens
gtcgttctcatcttagagctttgcttggggcaaggtccctagtctgggctgggagactcagtcagaaattggtttgcttatcctctgggactatgacggcccctccctggggttgggggtgtgacaggcacagaagccgacccagggggatcacataaagagccc

SEQ ID NO: 564505 - DNA, 171 bp, Homo sapiens
ctaaagaaaaaaatgatataataaagtctatcatcaacttcagaatacagtagagttaatgacagtgtagtaactgtttataacagtttggaagtcactttgtatataagatggaattttggacaaaatcttaaatgatgagtggaatttagagacatagactgaaaaagc

SEQ ID NO: 564506 - DNA, 145 bp, Homo sapiens
cacgacagacataaacctatactaagtccataaacacatggacaggtagtgtgactgtcgcgactagtaaaatagtaataatctatcattatgttcctgacctggttgacgatccctactttacggctatactgacctcattctt

SEQ ID NO: 564507 - DNA, 202 bp, Homo sapiens
gcaccttaactgtttttaagtgtgcggttcagtggtgttaagtatatttacattgttgtacacccaatctgtagaactttttcatcttcccaaactgaaattctctatacgtgaaataataactcctcatttaccctttcccttagcccctggcaaactccatgctactttgagtccctatcaaaagacgagggtaccgagt

SEQ ID NO: 564508 - DNA, 1623 bp, Homo sapiens
  misc_feature (1600)..(1600): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtccactgtgtcacttctgttttcctgtccaatcatnctgttgtctgctagcaggtaccg

SEQ ID NO: 564509 - DNA, 409 bp, Homo sapiens
taccgacggggtggtatggtggagctggtgacaatggtttcgtgtactacatagtgcacatgataaagtggccttaaactgtgattctttctggtaggataatgttatacataagactcgaccctaaatgaatgccatggcttttaaactcgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagcctactcagagtctgctttttccatcgctcttcccaggtttcttttgcaaagcttggtcttttggcccaggtcttcctg

SEQ ID NO: 564510 - DNA, 1572 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctgtcccactgtgtgcacttgctgttttccctgtccacatccatgctgtacagacaccaccattaaagcattttcatagtgaaaa

SEQ ID NO: 564511 - DNA, 1648 bp, Homo sapiens
  misc_feature (1503)..(1503): n is a, c, g, or t
  misc_feature (1509)..(1509): n is a, c, g, or t
  misc_feature (1539)..(1539): n is a, c, g, or t
  misc_feature (1569)..(1569): n is a, c, g, or t
  misc_feature (1581)..(1581): n is a, c, g, or t
  misc_feature (1587)..(1587): n is a, c, g, or t
  misc_feature (1603)..(1603): n is a, c, g, or t
  misc_feature (1605)..(1605): n is a, c, g, or t
  misc_feature (1627)..(1627): n is a, c, g, or t
  misc_feature (1647)..(1647): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggacgccacggccgacgaacaaggggagttcgaggaggaggcagggcgaggacgaggcttaaaaacttctcanatcaancgtgcatccttagtgaacttctgttgtccncaagcatggtctttctacttgtaaactacngtgctcagtttngcctcngttagaaattcacacngntcgatcgtaatggatcgtcggnactcctctaaaaaattacang

SEQ ID NO: 564512 - DNA, 1739 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgtcttacggtttcaagtggt

SEQ ID NO: 564513 - DNA, 563 bp, Homo sapiens
  misc_feature (369)..(369): n is a, c, g, or t
gccgaatatgttcattgtaaagcccatatacccttaaaagtcactggacgtccacgtatggtaatgtggtcacaatcagtattgtttctctttagtgaattcatgatttattcaaggtaacgtccaaggttcagaattttcagaaacaggtttgccaacgacagggttatattgcaaaactttgccgtgaagtttactcgtaggtgcagaagtaagagacaacttagatcaagtgaaggaaggggtaacagagttagaaatggctatctacactgatggacagtaagtatactaatgtagagcaggtaacaagtccccacgatgtataacatattcttctctaaaagctcacaaggaagttatgtgccnacttccgatcccctttcccagcagatggtaatggatgcaatttgcagaatagaacacttcgattgacaacaagtcactggaggtcctctggggatgcaggttaaaagcccaggatcaggccaggtgtggtggctcacgcctgtgtaatcccaggactgtgggagagtgagacgggcagatcacctgaagtcagg

SEQ ID NO: 564514 - DNA, 691 bp, Homo sapiens
  misc_feature (430)..(430): n is a, c, g, or t
  misc_feature (668)..(668): n is a, c, g, or t
gcagaaaagtcatccacgcccgtggcgataatcgccagcatactgacaataaacaccaatgcataggcggagaaaaatccccaaacggcttcgaggatacgttccggcagtgcgcgattccccagcttaatgctatagacggcgttcggatgcaccagtcgtttcagctcacggttcccctgcttaaacagcagcaggatgcggatcaccttcaggccaccgcccgttgacccggcgcaaccgccgataaaggctgaacataaaagcagtaccggcaaaaagagcggccagcgggcaatgctgtcagttgtaaacccggcggttgtcgccatcgacaccacctggaaaaacgcctggttaattgtcatcagcgccgaactgtagacattatgaaaccacagtacgagggtacaaataaccaccagcgtanactgtacgccgataaacatgcgaaattccggatcgcgccaataaaccttcagactacgcccacttaacagtgaaaagtgcagaccgtagttacagccggagatcagcaggaagatagcaatgatagtggtaataagtcggctatcgaaataaccgatacttgcatcatgtgtcgagaagcccgcaataacgatagtcgcaaagctttggccgttgggcatcaaagcattcatttcggnaaaaacacaacggcagggcacaa

SEQ ID NO: 564515 - DNA, 1647 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564516 - DNA, 230 bp, Homo sapiens
aagacaataggagaattgaagacgagacttagaaagaactagacacaatcgtaagaggggttcgttgaggcacgtcggcttctgatgtctagatgagtcccctgtaggtcagagacaatgtcaactgtttacgtatcaggtcagtgaggggacagcgcaccagtgatgagtgagagattcgaccgttatcgcagtttgagttcccagtgtgtgtcgtgtagtacacacac

SEQ ID NO: 564517 - DNA, 118 bp, Homo sapiens
gactatgtgcgctgacggaactcaggtctgaacatcaggaaggtggtgactgtcagacatcaggctgtgacccggaagaaggacaaccgctttgctgtggccgttgactcagaggggt

SEQ ID NO: 564518 - DNA, 849 bp, Homo sapiens
ccttttgttcgctacatcctctctgttgggtctggtcgacaacccctcctcaggtgatctggccaaccaactcgcggcgtttacatccggctccccccatctcagtgagtgcgccccaacaaaggttcgtcactctcttccctcggggggttttaatcgctcgcgcctaatgttgtgtcccctctcgtatattagagccccccccttttccgtccagggggccacacgaagaacctctctggccactagaaccctgggggggcccccccccgaaaatggcggttctcctaggaagtagtgcttgtcctcgcgttcgcctcgctgtcgctcccagtctttcttgccacgcagtagcgttgctaccccgagacgaggttcctcctgcgagaatccccactggtactgctcccacggcgctctcgttttctaccccgcgctctattgcttcttcttccggagactactttggggcgcccacccctctaatactcgtctctaccccttcttctccttgtgtggcgcggcgcaccgcccgccgcggcatacccccagagcttctcctcgtaaagaacataagagttgtttcaccccctggaccctcagaactgcaccattcgtgactcatattgtgtccccccctgctaggggggagcctgcggctgcctctcgacttaagagcatccttctgtgcccgccgcgcgcagtagcccctcctcacaaatgtggggcgagcgcccgcccttggcagagacgaacaactgccgcctccccctgggtggataaccaataacccgcgtccccctggggtttttgcccataaaaaacccctttttttttcccaacaaaaca

SEQ ID NO: 564519 - DNA, 1462 bp, Homo sapiens
  misc_feature (1308)..(1308): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcacaggcaggccatcaggagcgtcaagcgccttcgagcagtcacggcangtcggggcaaggctctggcaggtaccggggggtgggcaagggtcggaggcaacaagagcgggcgtccggccggtcacggggggtcgggggcagggcaccgggaggagaaaccggcaggtggcccgcttaaaactgggcgcccactttgtggacg

SEQ ID NO: 564520 - DNA, 1739 bp, Homo sapiens
  misc_feature (1146)..(1146): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggacgagcagatgctnaccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgtcttacggtttcaagtggt

SEQ ID NO: 564521 - DNA, 126 bp, Homo sapiens
taaggatcccccgtccgcgaagcacaaaatgatcgccccacgctgcgccatcgcggccggcaagctcgccatgcgtgggccctctgccgccgcctccaacactctctccctcgcatgcagcaggcg

SEQ ID NO: 564522 - DNA, 1585 bp, Homo sapiens
  misc_feature (1146)..(1146): n is a, c, g, or t
  misc_feature (1568)..(1568): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggacgagcagatgctnaccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggacgccacggccgacgaacaaggggagttcgaggaggaggcagggcgaggacgaggcgtagatgcccccgcgagacgggttagggaaagcggaggaggaaagcgagggggtggggggctccccgggacgaaaacccnccaggggaaggaaagaa

SEQ ID NO: 564523 - DNA, 1052 bp, Homo sapiens
  misc_feature (956)..(956): n is a, c, g, or t
agcgggtcgcttccacaggcaagccgtacagcgccggcggttgtggtgccatcatgctgtctcctgatccctgaatgagtcccatgcttatgctgctgagtacgtcaacaccgaacatcggagtggcgcggacgggaaaatacccttatgacgatcattgaccgatgtgactggatggttgggcctgagactagtatatctacacttgtgcggtgcttgcagcgcaaatgactgatcgagttgcacacttcgattcgatacaatcgcgacgagacacggcaagctccaggtgaaagagcactcgtacgtgttcgtgtacaacagttgggtcgaactcccagctcgatcttattggccaggaaattgcacgacgtctctacgcttaagccaatatggaatccgccgatttacctcgcgctctacctgtagacagagcgattgaccgaagcatcccggagtcgtactacgcgcattggcccacagaaatttagtagagccgcagcggaacgcctagggtctcataatgcgctccttggcgccaagcaatccataagccatccagcgcatagccaaacgaacccccttggccgcagcccgaaaacattgtggaccgccaacgccattccacgcgggcccccctctaacgttgaggggcccctcgagcgattccaaactttctcactgggtcgagcgctaggccttagacggatttcgctacacagaaaaagcgcaggcgaacgagcgaatccaacaaccgcgatggccaacggcgagcattgggcatgccggacgcccgtctgaagccaccctggagcaaccacacggttttgacgccattgacttggttccccccaccagggaacaccgagaagcatcatattgacaaacgattcaccttcagtttgacaatgaggccccctggtagtggctcaatcccatagagagtcgcaacaccncctgacggacgaaccattcagcggcacttgcgcatcaactgttccagtttaaacggcgcaacaagtaatatgagcaacgagagcacacagcctcga

SEQ ID NO: 564524 - DNA, 1333 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564525 - DNA, 1660 bp, Homo sapiens
  misc_feature (1637)..(1637): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccacttgacaggcggggcagccaggaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactgtgtcaccatggctaacatcagtgagtcgaagagagccactgcgactgtagtataggatgattcactgcgtggtccgagtacgcaatcatgatatgtacctggtggtcagagtaccagcagtaccagagatgtccacagtccgtacggtacggatggagcgagttccgaggaggaagtgcctgaggagcgagtggcctagagccttcagtcactggggaaagcagggaagcagtgtgaactctttattcactcccagcctgtcctgtggcctgtccactgtgtcacttctgttttcctgtccaatcatnctgttgtctgctagcaggtaccg

SEQ ID NO: 564526 - DNA, 204 bp, Homo sapiens
  misc_feature (93)..(93): n is a, c, g, or t
  misc_feature (154)..(154): n is a, c, g, or t
  misc_feature (183)..(183): n is a, c, g, or t
ccacatcccagctaatttttgtatttttttgtagagatggggttttgccatgtccaggctagtctcaaactcctggcagattcaagcagtctntccgcctcagcatcccaaagtgctgggattacaggcacaggcatgagccaccatacccggncgtccagttctttttaatgcagtatcctntatcatattcatagggtcaaa

SEQ ID NO: 564527 - DNA, 1555 bp, Homo sapiens
  misc_feature (1046)..(1046): n is a, c, g, or t
cttcttcgcttgttgtgtggttgacctagttggcgttggtgttcaggctctctatggtgatctgttagtgggtgttgctcctgctggctcccagtgtgtgttcctgcttggggagttgtggtactgtgttttattatctcctgcttgtgggggctcctccgcgctgattgttggtggtgcctcatactgtctgttgggtcccccactgatgatatggtgggtgtgttactaattttttccgggagcgggattgtggaatgttttgcggctagaagcttggccccatagtttttggaggactgctccccgcggagggcaccctggtggtgccggggccgctgctattgttgccccgctgtgcctgaatcccctccgcttgtgtttttatccgttttgtttgggatggaggatcctcccctgtgggtgccccccccatcaatgtgttttgcttcaccaggggttgaccaatagtctgtgtcggcgccggatattggctcttttgaaagttgggggggtcgttccttttgctccttgttggggggtggctcccgcgcccacgcgcacaaggtggtgtgtagtagaacacccgctatcgtgtgggtaccgtttggtgttgtgcgccccgtctatagggggggggctacgagttttttttgcccctcttagaaaaaggagggcttcttcttgtacaaatttttttgcctctctttggtgtttgcgcgcagaaaacacagagcgtgctgtgttataaaatgttataaaattttcgcgggggtaaagtaagtttatacacccagcttaacacatgtgtgtgtcaccacagtgacccctcacaataaagagaataaataagatcccccccccgtatagaccgccacgctgtgtgatgtgtgttataagcattagtctcaatgttgtcacacagagagagacactttgtctcccagagagactttcacacacacacagtgtccccagtctctattatgagttgtcgcacagacccccctgggtcccacagattttgagagttctctttacacacncccccactgtgacactctctcttgtccgctctgtgtctgtgtctctctggagaaataaaaaactgtagattgtagaaatttggctctgttgctctgtgttgtttgtaacactcgagagtgtgaaattgagagagattgaatggtggtgttgttcacactcggagagtttgtgagtgcttctctcacacacttccctgccacctcttaacccacatattgagaaatatgaaacctctttggtgctttatctgaagaatgaggaataatgtttgaagagatgccacccgcttggagataaatgtgggagaaatgaccatctaagctttacctggtccacccacgtgatagtgatccagaagccttgaaatttaacaccttttccaccttggttctttatactgaatgcccgactctgctctgtgttagagatatgaaatggtgtttgatactgtttgagaccttatggagagatttaattatttgtaataacaagatttgctcccgtctga

SEQ ID NO: 564528 - DNA, 203 bp, Homo sapiens
gctggcggtcgagttctatgaggatccccccagatgctgcttcgtgaaatacacagaacgagtacagtccctcatctggtagctaaaatcatgaagatcattgttgataccctaagggcttcttcgaatcaatgtggactgtgtcttccctggagccctgagtggctgaggcgggagttgatagctgtaacaatggggattca

SEQ ID NO: 564529 - DNA, 156 bp, Homo sapiens
tcatagctggcacagcttcgtatgcctctatataaaaccatacaccttaacaatattaaaacaacatctgactccaagtaaactaatgctctatacccactccaatattacataagagtatctttggcccaaagagaaccaggtacacacttacag

SEQ ID NO: 564530 - DNA, 573 bp, Homo sapiens
tgtgattattcaatttcatccaaagacttccatcgctgagaatattcgtactcaaatcgtgccatagctgaggcacaaacgaggaaggagtttctctctcctttagatacattggaaacatctgggcaagtttttcagagaagaccatcttcatcatctagttgttaaagtggatacacaatgactggaagaagagttgtcgtcagtaagaaaacaccttcactgacatcgttcaaatgcatatcttgctgatggcatagaagcaaattcaacaatgcctttccctgtagatcttccacgatcatccactattacaacagcacttatcaataggaccaaattggctaaaggcttcttccagaagttccatggaaacatgaggtgaaagatatcggacaaaaaaggggaaagagaaattttggaaaaagcgaatccgaaagcgtagtacctctcaaagggggatacatccagattcggctttggcaatttcaggcgaagctctaagattccagcttaaaaaatccgaacccaatgcctatgtttgataaaacatctcctgggtccccatattta

SEQ ID NO: 564531 - DNA, 1176 bp, Homo sapiens
agtggaggccggacgacaggaacaggttgagacatgtctatccctcccttatctagggaagtactcccacccgtggagccgtcgctgtagacccatcaaaccaatcttctccgttacaccttagcaggtgtctcctctatcttaggggccatcgaatttccatcaacaacgattatcaatatgaaaccccactgccataacctcgaatcagcaaacgccccatctacgtctgatcgcgtccgtaatcgacagcaggcctagttctcctatctctcccagtccttagctgcgtggcgatcgactatactagctaacaggaactgcgaacactcaaaacacaacgttcttcgacccctgccggaggatggagacgccccgattctatagcaagaacctattctgatctgattccggatgcatcgcctgaaggttatatatagcgtatagtactaccaggctgtctgtgactaatcttcccatattgtaacacttacttactaccggcaaaagcgacagaaccacttttggataacatcaggtatcggacatgaggctatgcactatcacatctgggctaccacgaaggggtttcattgcgtgatgaagcaggcacccagatatacgtacacagcagtagggggatatgaccggctggaagacaaagaaggcaatacttgacaacatcccgtataccaactagaatggagtcgcatattcgcccgacgcggacgtacacaagctaagtttagcttgacttcggccaagagttccgagacaaaagcaagcagtacaaatggagtcacggcaatgccacggaggcatctgaaagaccccataaggcaacacaaaagaagacctgagcacagcccggagggctggacccgacagcggagcaatgaccacaacccgcaccacactacagccggaagaaataggaacaaccccaggaacacgggagcggaccggggtagggaaaacggacgaaaaaggtcccgaaagagacagcagaggggcgcaggacaagccaaggagggaagagagacgtgacaacccgaagtacaccaggcaccaaactaagaagagcccgacggcgaacaccaagcgaacataagaataagcgggggaaaaagaaggaacagccaagcacgtccgcgatccgaaggccgagatagtgcc

SEQ ID NO: 564532 - DNA, 367 bp, Homo sapiens
  misc_feature (359)..(359): n is a, c, g, or t
tgagatggagtctcactgtcacccaggccggagtgtagtggcgctatctcggctcactgcaaccgctgcctcccaggttcatgcggttctcctgcctcagcctcccgagtagctgggattataggtacgcaacataacgcctggctaatttttgtatttttagtagagatggggtttcaccgtgttagccaggatggtctcgatctcctgacctcgtgatccacccacctcggcctcccaaagtgctgggatcacaggtgtgagccaccacgcctggccgcctaaatacttttcaattcatctttgtaactgttaactgttcaggaacagtatgcacttctcaagggctgtcctgacangtggattc

SEQ ID NO: 564533 - DNA, 123 bp, Homo sapiens
agacatcgagcataacttcatctctttcttagttacagaaaaatcctctcgtaaccgacatgcacagggttatgggatccgtcacccaacgctctcatcaacctgcgggggaaactgtgttct

SEQ ID NO: 564534 - DNA, 558 bp, Homo sapiens
aaaccatataggctaggtagagctggtgtgatcggagaggttacgcggcggtgcgctctttacctcgtgatcggttgtctggcgcgcgagggctcacggtcgcagtccgagaacctgccggtggtgcgcatccagtgctctacagggcgttggacagcggcgagcaggcggggacctccgaggcggtgctggtcgaccggacgtgctggttcggcgcggcggcggagttgaccagccggcgcgcctcacactgtgccgttgggagcgcgcgccgtagcctctcaaggctggaagagtcgacgcgcgcgtcgggaccacttctccatcgagcgcgcgcaacaggaggcgccagcggtgcgaaagctctcgtctaagggcagctttgctgaactgggcctggagccccgtgttgctgcacgcaactacaggaggctgcgcctgaagtcgttcaggcccacaaccgtgcagtctagcaccatcccctcactacttcgacggccgccatgtcgtttggcggccgcagaaaacgggcagtggcaagactctcaactacctcct

SEQ ID NO: 564535 - DNA, 165 bp, Homo sapiens
agattacatagcaagacttactactgtcaacacgttgatagtgacccgctcattttcgtgcggagggaccaatgtggatgtcaaaacgaactgtggcgtgcaccatctgtcttcatctacccgccatctgatgagcagttgaaatctggaactgcctctgttgtg

SEQ ID NO: 564536 - DNA, 337 bp, Homo sapiens
  misc_feature (288)..(288): n is a, c, g, or t
ctctactttgtaagatgaccataatactctcactctcttaaatcactatctggcaggcggctgtcgcacgcctgtaatcccagcactttcggaggccgaggcaggtggatcactggaggtcaggagttcgagacgagcctggccaacaccgtgaaacccccatctttactgaaaatacaaaaaaattggccgggcatggttgcgggcgcctgtggtctcagctactcgggaggctgagacaggataatcgcttgaacccgggaggtggaggttgcagtgagccgagantccaacgctgcactccagcctgggtgacagagtgagactctgtctcaaa

SEQ ID NO: 564537 - DNA, 398 bp, Homo sapiens
  misc_feature (53)..(53): n is a, c, g, or t
  misc_feature (75)..(75): n is a, c, g, or t
  misc_feature (104)..(104): n is a, c, g, or t
  misc_feature (107)..(107): n is a, c, g, or t
  misc_feature (118)..(118): n is a, c, g, or t
  misc_feature (122)..(122): n is a, c, g, or t
  misc_feature (128)..(128): n is a, c, g, or t
  misc_feature (132)..(132): n is a, c, g, or t
  misc_feature (156)..(156): n is a, c, g, or t
  misc_feature (160)..(160): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (269)..(269): n is a, c, g, or t
  misc_feature (295)..(295): n is a, c, g, or t
  misc_feature (316)..(316): n is a, c, g, or t
  misc_feature (336)..(336): n is a, c, g, or t
  misc_feature (368)..(368): n is a, c, g, or t
  misc_feature (371)..(371): n is a, c, g, or t
  misc_feature (379)..(379): n is a, c, g, or t
  misc_feature (389)..(389): n is a, c, g, or t
  misc_feature (392)..(392): n is a, c, g, or t
gaaattcggccataagggccgggaaactcggggggggccattgggcaaaccanacttggttggaactcgggcgcntggtttggtttttcttcggaaaccatgtntgncaaacccgatngggntgaaancganaaattcgataggtcgaacctgaanaagncggagacgcaggagaaaaatccacggctttccaaggaaccgatggaccaggagaagcaggcaggcgaatcgaaaggaggcgtgcgccgccaatatgcncngnccattcnacaggcatggccttctaatttaactnctttaagcggttaaactttgnaggaggcaaagaggttggancaggtttgcctttccaatcggccaatcaatcngcntgccaggnaaggaagganctngcttgt

SEQ ID NO: 564538 - DNA, 2885 bp, Homo sapiens
  misc_feature (657)..(657): n is a, c, g, or t
  misc_feature (1758)..(1758): n is a, c, g, or t
gagagggaagtggcgtggcttcaacagactttcttttgcctgtctttgtcccagagcctcttccctggccctgctgagaccactgctctaagaagagaccaccagactgagagaggactcccagctgccctcagagcggaggccgagtgctgcacagccacagctgctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcantgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcacagtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagggacaaacaaaacacagggactctgccctcctggagccgacatctggtgagggagagacgcagactctagacagatatttccaaatagcaggtaagtgctataaacaaagggaaacagggtaatgggatagagtgacagggggngggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatctcaaagctgctgtcccaaagacaaagcaaaggggacccagctcccttgggtggctcctagatgctctgctgcctgaccaccagagggcagcagtgctccttctcttccaggctgagcagaaagtggatgctcatgaacgttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggagtctccctccctgcagattccaaggctggaatctttttcttctggctccaggcagcacagacagggcctagcctggagagggtggacaagatgtcctctcagggtcttcaatggccaagtccaagcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttg

SEQ ID NO: 564539 - DNA, 166 bp, Homo sapiens
ctgagatgagtaggcaatacatgtccccgcctctcattcgtcgcccttcccggacggttccggtgacgattcttgccgtcttgctcgtggcagccggggtggtggccatcattgctgccattcaacgactccagcacggatccttgccgggatggttggcctgggg

SEQ ID NO: 564540 - DNA, 2759 bp, Homo sapiens
  misc_feature (1632)..(1632): n is a, c, g, or t
gagagggaagtggcgtggcttcaacagactttcttttgcctgtctttgtcccagagcctcttccctggccctgctgagaccactgctctaagaagagaccaccagactgagagaggactcccagctgccctcagagcggaggccgagtgctgcacagccacagctgctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaagtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcacagtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagggacaaacaaaacacagggactctgccctcctggagccgacatctggtgagggagagacgcagactctagacagatatttccaaatagcaggtaagtgctataaacaaagggaaacagggtaatgggatagagtgacagggggngggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatctcaaagctgctgtcccaaagacaaagcaaaggggacccagctcccttgggtggctcctagatgctctgctgcctgaccaccagagggcagcagtgctccttctcttccaggctgagcagaaagtggatgctcatgaacgttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggagtctccctccctgcagattccaaggctggaatctttttcttctggctccaggcagcacagacagggcctagcctggagagggtggacaagatgtcctctcagggtcttcaatggccaagtccaagcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttg

SEQ ID NO: 564541 - DNA, 401 bp, Homo sapiens
  misc_feature (53)..(53): n is a, c, g, or t
  misc_feature (75)..(75): n is a, c, g, or t
  misc_feature (104)..(104): n is a, c, g, or t
  misc_feature (107)..(107): n is a, c, g, or t
  misc_feature (118)..(118): n is a, c, g, or t
  misc_feature (122)..(122): n is a, c, g, or t
  misc_feature (128)..(128): n is a, c, g, or t
  misc_feature (132)..(132): n is a, c, g, or t
  misc_feature (156)..(156): n is a, c, g, or t
  misc_feature (160)..(160): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (215)..(215): n is a, c, g, or t
  misc_feature (241)..(241): n is a, c, g, or t
  misc_feature (262)..(262): n is a, c, g, or t
  misc_feature (282)..(282): n is a, c, g, or t
  misc_feature (371)..(371): n is a, c, g, or t
  misc_feature (374)..(374): n is a, c, g, or t
  misc_feature (382)..(382): n is a, c, g, or t
  misc_feature (392)..(392): n is a, c, g, or t
  misc_feature (395)..(395): n is a, c, g, or t
gaaattcggccataagggccgggaaactcggggggggccattgggcaaaccanacttggttggaactcgggcgcntggtttggtttttcttcggaaaccatgtntgncaaacccgatngggntgaaancganaaattcgataggtcgaacctgaanaagncggagacgcaggagacgaaaggaggcgtgcgccgccaatatgcncngnccattcnacaggcatggccttctaatttaactnctttaagcggttaaactttgnaggaggcaaagaggttggancaggtttaaaggacggggctgcccttttaacatcaaggaactactgacaccgaaggccgggcctgcctttccaatcggccaatcaatcngcntgccaggnaaggaagganctngcttgt

SEQ ID NO: 564542 - DNA, 3005 bp, Homo sapiens
  misc_feature (777)..(777): n is a, c, g, or t
  misc_feature (1878)..(1878): n is a, c, g, or t
tggcactccaggctgcctccaagagcaggttggtagagctgagggatgagagatttgcctgtcctggagagtcaccacccttccagctttggggaggcccccaggaaagtgagggagaagatatatgaagattgctgaattacgtgcctccttcggagaaccccacccagtcccgggcccaggcagtaacttgcccattggaaaggggaaagcagaggccacactcagtgacaatggccacaaggaacattggctagcatgtggatgacctctgtttccttacaggctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcantgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcacagtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagggacaaacaaaacacagggactctgccctcctggagccgacatctggtgagggagagacgcagactctagacagatatttccaaatagcaggtaagtgctataaacaaagggaaacagggtaatgggatagagtgacagggggngggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatctcaaagctgctgtcccaaagacaaagcaaaggggacccagctcccttgggtggctcctagatgctctgctgcctgaccaccagagggcagcagtgctccttctcttccaggctgagcagaaagtggatgctcatgaacgttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggagtctccctccctgcagattccaaggctggaatctttttcttctggctccaggcagcacagacagggcctagcctggagagggtggacaagatgtcctctcagggtcttcaatggccaagtccaagcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttg

SEQ ID NO: 564543 - DNA, 106 bp, Homo sapiens
tcttgactggatttcttgaatctcctctctctcttttcttagacatttaagacacttatggatttgttccctatagggagcaaatccataagtgtcttaaatgtct

SEQ ID NO: 564544 - DNA, 2970 bp, Homo sapiens
  misc_feature (657)..(657): n is a, c, g, or t
  misc_feature (1758)..(1758): n is a, c, g, or t
gagagggaagtggcgtggcttcaacagactttcttttgcctgtctttgtcccagagcctcttccctggccctgctgagaccactgctctaagaagagaccaccagactgagagaggactcccagctgccctcagagcggaggccgagtgctgcacagccacagctgctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcantgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcacagtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagggacaaacaaaacacagggactctgccctcctggagccgacatctggtgagggagagacgcagactctagacagatatttccaaatagcaggtaagtgctataaacaaagggaaacagggtaatgggatagagtgacagggggngggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatctcaaagctgctgtcccaaagacaaagcaaaggggacccagctcccttgggtggctcctagatgctctgctgcctgaccaccagagggcagcagtgctccttctcttccaggctgagcagaaagtggatgctcatgaacgttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggagtctccctccctgcagattccaaggctggaatctttttcttctggctccaggcagcacagacagggcctagcctggagagggtggacaagatgtcctctcagggtcttcaatggccaagtccaagcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttgtttttaaagaaaacaacatcatattacacaacagatcaaaaacaagtacaatacacaaaaagaggggagcgaatcaaaaatcacg

SEQ ID NO: 564545 - DNA, 520 bp, Homo sapiens
ctacacgtcatcttccttcagtcgctgagtattcacaccggcaccaagagcctggtggttgggtgcaatagggaaagcatcttagccccatagaacgtgctggacagtgcagatctggaggcctgctgaggcaccgcgtgccagcctctccacagtgtggccagcagggtggggtcaatatgtattgacacccatctctgtccacatacaccattcctaaggaccggagggtgcgtctcctaaaatgacgggcatccctcgcatgcacccaccgtcagcacgccggacagcggctgcagggaatcccgtgtcatctgtgtccaggccgtgttcccagctccagaattgtctcacaagtgtctctcatagctggtttttctcagactggaatccaaggttcatattccatctggttattaatgtctctctagcttttcttaagatataatgggcacgtagtaaactgcaccacttgaagattctgacccatacaaacactcatgaaagcatcccgaacgtt

SEQ ID NO: 564546 - DNA, 137 bp, Homo sapiens
ccagaaccgccgacgcgcgaagcgcaaggacagggctcgggcttcctcatttcgtccgacggctacatcgtgacgaacaatcacctggtgcagggggcccgcgggtccggcacggtggatcgcgtcacggtgacgct

SEQ ID NO: 564547 - DNA, 1232 bp, Homo sapiens
  misc_feature (657)..(657): n is a, c, g, or t
gagagggaagtggcgtggcttcaacagactttcttttgcctgtctttgtcccagagcctcttccctggccctgctgagaccactgctctaagaagagaccaccagactgagagaggactcccagctgccctcagagcggaggccgagtgctgcacagccacagctgctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcantgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatcctctccaagattatcatattgggtgacacaactttgaagttacagatctgggacacggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttgtttttaaagaaaacaacatcatattacacaacagatcaaaaacaagtacaatacacaaaaagaggggagcgaatcaaaaatcacg

SEQ ID NO: 564548 - DNA, 644 bp, Homo sapiens
gactgactctgagtgacaaggccctcatgaagcggctccgagacgcaggttcttcgtgagttcctcgcaggtgccggtcagatgctacacattgagaacctgaacatgtgaggccgacccctggccagtacctggtgcaactggcaccatgctccaatggagctcctgaccaggccatcatcacgcatccgcgtgcgcaggtcaccgtggacgccctctggcccttccgtgggcatcgtggctgacggtgctgggtgctggtcaccaatcatcttcatctacgagaagcgcccggaagccctgaggacgtcctggatgatgacgacggccggctctgcaccccgtgaagagcagcgggacagcaccaggaaatgacaaaggccaacgaacgtcctgccagagggaactcttcctgaagggccaggtggcccggaggacgcttcccatggtcctgcgtctggcagccggccgcccaggagttccacatcccaagtgcttgcacagattccacagttctcacactcttagccgcaaacacccaaccaccgtaaatgcccatcatacaccttcacttctacatgcaaaaaaagtagggatactctccaattcaggattctgttccttaagaattattaccttctgag

SEQ ID NO: 564549 - DNA, 186 bp, Homo sapiens
tccctactcgatccgtgatccagcagaggcacatcaggagggtgtgattgctgtagagtccctggtgaaagcgattatcaagtacctccttcaggaacaatacaggtaccttatgtaatcctaataagaagatgtttgttgtgctatatgacctatgagatatttgctggatcagcggatcgagtt

SEQ ID NO: 564550 - DNA, 181 bp, Homo sapiens
catctacttcgaaccaaagccatctgagcatgcagattgtggtgtggccgcgggcgtagcagtcctggacacaccataccctgtgtgagggcacaaccacggccacggacacccttctattcctcgtgtattgtgtcatctccctcttcctagcccctccttgagggggtactccttcctt

SEQ ID NO: 564551 - DNA, 288 bp, Homo sapiens
tgggggggcggggttttttaaaaaccaggttggggttttttcccccccgggcggttttaaccgggccttttggtttttgggcccgggggtttttggggttccttttcggaacttttaacccttttttgggggggggggggatgggttttttaatttggccaggggtttctctaattcttttcccttttaaaaaaggggggggggggggggggggggcaggtccccccctttttttttcccgggggggccccttaaccttttttgccttttgggggtggttccccccca

SEQ ID NO: 564552 - DNA, 1050 bp, Homo sapiens
  misc_feature (974)..(974): n is a, c, g, or t
  misc_feature (996)..(996): n is a, c, g, or t
  misc_feature (1006)..(1006): n is a, c, g, or t
  misc_feature (1008)..(1008): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgancagccgggcagccagagtacgngcgctgacgngnccgagtcaccagcaaagaacacacgccagcacaagaacaggg

SEQ ID NO: 564553 - DNA, 204 bp, Homo sapiens
ccccccgggggggggggggttttttttcagggaaattttgtgccccccccctgggcgggccccgctgggggcccccctttttacccaatttcctttaaaaccccttttacctggggcccggccccccttcccccttttttttttcccatttttccaaagggggttagttggtttttttttttaaaaggaaaacccccttgggga

SEQ ID NO: 564554 - DNA, 1639 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564555 - DNA, 1079 bp, Homo sapiens
  misc_feature (973)..(973): n is a, c, g, or t
  misc_feature (997)..(997): n is a, c, g, or t
  misc_feature (1041)..(1043): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccactggctgggctttccagggcagtcaatgtgactggggaagctggtgggaacatggtccgttcccggtggacttcttatgccggtttgcccatgacagcggggccaganacgggcgacgggcggcccccgatntgggcacaacttggtggtggaccccaggcgataaggcgggaggnnncaagggggcacccacaacgcttggccagagggaccg

SEQ ID NO: 564556 - DNA, 517 bp, Homo sapiens
  misc_feature (49)..(49): n is a, c, g, or t
  misc_feature (61)..(61): n is a, c, g, or t
  misc_feature (65)..(65): n is a, c, g, or t
  misc_feature (68)..(68): n is a, c, g, or t
  misc_feature (73)..(74): n is a, c, g, or t
  misc_feature (79)..(79): n is a, c, g, or t
  misc_feature (82)..(82): n is a, c, g, or t
  misc_feature (109)..(109): n is a, c, g, or t
  misc_feature (121)..(121): n is a, c, g, or t
  misc_feature (164)..(164): n is a, c, g, or t
  misc_feature (205)..(205): n is a, c, g, or t
  misc_feature (254)..(255): n is a, c, g, or t
  misc_feature (258)..(258): n is a, c, g, or t
  misc_feature (260)..(260): n is a, c, g, or t
  misc_feature (267)..(267): n is a, c, g, or t
  misc_feature (271)..(271): n is a, c, g, or t
  misc_feature (282)..(282): n is a, c, g, or t
  misc_feature (286)..(286): n is a, c, g, or t
  misc_feature (300)..(300): n is a, c, g, or t
  misc_feature (321)..(321): n is a, c, g, or t
  misc_feature (329)..(329): n is a, c, g, or t
  misc_feature (332)..(333): n is a, c, g, or t
  misc_feature (340)..(340): n is a, c, g, or t
  misc_feature (369)..(369): n is a, c, g, or t
  misc_feature (372)..(373): n is a, c, g, or t
  misc_feature (376)..(376): n is a, c, g, or t
  misc_feature (382)..(382): n is a, c, g, or t
  misc_feature (395)..(395): n is a, c, g, or t
  misc_feature (400)..(400): n is a, c, g, or t
  misc_feature (410)..(410): n is a, c, g, or t
  misc_feature (422)..(422): n is a, c, g, or t
  misc_feature (426)..(426): n is a, c, g, or t
  misc_feature (442)..(442): n is a, c, g, or t
  misc_feature (448)..(448): n is a, c, g, or t
  misc_feature (469)..(469): n is a, c, g, or t
  misc_feature (476)..(476): n is a, c, g, or t
attttattttttgtgccataccagagtacagtatcagctgatgctgacnttactctgaggnttanctnttttnntggangtngtttctgatttatagcttcttggtttntccttagacatnttggtggtgagagattttggtttttaaggggttgttagatggngtaaattttcttttttttttttttttttttttttttttaantaaaaaggggtgacagaatttcagcagttctttgatttttatattttannccncntcctaancaanccctgcctttngagnccaggggggaaggncaggggcgggaaggggggggngggttttnttnncaaatgngtttttttttttggggtactgtaccctgnttnnagnggtgtncccgggatagggncatcnctggagaagncattttaggagnaccnggaggcccaacggcanaagccncaccaaaaaagcgaaatgggnacaccanagggaagactttaatccggtttcttctcccctctgggaagt

SEQ ID NO: 564557 - DNA, 140 bp, Homo sapiens
aatcttgtgatccccccgctgtacagttgggatatggtacggccgggtgagatatacaccctctcccccggattttagtgggcagctgagagtcagggatgcgctgaacgcgacgttccaaggcagggccctctctcggg

SEQ ID NO: 564558 - DNA, 1326 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564559 - DNA, 1055 bp, Homo sapiens
  misc_feature (869)..(869): n is a, c, g, or t
  misc_feature (934)..(934): n is a, c, g, or t
  misc_feature (960)..(961): n is a, c, g, or t
  misc_feature (968)..(969): n is a, c, g, or t
  misc_feature (976)..(976): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacaactgnctggcttccaggcagtcatgctgactgcgaagctggtgtgaactggccgttcccggtgacttttntgccgttggccatgacagcggagcgnnacggggnncggccgntcccgtgtgtccaaattggcctggccctgcaataggagcgtgggttcacaggacttgcgccacttgggcccacgtgccg

SEQ ID NO: 564560 - DNA, 101 bp, Homo sapiens
aaaacaaaatgtaaccatggggaagtatgtatggttaagaactatatgaagctagaaaaataaataggccaggcacagtagctcacacctataatccagca

SEQ ID NO: 564561 - DNA, 540 bp, Homo sapiens
ctacggcatacaccatcagccatcactgctgcattccggtaccgccaatctgtcgttcttgatgtcgtactttaatgaaagggaggacatgtgggacaatgtcatcttcgcagacaggcggccagaagcatgaggcacacccctgctgctttgcaggggttccagtcatcgtcatcatcattttcgtcctgtttagttagtgtctgtgtgaggattggaaccagatactgtagtgctcccttcgcataaaacttgctggtgtgctcagggggccgtccttgttctgctgcctctgaagcttcaatggccaaatccatttcctcatcacagacattggaccagaattctatcccttgtaaagccacctcatcaatgtcacttttcattgcttcgattgtgattgcaaaaagagcaggacccatatatgtctccatgtactgataatataaggacattatcttcaccagattctgtaaagcagccactcgtaccctcgtatctggacactgtgtggcttcacagaccacctgcataataaag

SEQ ID NO: 564562 - DNA, 1012 bp, Homo sapiens
  misc_feature (912)..(912): n is a, c, g, or t
  misc_feature (953)..(953): n is a, c, g, or t
  misc_feature (975)..(975): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacacctggctgcgcttccaggccagtcatgtgcctgggaagtggtgggacntggccgtccccggtgcttttatgccgggttgcccctgaccncgggggccagccggggggcggncgcccccaatggggcaaatgggccggcccggcgccgg

SEQ ID NO: 564563 - DNA, 1455 bp, Homo sapiens
  misc_feature (1301)..(1301): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcacaggcaggccatcaggagcgtcaagcgccttcgagcagtcacggcangtcggggcaaggctctggcaggtaccggggggtgggcaagggtcggaggcaacaagagcgggcgtccggccggtcacggggggtcgggggcagggcaccgggaggagaaaccggcaggtggcccgcttaaaactgggcgcccactttgtggacg

SEQ ID NO: 564564 - DNA, 139 bp, Homo sapiens
atcggggtacacagggagggggacagagacccagagagacggggacagagacccagagagagagggacagagacccagagagagagggacagagacccacagagacggggacagagacccagagagagagggacagaga

SEQ ID NO: 564565 - DNA, 2186 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacacacctgcctgcgcttcccaggccagatacaaatgctagcacctgcggaaagcataggcctgtgcaccatggtcccgaaaccccaggctgcactaacatcatgcaccagggactatagccacacaaactgaaccagcacggaggagacaagacaagccaaaaaacaggaacagcatagaaccccggcagacccacggaagcctccaacccacccaaacacggataggtcacggcaccggcgcccaccagaaaacaatcgcactggcgcagacctggcaaaccccccccggcaccacatctggcgcaaccggcacagacaccacagaaccccgcgcgcacaggcccaggcaccacgtggacccacaccaccggacgaggcgaccaacacaactagctcacacaatggagcaaaccgcgacaacagccgccgacgcacccccacaaccccccacaacaactcgcgccaccaccacacacgggagcacccacaccccaaaaagacacacaacaagacacccccccacgcccaaggcaccgacaaaccacgaccaacacgccagagcgacccgccctggcgagacagacccccaacaagaaaacaaacaacgcgcccgcaaacacacacaccggcaaaggcaccaaagaaggaggagaaccaacttgagccacaccacccaaaccagaaacgaccgaaccccaacacacaacaactgaaacaccgagcaaaagccgaacacaccccaaagagaggagcaaaaacaaacgccacaaccacggcaaccacaaaatgcacaaaagaggccaaagcagaacaggacacaccaccacggccggaaaaaaacacaaacaatacccgaaagagaaccaacggaacatcacaagacaaggggcaagaaaagagaaccaaaaccgagcggaaacagaccaaacagagggaccacgcaacccacgcaggacaacacccgggacacaaacaacaagggagaagcatcacaagacgagcacacgagagacaacgaacagaccggaaccgtacaaaaaccaaagccacaacaaagaaaacaaagagaccacaacacacacaacaaaacgacagcagaagcaaacacagactaaagaaggatgaacacaataagcaccggacgaaaaacaacaaagacacgagggacaagggtgcgcgaaaacagaagaacaggagagagcaaaagccatcacacgaataaggcgggagagacgaagaacgagagcagggaagcagctacaagaaaatagaaacaaggaaagagtacggagatccaaccccccaacagaagacagaagaag

SEQ ID NO: 564566 - DNA, 500 bp, Homo sapiens
actcctggtcgtatgctgcaccaaggaagagacgcttgtaggccttgtcatctgctccaagaagataaggtcaggacggtgtggtggccaggcggacatagtacggtgtgaagcctttccacaggctgaagaagccctcgtagcggacaactttgatcagcacgtccagcccgttcttgtattccggtttcccatcagtcatccgcatgtcctgcattcgggtcttggcaatgtccacaggcattgaggcagcagtggtgacaagaccgctgatcatgctggcacagaaaagtgagacaagaatgtggtcagcagaagtagcctgagtccagtaagaactgcttggattgggagtgggaggcgagctgggcagcattgacgacgacggccggagccatggtagggaatgcagccccgccaaagtgtgaggacatcctcttaccgggtgatccgaatcagggcgttaaacacatttttgtaagcctcggcgcccccggacg

SEQ ID NO: 564567 - DNA, 1727 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggtgaggccccggccccttccccgaccgccctccggggaccccgcggcccctgccttggctgacgccctcccgtccccgcaggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564568 - DNA, 154 bp, Homo sapiens
gagcgagattccatcttcaaaaaaaaagaaagaaagaaaataacaaggttaccatgtagatcctgcagtcacggggccattctcaaacatcacaaggatgggagtcaaaaattgaaacctggaaaaagaaacctggactatgatggtggaataa

SEQ ID NO: 564569 - DNA, 1634 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgacacgcccactatggtgacctgaacacctggtgtctgtaccatgagtggggtcaccacctgctgggcttcccaggcagtcaatgtgactgggagctggtgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564570 - DNA, 795 bp, Homo sapiens
ggcttgtggcttgccgacattccactacctttatccgagagttactcccgttgtcccaagtggttcccagagcgagcccttgttgcgtggcattgcgtcgtgcgaccctggccgcgatctgaggttccctagtctgtcctggaatggaccgcaagcgtcgtttcgtctgctgagatcccatggtggtaaccggtgtgtctcaatgcgctctcgcacatctcatgaagccgcgatgccagaacgacgacgacgccactgtggcacatcgcgggtggcattagtgcgctaaaccacgccctggacttgggacttggactcctggcgcaatttgtggacccccttagtgtgccaaccctgaggcattacgcgtttcccattgcgcggcttttgagggagattcgcttgtccaaagccgatttgcgtccaatccggggattgtgcgaggaatttacctcagttccaagagcagattcgtatcgcggaggagacgcccggagagagttaacgcccttcccaaagaacatatttccgagattgggtttcggccttttttgccccgggagctgttggccctctatggtgggcctggggcccgtctcatgggggggttataccccgggagtttttctcccggggggggttgcgctgcggacattgtgttcccagcgcggggccctctatgggaggtggcaacgggtgtcccccttatggcgggggttttcgtgggcctgcgccccttttgtggtgacctcgccacccgtggtcggccgttattggagtcgtggtggcctttgg

SEQ ID NO: 564571 - DNA, 454 bp, Homo sapiens
cgggagtcaccccttacttcctggataggtaggcttttttaagttgtgtgttttgttttggagaccagtgtctccactttgtagctgtggctatcctggaactcaatcagtagatgcccagagatgatgtgcctgcctctgccgtccaatgctgggattgaaggtgtgcacagccacaccagcttaaggttttgttaaagaagacgataggtatggctggattatatagtcttcaggttcacatgaacttggctgtattctgataacattgagaccgttttccaccaagttagcctcatttgttcagtaacacatcttaccgaggaaaggaggcaaggaagtgcccttttgtgtctcctcattgttcacagcctgttggtctcgaacactcaacatatgattgctcgatcactttagatagtaagtaggctatttacataatgagctaacctca

SEQ ID NO: 564572 - DNA, 169 bp, Homo sapiens
tagaggatccgagatgactttgctctggccctggtctgtctgttctcagcatgatgtgttgaggctcctggaggctctgcaatgacagttctgacagtgacactgatggtgctgagctaccccactggacttactggctggggacaccaagaccacgtacctatggaag

SEQ ID NO: 564573 - DNA, 438 bp, Homo sapiens
agtggggggcgggatatagtttggcgagctaatgtaccacggaatagttgcgtgatagatggtgagggagggaggaggttgtcgaatagtgtcggcacattggggggcaaacgggtgttaagatatgaatagacgccttgctgatgattacgcgctggggttgggcgacaggtggggtagagcgatgcagctttatgcctgcgattgggggagacaggtggggagaacttggcatggtggtgagaaggggtggaggcgagatgacgtggcagacctaagaagaatagcgggtgaggcaacgaatggtgaaacggggcgggggatggacgggtatgttgagacggcgcgaacggggggggttgagatgatatggggcgactgcgggggctgaaaggtggcgaaacatgatgaaagaccggtattggctgaattccggga

SEQ ID NO: 564574 - DNA, 164 bp, Homo sapiens
cggtgcggttcagcgtgcctagcacccagtctcacaccagcagctggtgctccgtgttggcccccctctggcgtcactgcgtggtttgcctttcctccggtgactctgcctttggtctgtcctgctcctggcctccacacatctctcttttttttttttttttt

SEQ ID NO: 564575 - DNA, 226 bp, Homo sapiens
  misc_feature (39)..(39): n is a, c, g, or t
  misc_feature (47)..(47): n is a, c, g, or t
  misc_feature (213)..(213): n is a, c, g, or t
agggaaggtgggagttacagtgagccaacattgtgccancctgggtnacagaaggagactctgtctcaaaaaaaaaaaaaaacaaaaaaaaaacaagatggtcttgcccaggtatggtggctcacacctgtaattccagcactatgggaggctgagatgggaggattgcttgagcccaggagttcgagaccagcctgaccaacatggcgagancctgtctccattt

SEQ ID NO: 564576 - DNA, 370 bp, Homo sapiens
tatgaatcttagtcatttatatctcagcagaagtaaaccaggcaaaagtatcgaatgaaaagataaagttaatacacaaactgggtataaaatccaagtgcttaaaaattaacaaggtgggctgggcgtggtggctcacgcctgcaatcccagcactttgggaagccgaggtgggtggaccgcgagatcaggagattgagaccatcctagccaagacggtgaaacccgtctctaccaaaaatacaaaaaattagcagggcaaggtggcacgtgcctatagtcccagctacttgggaggctgaggcagaagaatcacttgaacccagaggtgaaggctgctgtaagccgtgacagcaccattgcaccccag

SEQ ID NO: 564577 - DNA, 290 bp, Homo sapiens
tttgattgttaattttgtgaagtaagggattccaggccagaaatcacttgccatcagcttttgaaggcacgctttgtgattggttagctgccctctttgtgttgagaattctggagctattctcgttcctgctcttttttatggcacctggaaacttggggaaacattttttttttttcttcagtgatttacttttcaagataatgtgccttgatatgaatcatttccatcgattttgtggacaatttggaaacttatttctggaaaaaaatattaagtaaaaaaaaaaa

SEQ ID NO: 564578 - DNA, 121 bp, Homo sapiens
ggcgctgtaacacatcaccagtgctcctgggccaaccctgggccctgaatgaggcccaggtgcaggcctcagtgggtgcaggtcctgactgagctgctggaacaggaaagaagggtaccga

SEQ ID NO: 564579 - DNA, 130 bp, Homo sapiens
tcccgggcggggaaacggcggctggggaagagggaaagacggcgaggacaggcttcgtatcaattcgccttttctgcatcttaatatggcagtgtagccccctttgtaagccccctcttccccagcccag

SEQ ID NO: 564580 - DNA, 166 bp, Homo sapiens
cgagctcggtaccccatgccaccatgctcaaccaatttttgaaatgtttgtagaaacagggtctcactatgttgcccaggttgttctcgaactgttgggctcacatgatcctcctgtctccacttctcaaaaagtactgccatccgagagagagggatggatggcc

SEQ ID NO: 564581 - DNA, 368 bp, Homo sapiens
gctgtagctgtttggatgtgaggagaatgaaactaccaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagctgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaa

SEQ ID NO: 564582 - DNA, 355 bp, Homo sapiens
atctgctgacctcggtcatacaacctccatctcccaggttcaagtgatcctcctgtctcaagctcccgaataggtgggactacagtgtgcatgcgccaccactcctggctgattatgatatttttagtagagacgaggtttcaccacgttggccaggctggtctcgaactcctgacctcaagtgatctgcccgcctcagcctcctgaagtgctgggattacagtcgtgagccactgtgcctggcaagactttcaagaattgtgaaagatctgagattctaccctacttgcaagctaccaagttactctgccacaatttcatatggtcataagacgtgaaactcttaggtcacaga

SEQ ID NO: 564583 - DNA, 184 bp, Homo sapiens
agggggggtgttctccacccccccagcattgaggaaaaaggggggtttttttatttcccccccccctttttccccggcccccaggaatgggccatttttggggggggcagggggtcccaaattggctccccctgaaaatgtaaaaactccaaacaaaatttttattaaattaaattttgggtca

SEQ ID NO: 564584 - DNA, 143 bp, Homo sapiens
ctgacagcaccatggcggttgcaagaccagcgcttacgaaggcggcaaaaggagccaaggaggaagtggttgatccattttttaagaaagattggtattatgtgaaagcacctcctatctccatatagaaatattggaaggcg

SEQ ID NO: 564585 - DNA, 521 bp, Homo sapiens
gtccggggaaaaaacatgtgcgagagatgacagcgaatcctagccaaaatcggtcagtcattatatccattctcttagccatgaatatgacatagcacttaataaatgaatagattgtctattcgcgaggggtgaagtgtatcagtctgttctcacgctactataatagagctgccagaggactggttaattaattcaaaaagaggtcacactgactcatagttctgcatggctggggcaggcctcaggaaacttatattcatggtggcaaggggaagcaaacatgtcttcttcacatggcagcaggaaggatcagtgctgatcagagggggaaaagacccttataaaaccatcagatctcatgagcatttcactcactatcacaagaacggcatgggagtaactggctacatgattcaattacctcccaccatgtccctcccatgacgagagggataatgagaactacaattcaagatgagatttgggtggggacacagcgcaaacatatcataaagtct

SEQ ID NO: 564586 - DNA, 918 bp, Homo sapiens
aagagctgagccgcttcagactgcggggcaagcgggccgcggctcccttcgcctcaccctcacctgcggccgtagaggcaggatgagtccgagcagcacgtagaagaagaaaggatgaaaagaagaccaccagaacggacgatacgaaccaaccgaacacacagaaacaagagcacataacacgaactgaaaagaagaagacgacaaaaacgaagaacacacagaagcacgacacaaggagcacaaagcacagaacgagagcaaaacaaaaaagcagcaagacaagaacaaagacacacacacagagaagaaacgaacaccaaaaaaacaaaaacaataaaagacaaagactaaaaggcacagaaagaggaaccaccacacaacacaaacacacggaacaaacaaagaacaacacgaaaaagagcaacaaacgacacgaacaagaaaacaaagcacaaagaaaacaacaaagcacagaaagaacaacacacaacacaacacacgacagcaaacaaccaacacagacaaaaaaaatacagcacaaacaacaacagaaacagaacaaaaacaaaaaaagaaaaacaagaaagaaaaacaaagaacagcaatcaacgaagaaacaaaacaagacaaaacagaaaaacagaacaacaagaagcaacaagaagacaggaaagcaaaaaaacacaaacaaagcacgatcaaaccacagaaaacacatcaaaaaaaacaacaacaaacaaacagaagaaacgaagaacacaaaaacaagacacaccaaaaccccaacgaaaaaaagagcaaacaaaaccgaaacacaccaaccataacagaaaaggcactacgaaaaaacaaacacagaacacacaaagaaaaaacccaaacaaacaaaaaaaagccaaacaacacaaaaaacaa

SEQ ID NO: 564587 - DNA, 389 bp, Homo sapiens
  misc_feature (23)..(23): n is a, c, g, or t
gaccgcgccactgcactccagcntgggccacaagagcaaaactccgtctcaaagataataaaaataatgacattggttttcaacttttagaatcaccctatagacaaagcatagaatgatataatttttaaattatagggaaataaaacttggactcaaaaaagggaggttgggaaatggttaagtgagcttggttctccttgccatagcagggcttaaacaaaagttgataaaacaagaaatagcagtataagaaattaccctggccgggcgcagtggctcatgcctgtaatcccagccctttggaaggccgaggcgggcggatcacctaaggtcaggagttcaagaccagcctggccaacatcgtgaaaccccgtctacactaaaaa

SEQ ID NO: 564588 - DNA, 197 bp, Homo sapiens
cctataatcgacggtttctctggggctggggtactgtacaggataagaagcaagtgaggttgggcacggtggctcacgcatgtaatcccaccactttgggaggcgagatgagcagatcacctgaggttgggagttcgagaccagcctgaccaacatggagaaaccctgtttctactaaaaatacaaaaaaaaaaaac

SEQ ID NO: 564589 - DNA, 199 bp, Homo sapiens
cccttttttggggggggggggggggggccgggcacctttttaaaaatttttagaaatttttggcccccccccttggaaaattggccgggggtttttgggcccccccccccctccccaaaccccccccgggggttttttttctttttttttttttccccctaaaagaaagggggggggaaaaacggtttttttgggccca

SEQ ID NO: 564590 - DNA, 326 bp, Homo sapiens
aggcaggctgggctggggcagacggtggtcacacgtcatggtttcactctcacaaatatctgggactatggttcaaggttcgtgagcagcgagtggaccttgtggttatttacaaggctgggccatatacaaagcattgacaacatggagtggagaggatccttggcgatgagctggttcactcactcctctgaccaacaaggaaacaaaggcccacgagaggagaaggccgtgcctggccagacgtgggacctgaacccagccagggctctgactcccagtcccccagtaccctctctacctccttgtcctgccctgggtcccat

SEQ ID NO: 564591 - DNA, 821 bp, Homo sapiens
cgcggtggctcacgcctataatcccagcacttgggaggccgaggtgggtggatcatgaggtcaggagatcgagaccatcctggctaacacggtgaaacctcgtctccactaaaaatacaaaaaattagccgggcatggtggcgggcgcctgtagtcccagctactcgggaggctggggcaggagaatgttgtgaatgtgggaggcagagcttgcagtgagctgagattgcaccactgcactccagcctgggcgacagagcgagactccatctcaaaaaaaaaaaaaaggtttttaaatttaacctttgggatataatgggattggggaataacgtggtttataaaaataacttttccagtggtacctttcaaatcataagggttatggctatggtactttgaaattaaaaaacatctcatgcaaagtggtctggggtcatttccattaaaattaaggaaccaattgggctggaacttaaatatatggtgggtttccaggttcctaaatatatgggagtctataaaacttggtttctagaatttttaaaataggttcttattacaaatgctgatctgctgccgagaatccaaattgtggacttcctaggttctccctagaacttaggtgctaacaataaatcctattactcaatattatttgttttcccgggtttatcctttcaggtgcggataagccttccaaggtattttacgacagagctcggccacatccgggggggggcccaacagggggccagggatacgggggagaaagggcaccaggggcttaaccaaccggccttcgcaagggcggcgccatc

SEQ ID NO: 564592 - DNA, 1139 bp, Homo sapiens
agcggaggacgggagtggaccagttcaggtccctagggggaatccgtcgcctccctctgagccgtgctatgtcttcgcctccctattatcgcagattagtcccgaggattacgtccccagcttccaaatcaggaggatcagaatatgtctcagtgattaagtgatcacactatgactgcaagagaacagtcctggagtgcattgacgcctcgctgcctaggtgagagctgacacgcaagtctggaaccagtgatgccggctggaatggtttgacatagagacaggcatgagtaccggagagtcgcccaggaggctccctcagttgggtctcatgggccccacactcccctcggaacgcctattgccccgtggtcgtctctgagcccgcttcttgtagtttcgtggccggcggatgggtagcggacctcgtaattgccatgggttggatccacgagtgcctcgtttgggtggaaaccgcatttttgcgctcccctgtgtactggagtgggtgtccatggagggcctcggtctggccctctgggtccactcccgacaggttgtcccctgggcagcccgattgcagcatggtgtgttcgtgaatcaaccggaagaggacggggtcgtacgtctgcctgagtgcgttctcctggaccaacccggcagtggaccggaaagacttggtcgatgaccaaggcgcatatccttccgggtgcttcgcacgttgctcccaccttctttcttgtcatgctcgtgtgccatccacgctaggcaccagaacttttcacgtattggacatggacactttcgtgcaaggcgcaattgctacgtgcctgatcgccggaaggaaaatggggtttgcccagatcttatcttcggcctccgcattaccttctattttaagtaccatgttactacacttgaaataatattcctcgggaacgcgcaaagtggggttggcgtcaggcatgactctcgcctcaaagcagagcctcttggcgagcacccccccagtgccgtatggggagggctaggaagaaaggtaggaacttcgcccagtgcgaattacttggcgaaagacttggcaacaagcgtaagcgtcccactccccaagtatttgtggggaccccataaactccctg

SEQ ID NO: 564593 - DNA, 366 bp, Homo sapiens
atatttatagtttgacaagatgagtgtaagggcatgcgagctgttgttggttcgtggctccaaatcgtccgtgacttggtcagtctggggttcctctcaccccagcgtttggggccttctctgcacatattgccataagaggacagcatgtttgtttaccatctgcccaggcaccacggctacaatcacatctagctgtatcagacagaagacaaagaacttactttctgtggtcattagttgtaagttaacttagcaatccctgattcaagttcaaaactttgctacctccagctagctttgttccttttaacgcacatgttaagtgaatgcggaacagaaaataaatgtaaaaacgagcattac

SEQ ID NO: 564594 - DNA, 1483 bp, Homo sapiens
  misc_feature (1380)..(1380): n is a, c, g, or t
agatgacacagagggatgcagtgcttctctttatgcaagatgtaagggaaatataagttcacttacattaaaaaagaaacaatcacacacgcaaacccttcaccagaagcttcacactacagtccgtcctcctccgtcctgctgccccagcctctcaccggcatcgcctttcagacgccaggtgtcactgacaagtgggcatcctggtgctgtcccgactcaacatctagcacacaaactgttgtcgaatgccaggcgtgagaacgacagaaaccaaagcgtgcgcaacccccgtgtgtgtatttacttgtgtgtagcactagtatcactttacataataacaactaaagattctgatgatagaactatgagaagaaaaaaccgaaatatacataacataacaacaagacggagaactcataaacatacacacacagaaatacaatgacgaaggaggtggcgcgcgaccgtaattaaagaagtgtgtctgccccgggcgtggcccccaacagtaagtgctggctgctcacccactgctggggggtccccagaggaacgcggaagggcctcttgacaatccgagtcacccagcatgtttgagagagaaagccacagtagtcgcgtcgtggcgcagggttcattcctaaaaaggccagagaaggggtgcgtgaggaaaaacaagggcaattcccatggtttcgtggaggccacttttgtggtaaggagagcatgtaacacctttttccttcccccgcgaggtgtgggcgcgccgccccaaattctttttttggggggtgtaggcccctctttcaaacaccaacgaaagaattcattctttaaggacttgccacgcaaattagaagtcgcgcccctatgcatccaacttatttttttcgccccctttggggataggttgggcgcgccccataaatttaacggccttccgtttatattacctttcggcgcggccagtttcccttataaagacctatggttttcactttcacacaccacacgttattactttcattcatataataacataaaaggtttttttcttcccacgcagcggtggctcgctcgatttgtcttttcttctctgccgccccacccacttccaccctgggaaagttaaagcggttgcgggacgggatggagggggggaaaaagcgaaggacaaaaacctaaccaacaagcggaatataccgattgggtaggtgagtaagtagtagagacgagtctctacagtacaggcctactacaccacaaaaacgaccggcgtgggcccaccaccacacatcgaggtagtgctgcacccaccaagagagcacggacggaacaactcgacgcagctacgagtccagtcaggaacaacccagngcaacactgcagagtgacgcacccccaccccacagcaccccaccgcgggcaagaaccaacaggacacagcccacccgcacacccacagcagaccccacccaaa

SEQ ID NO: 564595 - DNA, 394 bp, Homo sapiens
gactctagaggtatcccctctctgtcctcccagatcacgatgtctgggatcttctgagcatgggcagcaaagaatacaagttcatgttattatatacttgaataccatgtaatgaaaataattaagttatctgggtggaagagttcaaatacacatatatttaatcacacacactgacaaaatataaagcacacttctataatatcacatattgcagtatttctcagagtggcccccaagccggcacaggacatctacctggaacttggaagaaacgtgtaaatcttgggctccagcaaaatgtgttttaacaagccctccaggacactgtgatatgttatagtttgagagctactaattgatctgttcggaatacttctgtctgtagataatt

SEQ ID NO: 564596 - DNA, 218 bp, Homo sapiens
tcatgtaacagaaatctaaattcctaaataccctcgaacctctttctgaatactgttgtgttagtatatttctctttttttttttctttgaaaacacttttctcgcctttttcgtcggggcgagtgcgaaattcttttattcttgtttcagcctccccccttttttttttttttttcccaaaaaaatctatctcttggatcttgggcttatcgagggt

SEQ ID NO: 564597 - DNA, 1536 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgtgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564598 - DNA, 1010 bp, Homo sapiens
  misc_feature (1010)..(1010): n is a, c, g, or t
ttgctaggtacccatacccgtagtgccgtacgaaccaatgacaacatttgttgtctgtaatgaatgtggaaatcgatggaagttctgctgagctggaagaattgcaaaaatatctggaccattcataaaactgatccttcacatatactaaacacctatgccaatcaccaacatcctactgccaccccacatacttaacgtcacttgtagtccgaccacaaccttccccactccacctccctcttttacacccgcagcagaccactttccatcgccccgccgccccattcttctcacctccatccacccccttccccacccgattcccctcccaacactcatcactccacccaccaaacctcccccccctctcatgcctacacacaccgtcaccccccccctccccacccacgcctcacacctaatttataccatactcaccccctacaaacccaccacccctcaccatctaccacccaacccccctcccccctacgccctcacctcaccatccccaccacccccctcaccactcgccttatatgtcccccccgccctctccccctagtactaacttccgactatcccctcttacatctctcactatccacaacataccttatcctgctcactcactcctcccccgatcccacaatatattataccacatcccacccccaccacccatattcctacatactgtcaccacacaccctctcctacattcatcataatatacacccactctcaccaccactccacctccaacacacctccctccactcccaccaaacttcgcacacttacctccccctcttacctatactcacccgatcctacctcatctctatcagtactacatctaatcacacctgcctgtaataaaccgctacatccatactctcacctcccacacccaaaaacacatcctcctcaccacccctacccctcctctcgcacgccacactatcccccccaccacaaacgcattcttcgactccctcatactn

SEQ ID NO: 564599 - DNA, 1601 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgacacgcccactatggtgacctgaacacctggtgtctgtaccatgagtggggtcaccacctgctgggcttcccaggcagtcaatgtgactgggagctggtgtgaacatggtcccgtttccccggctgcacttcttcatgcccggctttgccccactgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564600 - DNA, 1112 bp, Homo sapiens
  misc_feature (994)..(994): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaacctaaagctgacacgcccacctatggtgactgaacacctggtgtctgtaccatgagtggggtcccacctgctgggcttccaggcagtcatgtgacctgggaagctggtgtgaaatggtccgttcccgggtgccttcttcatgcccggtttggcccctggacagcgggcggccgcagaccggggctgacggccgatcaccngattttgtccccactttggtggtggtaccgcagggcgcactatcgtgcgcggtaggcgcgcctaaggggggccctttccacaaccgttggcccccagacggttcccccgagcgccggg

SEQ ID NO: 564601 - DNA, 1010 bp, Homo sapiens
  misc_feature (963)..(963): n is a, c, g, or t
  misc_feature (968)..(969): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaacctaaagctgacacgccactatggtgacctgaacacctggtggtctgctccatgagtggggtcccactgctgggcttcccaggcagtcaatgtgactgggaactggtgtgacatggccgtcccggtgcttttagccggttgccctggcaccgggccgacgggggcggcnccccnntttgcaaagtttcgacccgggaaggcgtgggcagggccttg

SEQ ID NO: 564602 - DNA, 558 bp, Homo sapiens
gggtatatctttatgtgccaggcagagattcctaatgaaccctgtgttccctgagcgtcgcttcgtctcttttctggggagttaaattactattcactagaagaaacttcttggtggctcctcctgtgcacagaatcacaaagaggtgtagggccgtgtaaatgtggcagagggcttgtgggagaggtccgtggaaggtgcattttgtcccttttgcagactctactggttgagtctgtaacacacgctgtaacacacatgtgtgttgtgaaacacagctggttgatcttaattttggcctcgggctcagtttccctggcctctgagtgatttaagtacacctgatagaagggatgaaaaaccctttggggggtccctgcctgggctatacccgtctctcttgggaatgttccctcttgaacccctgtgtgaactctgtgacaagttcacaagcccagcttgggaaaagaaaggccatcccattagctgagcagtggaccagtctctccctctcttttcagaatcttgagaccaaccagaaataggggtcagtcccat

SEQ ID NO: 564603 - DNA, 408 bp, Homo sapiens
cagcagaggacgtgatcgttttatcattcaagagatggatacacacctcttcttactttttattagagacagggtctagttctgtcacccaggctggagcccagtggcacaatcatagcttactgtaacctcaaactcctgggctcaagcgatcctcctgcctcagaatcccaaagtgctggattacaggcacatgtcaccatgcccatctcatttttaaattttttactttttcttttctttttttttttggagatggagtctagctttgctgtcagggctggactgcaatggcatgatcctagctcactacaaccaccgcctcctgggtccaagcgattcttctcaggtttgagacggaacaggctctgcgcatgaccttgaaggccgacttcaacggcctgcgca

SEQ ID NO: 564604 - DNA, 911 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaacctaaaagtggcacagcccccttattgtggcctgacccctggtgttttgctcccctggtgggggcccccgggtggcttccggggccatgtgtactccggaaacgtggtaaagtcctcc

SEQ ID NO: 564605 - DNA, 722 bp, Homo sapiens
agtgaccgccgagggaatcttgccggggtgcaaccgacaccgcgaaacaggaagtgttgaacgaacagcggacctgtgaccagagtgcggtgtcgggcgcgaaccgctggccgtgggagcacgccgtagccgccccgtgagaacagaccggggcgcaattggcgacacagaccgtggggaccccgcccgaagaaattgttccctccacgaggggggtcgtaaaaaagagtgtcgtatggagcttgtagaatcaccactagcggggcttgttcatttagctctacaccatcagttggggaccacctcccacctattgtggtcctcccacgctcttgcccgctgtagccaccccatatggccgctctatcactttggggaggcccacgtggtaccacactgttgtcgtcgacgcgcgccccgcgctgttgtttgtctataagacgctggggtctcttgtagatgcacacaagcaaaaggaaaagaagcgtgatagtttagacgcgcgccttgaggtaataaaatacgagctttgtctgcgcgcctttctatccaaatgttcatttgaggcaaccctcttgtgacagagaggcagccaactttataaaaatagttctcaccccacggggattttccccgggaaattggtcgcggtggaagatttgctaaggattctcgtgatatatatcgagcccaaaatgccccctcctcccgcccacaaaaca

SEQ ID NO: 564606 - DNA, 1037 bp, Homo sapiens
  misc_feature (1014)..(1014): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcagtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtccactgtgtcacttctgttttcctgtccaatcatnctgttgtctgctagcaggtaccg

SEQ ID NO: 564607 - DNA, 1136 bp, Homo sapiens
gggcgctggggccctgggcagcgcgggctcgatgtgtgtcagccaagtagctggtcccactggagcggtgaggtcgccacggatagtgttcctgccccattactagcgatctgtgaccttgaggacagtgattttactgagtcttgcttccctcatctttaaaatgtggctaatgcctgccttagggaaccgttgtgaggcattcacgtgcagacatggtatatcaaaacgcactccttctggcataaacttgaggtggacagcataccttgaggcatgcttgaaggtctgctaggcagcttcacagccgttatcatattcctcattctcatatcaggaggtctcttatggaagcaagtaatgatgactaataacaagaaccttatcgtagctattgcaagcattcttccgccgtacagagttactgattacatgatactggaggattccatgtatgccagggcagaaacgagagagcgcgacaagagagcaggatgtctctctcaagacatggcacctgtctggtgaaagctggctggaccaagacgagtatatcgcaaagattaataacgttcgagaaggacagagcacagacaagtgtgagagaaatacgtcgataagagaggagatatagataatatatcataacttgaaggcaagctttatggaatgtgagaaggaccccagggaagactggaaccagaacccccgaaacaggacagagcctagatcatacctgaagagacggaacagcgcaacaggatgacaccagaacacgagcacctcccacgtggacctacaaccctggggacccacagggaccaggaactggcggaaaaagtcacagaggacggaagagcgagcaccggaaaaaaacgggaagaccgtggtggaacacacaagttggcatgcccatgacgagcagaccagacgggaagaaaacatgccccgcaacagaaaaacacaagcacaaggaaagaggaaccacaaagaaccgaaaaaacaaagagcgaaagagaagaaacatgtggacacccgagccgcaaaggccaccaaggacggcgacaacagaaagacaataacagaaagggaaaacagacatagaaaagaacaaaaaaacaaagagaaagaagaga

SEQ ID NO: 564608 - DNA, 1532 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccctgctgcgcttcccaggcagctcaatgctgactgcggaagctggtgtgaacatggtcccgtttccccggctgcacttcttcatgcccggctttgccccacttgacaggcggggcagccaggaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 564609 - DNA, 850 bp, Homo sapiens
  misc_feature (746)..(746): n is a, c, g, or t
  misc_feature (766)..(766): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtgagccgtggctggggactgggcggcggctcaaaggtcaaggggctgctccaagggcaccgccgtgggaactgcgcagccggggcccctggacgccctcctcttctctgagccactcaatcccctctactaaatcggctttgggagcaaggtccagctgtctgccgaggcgaggagccgcacacacgtaatctccctgcagggagctgagctggggcagtggctgttcctctgtccttgggaattggcagtggccccccggggaggggtttgtaagctgtcaggtttggcctgacttaattcgtacagggcaggnggcggctttgggttgaaggnccgtgtctaactcccgggattctgggcccgctccaccagtgcccgggtttcgctggggggccggtgcgctcccggcgccccgtg

SEQ ID NO: 564610 - DNA, 931 bp, Homo sapiens
  misc_feature (827)..(827): n is a, c, g, or t
  misc_feature (847)..(847): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggtgaggccccggccccttccccgaccgccctccggggaccccgcggcccctgccttggctgacgccctcccgtccccgcaggcggcaagtacgtgccccgcgccgtgctcgtggatctggagcccggcaccatggactccgtgcgctcggggcccttcgggcagatcttccggccggacaacttcgttttcggtgagccgtggctggggactgggcggcggctcaaaggtcaaggggctgctccaagggcaccgccgtgggaactgcgcagccggggcccctggacgccctcctcttctctgagccactcaatcccctctactaaatcggctttgggagcaaggtccagctgtctgccgaggcgaggagccgcacacacgtaatctccctgcagggagctgagctggggcagtggctgttcctctgtccttgggaattggcagtggccccccggggaggggtttgtaagctgtcaggtttggcctgacttaattcgtacagggcaggnggcggctttgggttgaaggnccgtgtctaactcccgggattctgggcccgctccaccagtgcccgggtttcgctggggggccggtgcgctcccggcgccccgtg

SEQ ID NO: 564611 - DNA, 1132 bp, Homo sapiens
ttgatgttcggcgaccgatatgactattctctacaaaccacaaagacattggagacattatacctattattcggcgcagtgagctaggagtcctatgtcgacatgctcataagcctccttattcgagccgagctgggccagtcgcaggcaaccgttcgtaggtaacagagcctacaatctacaacgttagtcgtcactagcccattgtcactttgtaactatatcttcttcactatgtaatagccctatcagtaaatcggacggctattggtaatctgaactagttcccgctaagtacatcggtgccacccgaatatggcagttattcccgacattaaatcaacataaggcattcttggacatctgtaacctcacctactcatccatacgtctctgactccgctagttcgtagcgtaactagttgcgacgtgaccctggagtcgagcgtacacaagggcttagagatcgagctcttaacgcacatactcgcttgtgagcatgtggcaatcattactacctcgcaacactcttgtgaatggccttccagtaagaaacctaaaacacaattcattactcactttaacaaccttaagcaaggagtagttcttcacattcattagtcatatacgagggaggccaaatcagactttacagttcagcgagagcaagatgtagtccacattataacagatacacccaccttggccaattaagccccaaattatcacatatacggcacccatacattaacgttctcgaattccaggtccctaatattctacacgacatgtacactaacgcttcttccataatcttctgcgccaagtctctaagacttggctggggcattcacacaatagctatttaacaagagcacgcaagactcaaaggagcaaccatatactatcggaagccacgacgggcagagagcgaagacacccaattcctattaccaaagaaacgttaatatctggactattttcacggtccaccctggaaagtcgtataatactttaatcgcttaccagcgctttcgcgacatacatcctcgcaatattggctaaccttaacatactcccggcaaaacaaaagagacattttgggataacatagggtaatcgagcctgagca

SEQ ID NO: 564612 - DNA, 202 bp, Homo sapiens
cagtctatggagatgactgagcagatgaaggcatcagatgccttcatcagctggtattttgcctaagatctatctaagataacctattattaaatattttacttaatatagggcataatcgtatcattcaaaattaagtctgcgttatttcttagataagaactgaatgtggccgggagcagtggctcaagcctgtaatccc

SEQ ID NO: 564613 - DNA, 194 bp, Homo sapiens
gcgctgagggggctgttgagtggctcacgcctactacctcaaacatcagttctaccccagtgtggtgtaccttgaccaagtaccagccccagcattggaagtcctgtacatccaggcctttgtccttgtcttccattctgggcaaggctgataggcaaggtgttcttgggtcaactgagggcagcagagatgga

SEQ ID NO: 564614 - DNA, 287 bp, Homo sapiens
  misc_feature (131)..(131): n is a, c, g, or t
ggggggggggggggggggggggggggttttttttacccgggtttttttttttcccccccgttttcctggggggcccccccccccttttttttcccccctttaaaacccccggggcggttcccccccccggnttttacctttggccggggggggggttactttttttccccggggacccgtttttccctttggcccttttttggggccccttttaccccgtttttttccaaaaaccggggggggcccggcccggttttcccgggttttttttcccccccgggccccca

SEQ ID NO: 564615 - DNA, 676 bp, Homo sapiens
acagattccctttgcgatggaatataccccccaaaggttaccactgtccagctgagaagaggaagccatcgggtgccgtctctccttgatggaatcgatacagggctcctggtgctgaaggacttgggcattcaggtggaccgctacattgccacggaggtgtgtgaggactccataagggtgggcattgtacggcaacaagggcaagatcatatacatcggagaagtccgcagcgtcacacagaagcatatccaggagtggggaccattcgatcaggtgattgagggcagtccctgcaatgacctctccatcgtcaaacctgatcgcaagggcctctactatggcactggccgtctctcaaagagttctaccgactcctgcatgatgcgcggcccaaggagggagatgatcgccccttcttctggatctttgagaatgtggtggacatgggcgttagtgacaagaaggacatttcgcgattactcgagtacaaccctgtgatgattgatgccaaaaaagtgtcagaagcacacaaggcccgcaactacaggggtaaccttcccagtatgaacagggcgatgaatccactagtaatgataagctggaactaaagaatgataaaactggcagaaaccaaaacaaaaaggagacataacacaagtaaatcctacaaga

SEQ ID NO: 564616 - DNA, 204 bp, Homo sapiens
  misc_feature (101)..(101): n is a, c, g, or t
agactgatatccgctgccacaactgagggatctgacatttctatgccactttattttatgtaaatgcgttattttactcctttttccatacttttgatggnttgggaaaattactatttattccctttcttttatttatttcttattttttgagacagagtctcgctctgtcgcccaggctggagtgtagtgttgcggtctctg

SEQ ID NO: 564617 - DNA, 442 bp, Homo sapiens
agttgtaaaaggggcatagtcccctttgtcataactgacagatgctgtttcgagtactcctggtgcaggccgtgaaattagacagagagattttaccacacattaattatacttgtgcagtctctccagtataacttctctaatgagttattagaaccacttgtgtcagaagaccttgtccaattctttacatttgcaaaattactttgcagtataggcatacaagatgggtcagtaaggcttgagtgcacactaaattcttagacgcatttgttgcatttgtcgttactatcccatatgaatagtccaatgtagtgctaggtctgaaatgcgactaaaggccttgcaaaactcattacatttgtaaggttactctccagtatgaattttccgatgtcgtgccaggtgtagcaaattcgattagaagcacttgtcaacattc

SEQ ID NO: 564618 - DNA, 973 bp, Homo sapiens
gggccgcgggccggcgtgcgtggcaagcctctcgcggctcggctcgctcggcctcccttaccgggaggcggggtctggcgccgcgtgcggcggaggcaggccccctctctcccgcctcctcgagcctggctccttcccctggccggtgcgtctctgcgccagctcgtcctcggcgtcctgctcgcgcaggctcggtggggctgctcaacttgtctacttcgtacctcgccctggtggcggcggccgaattgtctcagggctgagtgacgtccaaccacgtacctggacggcaggatcccaagcaaggtccgtgggcagccaaccaggacgtactcccgagcagacgggaggagcttgggccagggccttgcaagggccgtcgagcagcaaggtcgccagtcctgggcgcagaagcccacattgggggacactcttctggagtccagtctctgcagacagcctccgcaaaccagtcacaagcaaggaacctccaaccaggaggcacacgctgggaaagcatagggggagacgtgaaggtccaggcggactcaagtggcaaggcttgcatgcaaggaaagacgtccagcacatggaaggacttcgtacaacgaagaacgctcctcgggaatggggaatcccaattggtgcgatgcacagggacgcgccccggaggaagtccggcgacctcacacgcaggtcaccttggacagcaacacacacagtaggggagggaaagcccaggcgacggcaccggggcagagtccagcccaaacacaatccgagtcccacctggacgcgcagaaatccggccacagaccgaggccagccaaagacacagtcccgcagaaagagcaacggaaaggacccagggaaaaaggggaagacatccgaagggggacaaatcgacaggagcgcacaagggtataggcgtccgcccttcggcacagcaaagtcggcgcagggagcaaacgca

SEQ ID NO: 564619 - DNA, 875 bp, Homo sapiens
tgacgccgaagtgcatcgggggggcccgggggccctggtggctcctgggcatgtgaggaactctgcggtgggttccgcgtgaggtttcggcagtggcatacggggtccggggtcgtaggccagatggataggtgagtccggagggcgcagatgagccgcgtgatactctgccgtggaggtcaaatggacctaggataaaggagtggatgcccgtcaccaacgttgggtccgcattgcgtcgaaaggacagtgaaagattcaacgtccctggaggagatctatctcttctccctgtgctcattaaaggaatcagagatcattgattgtcttcctggagggcctcttctcgaaggcatgaggttatcgagggattatgccagttgcagtaagcagacccgtgtccggtcagcgcaccagagttcaacgtgcatttccgttggctatcggggactacaatggccacgtcggtctgggctgttaaagtgctccaaggaggtggtcaccggaagtccgtggggccatcatcctggacaagctctccatcgtccccgtgcgcagaggcgtactgggggaccaagatcggtaagtccccacattggtccttgataaggtgacaggtcgtagcggctctgtgctggtacgcctcatacctgagaccaaggggactggcatcgtctccgaacctgtgcctaagaagctgtcatgatggctggtattccgatgactgggtacactttcagcccggggcttggactggcaacctggggcgaatttcggccccggccactttgattgcgctttaataccatacagtaactgaccccgagtctgggaggcgacgctttccaaggttctaaaaaagcacggcactcgta

SEQ ID NO: 564620 - DNA, 462 bp, Homo sapiens
cagactatggatccttcgtgcagtggattccagacagaaaaactaaattccaaattctaaatgccccctcccttttggagtttaggcacaactaaccagcacattacaatagacagtcatagactgccctaacactaacagactctttgtggcaatcagataacaaattccaacctgactccagtacagcatcacacgacagatagcagaccctgaaggaacatacaaattttttaccccaaaatatatttctttggcatattttgaaaatgggcctgttaagctgtcttttgtggggacacctttgcatctgtagagacactcttaccccttccaggtcttccccagatcacggagcgactagtgagaatctgttctctttaagggttgaacagagaggctttgggccaggcacgtggctcacgcctgtaatccccgcactttgggggctccccgggtggg

SEQ ID NO: 564621 - DNA, 115 bp, Homo sapiens
tactttccacagggggaatgtttcatcttctccttgttcagtataaacgttggctgtgggtttgtcgaaagtggcttttattaccttaagttatgtcccttctatgcccagtttt

SEQ ID NO: 564622 - DNA, 486 bp, Homo sapiens
aattagctaggtgcgctggtgtgtgcctgtagtcccagctaccggggaggctgaggtgggaggattgctggagcctggaggtcaagactgcagtgagctgagattgcattgctgtactccagtctgggtgacagagcaagatcctcaaaaaaaaaaaaaaaaagtgatctggaatggggaatttaaaaaaattttttttctttttttgttttttttgagtcagggtcttattctgtcacccaggccggagtgcagtggcacaatcttggctcactgtaacttctgccctctgggctgaagcagcctcccgtctctactaaaaatacaaaaattagccaggcgtggtggcaggcacctgtaatcccaggtacttaggaggctgaggcaggagaatcacttgatcctgggaggtggaggttgcagtgagctgagatcatgccactgcactccagtccggggtgacagagcaagactctatctaaaaaa

SEQ ID NO: 564623 - DNA, 472 bp, Homo sapiens
  misc_feature (39)..(39): n is a, c, g, or t
  misc_feature (297)..(297): n is a, c, g, or t
  misc_feature (335)..(335): n is a, c, g, or t
  misc_feature (337)..(337): n is a, c, g, or t
  misc_feature (350)..(351): n is a, c, g, or t
  misc_feature (356)..(356): n is a, c, g, or t
ccagcgctgctcgccttgttgggaaaaaacattttttcnccctcccaaggagaggggaagattttacaatttattttctccactttccccaaagggctcccccgcggcccctcaaaatgtctctccctccccgaagcctctcagggggtttaaaaagagcaaagaaagacctaaagaaacctcagagcagggggagctgatggcctccttcctttgggggtggagggacaaccctgagatgaaccgcgcaggacgaccccctctccgagcagccccaattgtgcccccatgagctcnggggctcccccctcctcctcccccccgcccccacctcntnctcctcgcttcgnnaggangcagaagagcaggagagcacctgccccatctgtctgggggagatccagaatgccaagacattggagaagtgccggcattcattctgcgagggctgcatcacccgggctctgcaggt

SEQ ID NO: 564624 - DNA, 115 bp, Homo sapiens
aaagacagcgctctagtatcagtagagacgactcagaaaagtcccagagctaataggcagaaatttagcactattgaacatagtagtataaaaagtagtaagtaggaacctagag

SEQ ID NO: 564625 - DNA, 210 bp, Homo sapiens
  misc_feature (4)..(5): n is a, c, g, or t
  misc_feature (73)..(73): n is a, c, g, or t
  misc_feature (75)..(75): n is a, c, g, or t
  misc_feature (88)..(89): n is a, c, g, or t
  misc_feature (94)..(94): n is a, c, g, or t
tttnntttttccccactacagaacttttttgaagaaagagggaaggggaaggcgaccccccgcccccacctcntnctcctcgcttcgnnaggangcagaagagcaggagagcacctgccccatctgtctgggggagatccagaatgccaagacattggagaagtgccggcattcattctgcgagggctgcatcacccgggctctgcaggt

SEQ ID NO: 564626 - DNA, 1532 bp, Homo sapiens
  misc_feature (302)..(302): n is a, c, g, or t
  misc_feature (413)..(413): n is a, c, g, or t
  misc_feature (492)..(492): n is a, c, g, or t
  misc_feature (1155)..(1155): n is a, c, g, or t
  misc_feature (1299)..(1299): n is a, c, g, or t
ggctcatcaccacatatgggtgctggtgtcatcagttggcattattagcaaaaatagacatgtactattgcctatcagagaacagccacctctcacagctgctctagtccattcaaaggaagcagaaaaacgctaaaagcacttctctcttattagctacatttagatgttggaagaaaaaaaaatgagacttgttctttcttctgtcacaccagcaacatcacctagacaaatgataatggatatttcccatcaaaaacacttctcaaacttatacttctatatgttctgtcatagaaatngttttcaagccagtttccttttgccaacattttccccgtcctcttaatacatgttggagtgaattggggacaggaaaattatagtaagatggaatttgaccagtgattttngtcctgagagggagatatgatttcatttagggaacctacttgctgaatttcatcctgcagagttaatcattcttgtatntttccttatatcaaaatcagctagagttagcatctacattattgaattgtcatctttttgcccatcactttagaggtttttaagcctgttgaacttagtatataattatctcagctgtgctttagacaattaaaatggttctttaggcagagttgttgagctcaggggagtagttggtctttttgatttttcttaggaagtaccagatacaaaaacccatgagggattcctggatatagaacagggattcgataagagaaaatctggcatcatttctttacaggacacattatagcttcaggaggcccttggtctttgccattgctgttggcaggccttgtaacaaaccattcttggagggccttgtgggagggatcagttgtgcaagtgaaacaaagacttttggataactgactaacatcaaggcatattgatggcaatcagcaatttgagtcaggaaaaggactagcctttgtatctcccttgtttcctttctcctccatgtaattttaattcctgatatttccagctatatttgtctgttgtcacctgactctgtgtttgcggacgcagttctgggtctgaagcagcccttgacctctctagacagcatcaaagaacttattaaaaaaaaaaaaaaaaaagaagggtccctagtgcctntttgccatgcccttccttgatctccttcctcaaactaagaaaattctatagcctttctatttttatgggctgtgcaagcatgccaaatcatcaaggtaacaaaagactacctcttgattttccagcttgaatgatatattttgngggaagattaataggctctatttatatattttttgagatttttctatttcaagaagcatatttagttagaaatagacttttaatggaatatttatatatataaatgccacagctttggtttaaatcgcagttttgtcaacattagccagctaaggttcacttcataggagaacaatggaaaatatcagttttagcatcaataaaggtgaacggttattaacacaagaaacaag

SEQ ID NO: 564627 - DNA, 182 bp, Homo sapiens
tgcactacctcttattgcggcgccaccatcctcgcagtatcactctctctcatactatgcacctttgaatgttcacccagccataaagggatcactcagaggactccatcgtccctgcccacgaggtcagaactgagtctctgcctctccctgctactatccacggacaccttagctttgta

SEQ ID NO: 564628 - DNA, 708 bp, Homo sapiens
tacgtgccattccctagagcgttaggcgtgtctcggttcttaagacctacaatcggggtacgaggtggagagcgggcctaggggcggcatctccgaagacgtcgagaggctggggcacatgatacacctacatactctcttgtgcaatgcctacttgaggcggccagttaatcatcctgtctctgccctgcggctgagttgcacgcagatcgggcagtcctaccgcattgtggctgctcacaacaagtgtcccagggcatggccgtatacgtagagcagctgggactccgtatgatccattgcccaacagtcatggagaaaaactcgttgccctcaatcctactacatggatcctgtcattggattggctgcgtggtgcccaccatctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgacgctgactttagtgagcatagcagtgggaacaaggtcaaggtccttttgaaacactgcagcgatcttaatttcgtcacatctcggagttcacatacaatggagtatcctgagttgcccttgctcttctggcctggcctgccacacggcccag

SEQ ID NO: 564629 - DNA, 190 bp, Homo sapiens
agacctgtgggccgtctgtgtgtcctgcatctgcatgaatattcccgaacgtggccagtttcgcttccatgtctggtctgggcaacgtgggattcttgggccgggatttcactgggtttttctgacttctcgtggagtgcccaagattgagctgagggacctcagggatgcccgaatgctactaaagctc

SEQ ID NO: 564630 - DNA, 282 bp, Homo sapiens
ggtctgtaccacagagtctcattctgtcgcccaggctgacgtgcgggcgtgatctctggctcccgtgttcaagtgattctctatgcctcagccccctgagtagctgggattataggcacacgcaccatgcttggtaatttttgtattttcagcagagacagagttcatcatgttgtccaggctggtctcaaactcctgacactctggggactacgcctccctcggcctcccagactttgacgaactttggaaaactttacgttcccctctttctgtcgggac

SEQ ID NO: 564631 - DNA, 898 bp, Homo sapiens
actcgtgtggcccgatgtggagctgcatctgtgtgggaacttcactctgtggctgccaacctgctcacctacctgctggcgtgcagtgcgggacccctgtggtcctgtgcgctgctcaatggctgagtatctgcttggctggcgcagatgggcaagaactacatcagctgccttgtgggagcttgcagctggaaggcccagctccatgcatgcaatgatcatgtgccccgtggccttgtcaccttgtcgtgagctgcatcacgccaatggtctcttacgggtcctggcagggagttgccagaaatgcatccaccttgtgctgatgggtctccacctggggaaaccttcttggtccatccttgatgtcggaacaatcttacccaggacggtctccttgccgttcaggttccacatgtggtgacctggtcatgccaactttcaatccttcatgggtgcgcagagggactttgcccttggttgctcggtttttgggatgcctcttgcatgctgttgcttgctgtgggctgatcccctcccatggattccgggcggccccagggcaagctggtcttggtctcacccagaactgcatccaccattcactggtggacccttgcaacattgcgggcttttctggtgtggcccccttgtcctgggtctgtcgcaccttccttcatgtggagcccagacgcgtgagggctcatgcggacgggtcttccctccgggggcggtgctgctctaccggtcctcctttgccgtgtccattccttgcgcaggtgaaccagtggaccctagctgtgcccatattgtctgcggggggggctgcgggccccatctgccgggtcggacctctttccttgccggagcgttgggggccttcctccagagcgtctccgga

SEQ ID NO: 564632 - DNA, 491 bp, Homo sapiens
  misc_feature (62)..(62): n is a, c, g, or t
  misc_feature (73)..(74): n is a, c, g, or t
  misc_feature (134)..(134): n is a, c, g, or t
  misc_feature (186)..(186): n is a, c, g, or t
  misc_feature (192)..(192): n is a, c, g, or t
  misc_feature (319)..(319): n is a, c, g, or t
  misc_feature (328)..(328): n is a, c, g, or t
tctaaaacaatacaaacaaacaagacaaaaaaccgttccaaggctccgtaagctttaggcancccagagcccnnctctgcccggctgtgggaagttttcgttagggctacgatgttggtgccacatctgctgcntgtcctcagggggctctcatcccacagcagagatctgtcataggttagagcngtctcnacagaagcaacacctgaaaggcatccaggggagccagttctggggcaggctgaacctgcagcttcacttgccatgtaaattagagactggaaaggcttctctgacttcaatcttcctcttctgcaanatggagatnagaccttcctggaaaggttaaaataatgaaccataggtgaaactgcctggtctagccccaggcttgtcctgggagctcaggaaatgctgatgaaagctggatggagatggctcaggggagcccatgcctttcattgggatagtctgtcctgctgtctgtcaaa

SEQ ID NO: 564633 - DNA, 405 bp, Homo sapiens
tcgagccggtcccagggacaagcaagagttgaacgtcgacgtagccgtgcgtgggcatagtggaaaaggggaaggccataggatgccgcattcagtctgtggaagatggggatgattctggcacaagcaaaaatgattgaagtttatgtctagacagcacctctaccaatccatcttcagctgactgaatgtcgtatgatagcccttctccaaagcagaggtagaatgatcaggtttcaccatggattttgctactgatttcgttttgggaatcaccttacagattcgaggtccctttggtatatattgtttattctttagcttttttaagaaaataatttggtgtcatatttaaagcacttgtattagtcaatgtttcgtgttccgctgttgcttgtaccgctg

SEQ ID NO: 564634 - DNA, 124 bp, Homo sapiens
tgcctggaggtcctgcaagaaagcgagggtggcattgacctttagtgaccatacaaaataattcctaggacctatacgtcagtgatcaaaaccaatgtgttgttttaccctcggctcttacctt

SEQ ID NO: 564635 - DNA, 107 bp, Homo sapiens
tagggttcatcctgcctccaatactggtgtctttgcccgcctcggtcagcggcaccctgtgcccgcgcgctcctcctggcgacgccgccctgtcgggctagtcgggg

SEQ ID NO: 564636 - DNA, 1001 bp, Homo sapiens
ggactgaggctcagaggagggaaggcagccggggctcagctgttacttgtatggagtccttagcatcctgggcaggctgaaaagaagacttcctgcagtcacatggtttagtttgatcacagaattcagagaccaggacaccagagactttcccacttccagtccacagccttttcattttagccatggttctggggctagctgattcagattgcagtgggctggggtagatggagccgtgggtgtctgtaccttggtaagttacgcacgtaaattcagatttatagccaggtttcagcactctgctgtgagagaatgtactgcctctgtgtaagcggaagtggaatgtgggaagccagatcggattctgagatgcatagtgatgacttgaccagagcatgacagaggggcctgaacaccggtgatccacccggtggtcgtagtgcatgtgggcctgaccagggagctcgctgtggagcggctctaggtgtgacttggaggccgtgggtacgtaaggctctagttcctccttgctgagctttgggagcaccgtgggctgcaacttcctccctggcagatcccagtagatctgtgcgcaagccaagtgagtgggaaggcactcatacagcaggcccagggccagcaccactgacattcctgcttactgtcagcgctctgttctcagatgttttcattctgggtactaatctagctctccaaggtttccccaggggccaagacttgtgttttccctctggtacgccaagaggccctggcaccgtcctgggagcacagagatgtcagggatggccaggaagaagagccacgaagggctgttggccggaacgggattgcaagctctagtgggcccgggaccgggggcctgcgcaggctaggagacaagggggtccacacgggggaagaggaaaacacggagaacgggggacccgctcgaagaaaaatcggcgacccgcaaacaggacgaaagcggagtgatatgc

SEQ ID NO: 564637 - DNA, 470 bp, Homo sapiens
tggggtgatctgaggatccttaaaataaataaaataacaaaaaatcatgaaacatggaaaatttataaaaatgcaaaatgctctggaaagtccctgtaatacaattgaacaagtagaagaaaggaattcagagctctaagacaaggtgtttgaattaacccaatacaacaaagacaaagaaaaaagaagaagaaaatattaacaaagcctccaaggagcctgggattatgttaaacaaccaaatctgaaaataagcagtgttcccaaggaagaagagaattctaaaaagcttggaaaacgtatttgggggaataattgacttccccagccttgccggagatgtagacatccaaatacaagaagcacaaagaatacctgggaaattcatcacaaaaagatcatcacctaggcacattgtcaccaggttatccaaaggtaagacaaaggaaagaatcttaagagctgtgaga

SEQ ID NO: 564638 - DNA, 141 bp, Homo sapiens
gtcacatcattttaatgctttaccaggtgcacacatatttgaggagattgcaaaagattacagaactctgaggtcgtataggggagcctgtattctctatttctttaagccgaagtgggtctcagagcagtggtgatatct

SEQ ID NO: 564639 - DNA, 314 bp, Homo sapiens
catgcatgtgaaggttctgttacagatttaaactcatatcacagggtttgtgtatagattatttcatcacccaggtattaagcccagtacccaatagttatcttttctttattttattttattttactttaacttctgggatacatgtgcagaacgtgcaggtttgttacataggtgtacatgtgccatggtggtggttcgtcgcctatcaacccgtcatctaggtttaaagccctgcatgcattagatatttgtttcaattttctccctccctgctccccctcacctctcgacaggccccaggtatactgatg

SEQ ID NO: 564640 - DNA, 208 bp, Homo sapiens
ggggacttgagactcaccggcccgacgccatgagggccctgtggtgctgggcctctgctgcgtcctgctgaccttcgggtcggtcagagcttaccgatgaagttgatgtgtgatggtacacacatagaagaggatcttggtaaaagtagagaaggatcaacggacggatgatgtaagtagtacacagagaggaagagctatttacttt

SEQ ID NO: 564641 - DNA, 129 bp, Homo sapiens
ttcaatgaaatgcttgtatacaatgatataacaaagaaaccctaagacaacgagaacttcaactaagtgcactcatgcagaatctctgcggggagaattttttctcggggaagtaaccctgcctttgaa

SEQ ID NO: 564642 - DNA, 120 bp, Homo sapiens
cacgcacaggattgactcactctgttctttgattttaggtccgctatctcctcagtgtgagtgtatatatatgtataagaaagagacttatagataagtgataaagggggtgccgagacg

SEQ ID NO: 564643 - DNA, 206 bp, Homo sapiens
actatttcctggctgtgtgacctttagtaagtgacataacccctcaggacctcaatgtcctcatctgcaaaatgaatatgataaaagtgcctatctcccttcccgcagggttatggtgataaggaaatgggttaatatacgtaagtatctcaaatagggtttggtatactaaaagcactgggtgatctttctaaaggactggcagg

SEQ ID NO: 564644 - DNA, 1188 bp, Homo sapiens
  misc_feature (206)..(206): n is a, c, g, or t
  misc_feature (210)..(210): n is a, c, g, or t
  misc_feature (941)..(941): n is a, c, g, or t
  misc_feature (1036)..(1036): n is a, c, g, or t
acctctctcctacctcccccttcacaatgctcacatactgaatattgcacctatttctcacaaagcccgaaatactgctaccttcttgccctctctgccttcatgcagcacctacctgctaacatcgacacggcacatcaatcacatgaaccactcctctatcgtctcaactccgacctctcccactctaaataacacacgctacnctcngccaccttcgcatctccactgctacactacgcaccgcagtcccccaccctatcactttagcgtcgccaatcgttcatccggtcctccatcccctattcatctccgtcctcctccccgcacacttcaccaccccctctctatcttcccccctgtactcctaccccaccacaccctcctatcatcatacgccggtcaccgcccactgcgcatcccttctacttcacacgacaccccctatcacacacattccctcaccacctatataatatccactatcctctccacattgctcatccctcacatctcctcccccatcaccattaccactcccgctcctcttcattctcatcatctgtccctagtctataaacaatccctcatcctacccctcactcacctccccacccaccctccaccccccaatatcccataccatcctctcacttccgcctacccacctcctctatctctcccaccgctacctcctttccactaccgtcctcttccccctccactctactcccatctccttatacctcatcctctccccctcactcttctcccttccttaactcccactccttatccttcttctctcccccctatccccacacccccctcttctcctcactctaatatctctcctgcacatttcctcttctccctgtacaatcccccctctctcacatcttccctcccccccaccccgcatcaacatacttccccccatncatacatctcatctacgctcacacctccacgctccccccctatatcatccaccgacccttcacactaactattcctcatccccactcatcttttntttcccctcccacccctctcaccacctctctcccctcctccacaccagccccactccactctcattctactcgtaacccactcccctccaccttcatatcacttcgcgcctcctccacctcctcaccatcccctactcattccccaccaccg

SEQ ID NO: 564645 - DNA, 169 bp, Homo sapiens
ctaacgcgaacatgccctgtctattgattttgataaaccgtagagaccatgggtctggctctgtctgcccagacttgtctcaaaggtccttgccgtgaagcgatccttcccacgggtcatcctcctagagtctgacctagcagtgcatgccaaacgcttaggcactagg

SEQ ID NO: 564646 - DNA, 496 bp, Homo sapiens
  misc_feature (203)..(203): n is a, c, g, or t
aaagaagagaaaagaggaataaaatatatcaggcaaatcccttatcctcactggcttcaatttccccgcccacccctcttagtgacagggaaattgaagccagtgaggataagggatccttacctctccgcactcttctgagacctggcagatctgagaataaacttcagcaatgacagtggccctggagagcacaggaaggncctcaggaggggactctcctccttccaccccaccctcattccaccccacccttcctcaccccaactcacttgcagtccagccctcccccaggaggtaaatctgggatgtcctctgaggccagagtcctgaaaactgtgttcaggctggggggcttctgagcagaggcacacagttctgagaaagagtcaagagttaggctggggcacagtgggcgcacgcttggtaatccccagcactttggggagaccaaggcgggccggattcactttgagggccaggggttcgagaccag

SEQ ID NO: 564647 - DNA, 323 bp, Homo sapiens
gcgtcgtgcggtcctgggaccaggatcaggaaatggttcgagacctgggatgaggaagtcgtgggcacttaatcaaatgtggggtttcgagagacgacggaacagacaaggatacaaatttccatgtggccttggagaacgtggacaccactatgaaggtgcacatcaagagacccgagatgacctcgtcctcagggtgagccctgcggggccccttcaccaacccctccgtcctgtcccggacacaagggtctgcatagcgtccatatcaagaggtggccccaggacgcgggcatcccaggctcctgctgtgcttgggcaag

SEQ ID NO: 564648 - DNA, 1175 bp, Homo sapiens
tcaaaccgaggccaatggttatttagtttttatttcataatcataaatcttaactcggcaatccagctaggcttgggagggaacaaggaaaacagtggaccccaagagggaaacttacaggcaagaagcacaaagaattctaggatacgtgcgaagcaaagtgggggtggagggggtgctcctccgtgagctacagaaaggaagtgatcgtgggtggttaagatataaacacaccacaagtctcaacacttaattcgaagttgtgcgtcccacgagctcaagccaaaggggtgaatctttctgtgtggcgggctcttgtgcccaaatctcctgtggcacccaagaggcgcttccgagtgggccctccacaaaattattatcatgtgcgctttctttcacacatttgtgcccacaaacacccaacatgtgcttgtgcccaattcacaaacacaacttcaagctcttgaggcaaggtgtgcaagatgtgaaaaaacctgtgggagaaccccattgtgtggtgttgggggctccaggacaattttgtgcccatgtgggaccacaaaatgtgcccagagagatccccgcgaatgtcgcgttatggagatgtgaagagttcccctcattctttctcaaaattttctcctcccacaattaaatgtggaccttttgccccacccgagtgtgcccaattttagtgggcgcggtgtgtgcagagttcaacccaacccgcgtggacaacattaaaaaccccggggaaacattaaatccggtgttgcaaaacagcaggagaacccccgttataataacccaaaaattccatttccttcttcccggggggcctacagaaagccacggacaaaattatcgcgggcgcgggagtctttgggggaaacccctggtttctcgagcaaaaagagcttcccaagagggaaaaacgccgcgccccaaaagagggccccccccgatcgaaaagtgcccaagcgtgtcgaaacaacccggggtggggtttagacccggtgggtacaaacagacaacgcggagaaacacaaccccacagcggcaacatctttgatagccccttgtggggcccaacaagcttaaagggtcttgtcacgaccctgggctggagaacacgttggccaacttggagagccactggagaccccacacgtggg

SEQ ID NO: 564649 - DNA, 363 bp, Homo sapiens
  misc_feature (74)..(74): n is a, c, g, or t
  misc_feature (79)..(79): n is a, c, g, or t
  misc_feature (96)..(97): n is a, c, g, or t
  misc_feature (103)..(105): n is a, c, g, or t
  misc_feature (325)..(325): n is a, c, g, or t
ccaattattgctttagattaatatctatagaaaaaaaatagtctctctgtgcttcactagtttccgacggcccnttttnaatgcagttttaaggannccacannnaatgttgaaactgtgtatgacagtaactatgtaaaaggcactttgaatatccaccccatgtatcttcaaaatagtctcatctcaagctatccttctgatatattactataacatagagaatccaatgaaactgtcatttctgcctgtaggacaacgaaaactttttaattttcaccataaagggccccgttttaagccctttttaatttttaattccccntctttttttatatcctcctttttttgtgtttttttttt

SEQ ID NO: 564650 - DNA, 135 bp, Homo sapiens
gtcgtaatgcttagggtgaaaaatcctgggccagacagtgggtacagagggaggaagagaaaagggaaaaaatggagggctgagaagtggagaacatatagaaggagacactggaaaaagacaaagctgggggca

SEQ ID NO: 564651 - DNA, 363 bp, Homo sapiens
  misc_feature (321)..(321): n is a, c, g, or t
ggggcttgttcgctgtgtgggcgtcggagccagatgccggactgggtcagcgctgatcacggacgttgcagcttctgccaattcttcgccaactatgctgggccgtgtcgcctcattcttgcctttgtcagttcctctattcaactacgttggcccgttcaaacaaatcccaagaagcaggaatgaaagtggcgctttctccgacccagggtttccagggaccaataagctcttgaagcgcaaagcaatgcgacgggcgtatcgcagcgggctcttccacacttttcacctttcaattccccattttcttaaaccacaatntcaaccaaagcaatttaccaaagagcccaaaactttacaagc

SEQ ID NO: 564652 - DNA, 254 bp, Homo sapiens
acattataatgtcgtgtacattaaaaattcaaaatgtgggaaaagggagtggtgtaaaagcattttttatgtgtgtgtacacatatttgtgtcagaggtgtgatcgaagcttctcatcagctttagaataactcttttattagctacaatgatatattttctaagctctcatggcttatgatatagctataggtctatagatagattacacattatataaataagcaggggtaccgcagctcgaagttcgatca

SEQ ID NO: 564653 - DNA, 534 bp, Homo sapiens
gagcggggtggtaagtgtcaggccgatgtgtccgcccggcgaggggccggggtcgggggcctgccggggccatgctgctgcgggtgcatggtgcaagtggggccatgctggggctgcaagatgcggagccgcctcggagcctgagcctgcccctggggccggtggcctgtggggagcccgctgcggtggccctggcctggcccgggggggagggagagcagaatgcgatgcagccaggtgcgggagcaggcaaaatggccgggcagtaggatttatcattgcgggccattcacatttacacgttggccttagggagactatcacgagatccatccaaacaaggtttggcatccataatcaagaaattccacgggaggagcacagaggaaagcaccttcacaggaagagtggcccaaaggacccaaaggatcacacgaatattgaaggacaccatatcagagcagcaggggcaccaccacagaggggttcccaagcgagacgcaagatacagcacggcagtaggatgacccaagg

SEQ ID NO: 564654 - DNA, 294 bp, Homo sapiens
tataaagtagagtacgctacacacctgtgctttcacgatcgagtaccgcagctcgatagttcccatctctagtcgatcctcgtgccctgtttgaaattcgttctcctaaaggggaagaatcgcttgggcccgggaggcggagtttgtagcgagccgagattgtgccattgcactctagcctggtgcaacagagcaagactctgtctcaaaaaaaaaaatagtaatgtgtcaatatagggtcattacttgtgacagatgctccatgctactgtagattttggcttggccttatcg

SEQ ID NO: 564655 - DNA, 282 bp, Homo sapiens
aagtttggaaacctaaggcccctttgtcctccctgggtgggccaaggtttgggacctgttttggactgtgggaaactcaccctccccttgccaggcctttcccctgcaggaatggcattgcaatagtttaagggggcccctccctttgatcaacctttgtgtgcgagggtttaaatagggtcgaacccaaaaatgggaaaaaaaggggtgggccaggggctaatggtgtccctgtgtaaagtttttgccaaactagctctataaatatatgaatatggccca

SEQ ID NO: 564656 - DNA, 341 bp, Homo sapiens
  misc_feature (336)..(336): n is a, c, g, or t
ttgagacagagtttcgcttgttgcccaggctagaatgcaatggtacgatctcggctcaccgcaatctctgcctcctgggttcaagtgattctcctgcctcagcctcccaagtagctgggattacaggcatgcgccaccatgcccagctaatttttcatttttagtagagacggggtttctccaagttggtcaggctggtctcaaactcctgacctcaagtgatccacctgtctcagcctcccaaagtgctgggattacaggtgtgagccacagtgtccagccttcaattcatttttaaggagtgtaaagagatccagaggacaaaaaaattttttngacaa

SEQ ID NO: 564657 - DNA, 962 bp, Homo sapiens
  misc_feature (353)..(353): n is a, c, g, or t
  misc_feature (440)..(440): n is a, c, g, or t
  misc_feature (486)..(488): n is a, c, g, or t
  misc_feature (739)..(739): n is a, c, g, or t
  misc_feature (835)..(835): n is a, c, g, or t
agcggggtgggcccgtcggtcctccatcggccgcttccacttactgagcttgttgagctccggggcccgtgcgagcgtcgcggccgaggctcctgtgggtaagaggacgggggagtgttcaccgggggtagcagtctgcgtaccactatgtgctcgtcgcaggcgcccgagtgcgggcataggaccgacggtgcgtcccgtctccttgaggcatttccttcgtcctggcgcgggttctggacggctgaggcgagttggacatgccggtgcatctgccttgagaacggcgagctcgtccatgagttcgagatggatgatccgaatcgcacagaaaacctcgtgtcgcgcagagnataccggttgcagagtcggagttggaatacaggactttcacacagattcgtggtccacatggagactgacgttgagatatcgctacncgagtggagagatgactactgaaacgcagttattgtagcagaggcnnntttggagtgggcgagacgtatgagtaggactcttgtatatctcgtaaagtggaatgctaagcataggtcgcgtacaggacgaagttctcgaaaggaacacatagcatacaaaggcaatcacacaagccatgggagctactgtctacgtcacggggaaaacagcgatgcgcgtatgctagaggtgcggactgtagtgcaacgcaagggaaccaatggaagtatgactagaagaagtgttacctaacttgcancatagtcccgaggttagccatcaagggcaagatccaaggcaagggctagtcgatttgccctaaatttgacgagtcagagcaactgggtatgatgcncagtagtagtcaagcgttgtaacttgcgcgtgcaacagagtgaaaagggtgaaagctggaaagaggaacgtaagaggacaatggtgggaagcaaggtcgcggaatgttggaactgaagtgcctggaa

SEQ ID NO: 564658 - DNA, 452 bp, Homo sapiens
ccctcacggattacctcaagtgatccgtccatctcagcctcccaaagtgctgggagtacaggcgtgagccgctgcagctggcctgcatttgcttatgggttcttggtcatgaagtctttgcctaagccaatgcctggaaaggtttgccagtgttatcttctagaatttttatggtttcaggttataaatttaagtctttggttcatcttgagttgatttttgcataatgcgagagatggggatccaggttcattcttctacatgtggcttgccaatgatcccaccgctgattgtctaatatggtgtcctttttccactttatgttttgtctgctttgtcaaatatctgttgactgtaattattcgagtttatctctgggttctgttacctgctctattgatctgtatgcctgtttttataacagaaccatgctgctttggtgactatggcct

SEQ ID NO: 564659 - DNA, 729 bp, Homo sapiens
tgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggcttggcaatgtggaagagattcctgagaatgacagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagaaaaaattagctgggcatggtgtgtgtgccttgtagatccagctacttgggaggctgaagtgggaggatcgccactgcagcctcccaagtagctggatcgcttgagcccagggtattcaagaccagcttgggtaacatggtaaaaccccatctctacaaaaaacagaaaaaattagctgggcatggtgtgtgtgccttgtagatccagctactgggaggctgaagtgggaggatcgccactgcactccagaaactaaaaaaagaaccatgaaaaccttcacaaatatatctaagccaaatggatggctgggtctgcatccagtactcgaaggtaggcaggaatcgttgcccaaattgggggg

SEQ ID NO: 564660 - DNA, 423 bp, Homo sapiens
ctctccattgacggcacaattgggtggagaagaagggaaggggtatgattgtcctgatggctcaggcttgcagtgaggttcagagagggaaggaggaaaggccaggctggcaggctggcgctgttagcacttcctctcccacagttcagacaggctcactcgtgggctcagtgtttgccatggtcttcctgttggtccaaacataaggccctgatccttagtcctggtgccctgctttgactttctggccgaggaggcctattttgtgcatgctgtctgttgcagtggctagctgcgatggcccatcatgctcatgtggccgcgatgtagcgccatgtgacgcggaacactctgctgctggcatgtatgcccctggtggtctggaaggccagacccaggcgcccccacacggtacggtagcag

SEQ ID NO: 564661 - DNA, 409 bp, Homo sapiens
  misc_feature (9)..(9): n is a, c, g, or t
  misc_feature (11)..(11): n is a, c, g, or t
  misc_feature (46)..(46): n is a, c, g, or t
  misc_feature (66)..(66): n is a, c, g, or t
  misc_feature (403)..(403): n is a, c, g, or t
attcggcangngggaaaggatggaaagctggtcaacgggtacatanttacaattagataggagcantaagttcctgttctattgtacagtatggtgatggttaacaataaggcattctaggccgggtgcggtggctcatgcctataatcccagcactttgggaggccgaggcgggtagttcacctgaggtcagaagttcgagactgggctggccaacatcgtgaaacgtcgcctctactaaaaatacaaaattagtcgggtgtggtagcacacgcctgtagtctcagttactctggaggctgagacaggagaatctcttggacccatgaggcggagactgccgtgagctgagatcacgccactgcactccaccctgggcaagacagagcgagactccgtctcnaaaaaa

SEQ ID NO: 564662 - DNA, 152 bp, Homo sapiens
ttgttatgattgctgggttgaataggcgctggcgactgcttctgcgagcttggcttcggctgcaggagtggaggggacatcggggctgtgaccggaggttccatgggcccagtgatagggctggtggatgggggctgcaccgtatccacatg

SEQ ID NO: 564663 - DNA, 236 bp, Homo sapiens
gctgcagttgtctgtgagccgagatcatgccactgcactctagcctgggcaacagagcaagactttgtctcaaaaaaaaaaaaaaaaaacaaaattagttgggtttggtgcctttggcctgtcgtcctagctactcaggaggctggggcaggaaaatcgtttaaacccaggaggtgacgtttgcagtgagctgaaatcaggccatatgactttccagcatgtgattacaggagatg

SEQ ID NO: 564664 - DNA, 302 bp, Homo sapiens
  misc_feature (37)..(37): n is a, c, g, or t
ctgcctcctctcaggcttagtatctcctgctcatcantccagtagctaggactgacagtgtgtgctacatactggctaatttaaaaactattttgtagagacagggtcttactatgttgccagagtgtctttgactcccatcctcatggaatcctaccacttcagtctctgaaagtgctaggataatagacatgagccatatatgcccagccagttttcttttttctaaattgaagcttggcaagcagagggacatgtataagggaaatagcttaagtttagagtgggtgtcagtagtcagc

SEQ ID NO: 564665 - DNA, 178 bp, Homo sapiens
agcagcggtcttacctgttggctcactgcccaagctccaggtttggctgaggtgaagtctgcccctttcagaaccacgtccgcttgcagcacccagcccgctaataagccattgaccttgagtttgagtctagggctgatttgctgctctgtctgggggaaccccaggggccttgtgg

SEQ ID NO: 564666 - DNA, 115 bp, Homo sapiens
ctgagagattataatctttcatatgctgcatttgatttgctagtattttgttgaggatatttgcatcaagtattcatcggcagaaaatggtctgaagttatcttttttgtggtgg

SEQ ID NO: 564667 - DNA, 980 bp, Homo sapiens
  misc_feature (568)..(568): n is a, c, g, or t
catgcagtaatccttctaattagctatcctctacaggcaatatactctccggacaatgaaccataaccaatactaccagatcaatatacttcatcattaactaatcataagtggctatagcaattaaaacataggaatatagcccccatgttgcatcttctgagatcccagagggttaccccaagggcaccccgtcgtgacatgccggacctgcatttcttctcaacaatgacaaagaaactagccgccgcacagtctcaaatcatattagccaaagtcgttctcccctcagcataaaacgtagggccttgctccgtctactctgcctgcaatcgtgtatgccattcagtatgcagggcagttggacggtgagcttaaaaccaatagcccaagcatatcgcgagaatacttagcgcactatcgtcctcaagattaacccacataaggaatgaagtacatcagacaggtatcctagcacggtatcgaagcgcgcataagcacttgatcgcaattgcatgtaattgtatatactacttttagtgaatattacttcgcctaatctaatctnacccggcaattaccctacttaactacaagcatgtaaaagcatccaatgtcatcaccgtaaacccttattaactgattttcgcctacctgaaaagcgatagctagacgattgatctagacaggcgcttgtaatttccaattacagcgcatccgtcttccgcataggagtggcttgccccccgggctaaacgctggggtttttgtggcccccaatagtggagtccattttactccggaaacgaaatttcagcaaagaaaaccagaatagggcctccattcattccacccaaacctattccgttaggacacaaccaatacaatcgcttcctttaagaggtcttacgatctaaccctaaaggcctttaggtctaacttcgacactgcaaatcacaacttagtcccccatagtctga

SEQ ID NO: 564668 - DNA, 463 bp, Homo sapiens
  misc_feature (291)..(291): n is a, c, g, or t
  misc_feature (339)..(339): n is a, c, g, or t
catgaagggattgggaagatgttgttcaaagggtacacactttcacttataagatgaacaagttctgggggtctaatgtagcacatggcaactatggttaacaatactgtattgtatacttgaaatttgctaacagagtagctctcaaatgttatcacacaaaatggtaactagatacagtgatcagtgtgtgttaactgattgattgtggtaatctttcacaagtctttgttaaaaatctacacattatatactaacatctacctatgtccatctagccctaaagagcgncaaattatatcatatggattgtgaccctacacaacgtgagaatttaantttcagcctgagtttcagtttcaattccaataccactactttctatgtaatactgaacaagttttctcaacattctataacaaatattccaacccctagtggggtagaaaaacttacttttttt

SEQ ID NO: 564669 - DNA, 439 bp, Homo sapiens
  misc_feature (26)..(26): n is a, c, g, or t
  misc_feature (160)..(160): n is a, c, g, or t
  misc_feature (191)..(192): n is a, c, g, or t
  misc_feature (369)..(369): n is a, c, g, or t
gtaattaatcaaagctacaggaactnaaaacctcacttaaggaattttaaaataaaattgaaagcttcatcaacagactacaccaagcagaagaatttcagagcttgaagactggtctttcaactaacccagtcagacaaacacaaagaacaccatgtanggaacaccgtccccaagaaatatgggatganntaaagtgatcacatttacaactaactgggcattccaggggagagaaagagacaaagtaagccacctggggaaaccattacttcagcgaataatttacggaaactttccctaattcgtgctaggagaggtaggccttccatatgtcaaggaattccaggacaacaccttgccagttantaccatccaattggaacaccacggaggacttccagttcacccggcttacgggttcaccgctttgggggcc

SEQ ID NO: 564670 - DNA, 196 bp, Homo sapiens
ggaattgccgggggtgtggtggcacgccggacctcagacaatagcccaggtagcgcgggacatctggtcgacctcacaggacctcggacactaacgtgagtggcccaggagagctggtggacatcacgggcactcggacactggtctgagtcgcccgggagagcttgtcgaaaccgttcacttaatgccgctagcg

SEQ ID NO: 564671 - DNA, 139 bp, Homo sapiens
gtgtgattatgcgtcttctgctttacaactaaatggaatataacgttcatacaactacccgattgtcactttaacattcctacaacgcacccaaaggatcccaactaccactcattttaaccccttctgtcgtcttctc

SEQ ID NO: 564672 - DNA, 217 bp, Homo sapiens
tttttttgggggggggggcccttttcccccccccccggggggccccccccttttttttggggcccccccctttggggtttaccccggggcccgggggtttgggggtttctccccccccccccccccccccccggcccctcccttttttttttggggttttttgggggggggggccccgggggccccaaaaaaaaattaaaaccccccctttttccca

SEQ ID NO: 564673 - DNA, 194 bp, Homo sapiens
gggagaccacctaactaccaccacctctctgttatacagcactttctatatcggcagttcatacagtattatcttactatatcctcaaaacaatacactcccatctccatctcacagaggaggaaactgaggcatacagacggtcgatgggcacaccttatggcagggggatccacatagaagtcgacactgca

SEQ ID NO: 564674 - DNA, 274 bp, Homo sapiens
gccgacctgcgtttctgcggtgttttagcggcggcggcgtcacatgacaacgagttcatttcatgcggaggggcctggggggtcgctcggcggggcggctggcccaggcttcttgttggcggggtggtgcagcggggtggcggctggggttgatgcatcaatgctgggctttccagctatctgcccttctctacgcgacgggggcctccttgtgaaacgtgtccaggcctaagcactgccccgctagtttgccagtcccctgagagacgaggcc

SEQ ID NO: 564675 - DNA, 1015 bp, Homo sapiens
gagcggggtcgccgcgccggccgagagggggccggatcccggaccatggcggcgtgcggggtggcgccgaggggcggcgcgcggccctggaggcggctgtgcggcggcaggttcctgagctggggaggcgggagcttgcgtgctgtgctgcggagacctggaggccactggtgcttgggccgcatgcgaacacccggtgtgcttacctgcttgcttctaccaaggatgcggggtgctctgcgagcagccgctactgcgcccgtgtgccgcggaggagctgctgccaaggttggtctttgggaacgaagcttcctgccttttgccagcgatccccatccaccagctgcagcattgagcacgacactctgatatctactcttgcaggactggcacacagggtgtaccgcatttgtacaggcaggctagcgtgcaagcaaccgaggttgccccgcgggttgccccagagagcttgccacccttttcaagccgtcattccggggaccctgggagcaggcaccatttgccgcgacggcagccacacttgacgcgctcctttcctagacttggcccgatcgcttgtgcccttccaagcaacagtttcagcaagcacttctttcagccattagtgacgccgcgcaaggtcgcgtcacctccgcggccaaagggacccttgggccccgggacattcggcatttgccaggggttgaaccacccgaatgaccgcgttcgccacccgtgtggggacaaacaccggcgtccgtgcgacggtttcgctggcttcaacagaaggacgcctaaaccctgggagccgccaactgcattcgacggccttggtttttagcgccactccttgacagcccgtctgaaaccagcgcgtagtctcgtgcgccacagtttctttcgcgcactaccgtgacaggggtgggcacccgcgaggcagtcttaggtaaccacgagcaacgtagtggccctaccccgtgctgtagtgaatgcacctttcctcggggcgacacgc

SEQ ID NO: 564676 - DNA, 544 bp, Homo sapiens
  misc_feature (473)..(473): n is a, c, g, or t
gggagatctggatggcatctacttcgtatgactattgcagagctgcccatgtaagacggggatcagcgctgtaagcttctgctggggataggaattctggtgctcctgatcatcgagattctgggggtgcccttgatatatcttcaccatcaaaggccaacagcagagggctgccgggacgggccttcggggcaggtgactggagatgtcagcaagtgtcacccatctcctgcaacgaagagctgaccgaaggcccagaagggcttgcaggatgtggaggcccatggccagcagctgctaagcagtattgtgatggccctaattggcttccctggtatgcaggagaaatggcccatacggtacaagaagaacacgtggaggagcttgacgggagagatcactacattaaaccataagcttcagagacgcgtctgcagaggtggagcgactgacgaagagaataacctaggtcnttataggcgtgcagatatccgctgtgacacatgaagtactaccccagctcccaggactccagctccgcatg

SEQ ID NO: 564677 - DNA, 486 bp, Homo sapiens
caaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagcgtcacatttcatagtcaagggcattatatacacagccagagctctccaatatcgttgttgtgtggggacctgccctatttacacatgcacctgggggttaaacagtaaaccctttctattcatgggcgcttcactctggtggtcaccaggcagtgtccttaaattttttttggtagtgtggacacgggaccggtttcccaatggcctgtgaaatattaggttcagccccgtagatcctagaataagggggttcatatagatatagttgtgcccaagaaactggtttttaaaaataaaaattctccc

SEQ ID NO: 564678 - DNA, 972 bp, Homo sapiens
  misc_feature (305)..(305): n is a, c, g, or t
  misc_feature (334)..(334): n is a, c, g, or t
  misc_feature (384)..(384): n is a, c, g, or t
  misc_feature (389)..(389): n is a, c, g, or t
  misc_feature (391)..(391): n is a, c, g, or t
gccgggcgctgcgaaggctcggctgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgcctcggtctcggttccggtcggcgccgccgtccccgcggcatgacgccgtcgacggtaccgagttttcggcaatccaggcgctgnacggagctggcaagcgcatcaagagcgcntggtgctgaatggggaagtctgagtatatcaagagaccaatggagaaacngagtngnaataacgaatctgtacgtggcaagatattcattatagcagacaatacccagagatgtgaatacagctgtgatggagttgctcatcatggattacgcactgaagactgcctgtgccagggaaccattattggggtcatcccctacttcccctacagtaagcagagcaagcatgaggaagaggggtaccattgtgtgcaagctgctagcaatccatgctggcgaaagcaggtttaactcacattatcgactatggatcttcatcaaaggaaatacgaggctattcaggattcctgtgaccacgttagagcctcaccttacggctcagtatatccgggaggaattcaacttacggcagtgccgcatagagctacgttgcagatgctgaaggaggcccagcctatgacgagagctgcgtctgggttggccgcattccgggaacatcaggcccgacttgaatggcgacggtcgaacccgcttgtagatgacttacccgctgcgtgctgagggccggcagccctacgtgcgagtgccccgccaacggacaccacggcaattagacggagcgcagtccaaattgacac

SEQ ID NO: 564679 - DNA, 1017 bp, Homo sapiens
  misc_feature (350)..(350): n is a, c, g, or t
  misc_feature (379)..(379): n is a, c, g, or t
  misc_feature (429)..(429): n is a, c, g, or t
  misc_feature (434)..(434): n is a, c, g, or t
  misc_feature (436)..(436): n is a, c, g, or t
gccgggcgctgcgaaggctcggctgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgcacactccgatgtcctcggagtttccgcgatcccagcgcgcaccgcaccacgatacaccccgcaagagccatgaacgccgatcgcaccgagctaccagagatcttctcggccaactccacggacgactgnacggagctggcaagcgcatcaagagcgcntggtgctgaatggggaagtctgagtatatcaagagaccaatggagaaacngagtngnaataacgaatctgtacgtggcaagatattcattatagcagacaatacccagagatgtgaatacagctgtgatggagttgctcatcatggattacgcactgaagactgcctgtgccagggaaccattattggggtcatcccctacttcccctacagtaagcagagcaagcatgaggaagaggggtaccattgtgtgcaagctgctagcaatccatgctggcgaaagcaggtttaactcacattatcgactatggatcttcatcaaaggaaatacgaggctattcaggattcctgtgaccacgttagagcctcaccttacggctcagtatatccgggaggaattcaacttacggcagtgccgcatagagctacgttgcagatgctgaaggaggcccagcctatgacgagagctgcgtctgggttggccgcattccgggaacatcaggcccgacttgaatggcgacggtcgaacccgcttgtagatgacttacccgctgcgtgctgagggccggcagccctacgtgcgagtgccccgccaacggacaccacggcaattagacggagcgcagtccaaattgacac

SEQ ID NO: 564680 - DNA, 989 bp, Homo sapiens
cgcaggcggcgctgtgccggcggagccgttcgagacagcgcgggcggctcgggtcccctggggctccgaagtaggaggacgccatgaacggagaatggagttaacttgaatacctttaaggtctcagtatgacattgacgatccgtgacatggctcagcagtggcgtgccaatccggactgttggctgggagttcttgaaggagatggaatcgaagggggaggacaagattcctaggtggttcttgacgtggcgacattctcaaccccgagtggccattaggaaacccctggtgttgtgttgttgggacctccctcgtgtttgggcaagtggtccctctgtgctggggggagctcgtttccttccggttttcatcatgttctttgcctccccttgggaattactccggatttactcctaatattgtgaaagcagcatctttgatttgagctgggggacgcacactttttttctccaggggagagataatacaccttgtcaagtagagcgacaaattgggcatgactccttgttgccattacctttctcatcagaagagttggaagcgacaagtattttgagctcgagtgcccttacttcccatggaggttgtctccttgagaggtccccttggaaatgcagccggtgtgcggccgaaagaaagccggtttaccgggttataccgtcaccaagagtcacaggcctgtgatttggtcgagtgttcacggacgagatttggccaaagagccccttttgccagcctcaaaggtcgctggtcacttgttggttgcttagcatgcccgcctgctgggcttcctttcattgggtcgaatggcaggacccgtggtccatagtttgcgagcttgacggcgttggttgacaccggggggcattttcacgcaacgatttgtggcccaccagattgtgctgtgtgttgcaaagccgcaaagccttttttttttggggcgccaccacttccaggttgtcccg

SEQ ID NO: 564681 - DNA, 101 bp, Homo sapiens
agggcttaagcggggtgctgcctgttgggggccaatgccctcctcctaggggggtcggggctaggctggagtggtccaccggctcagcaccctcctgcgca

SEQ ID NO: 564682 - DNA, 133 bp, Homo sapiens
agtccagaaggtgggaccatgacctatgaggatgggaaagtgtctatactcaaccaaacagagaatgaaaatctttgtgagaagcagccagtctctaaccatcagtacagtcagaacggcggatcaacggact

SEQ ID NO: 564683 - DNA, 255 bp, Homo sapiens
atatatgtatcgcgctactattttttgtcgttgttgtcttagtacaagacagtaccctgatgacctccgtaatatgtgatgatcctctctagtctcactgcaggctttgcatgctcggatctcggccgatgctcctgactctcgcgcctgagaaactcctatcgtacgtacacaccaccacacctggcgaatttttttctttttgagatggagtctcattctgtcacccaggaatgatctctgctcactatcaga

SEQ ID NO: 564684 - DNA, 226 bp, Homo sapiens
  misc_feature (220)..(220): n is a, c, g, or t
aactgtcacaatatgacacatgattaattcagcatcgtaggaagaaaagccttagtggtccagaagtgtgcatggcaattgaccatcatggttctctcaatgagctcatcaggacattccagcaaggtgatgcctagtagaccacaccacgcattatttgaccacggacttgagacttctgccaaccttccttgaaggcatctacttgtagccccagggnttaccg

SEQ ID NO: 564685 - DNA, 109 bp, Homo sapiens
cccccttttcccggggtgcccccctcaaaatggggccgggagggggcgggtttaaagaggcccccaggtttttttccggtggttggggtaagggggtttttatttgtta

SEQ ID NO: 564686 - DNA, 312 bp, Homo sapiens
aaggaggaagtaagcatgacggtcactaatcacctgaccaactgcatcagccaggcactcatcgatgcctggaggagcgccatgcacgaggcccctcccatgggagaacctttggcgctaatgagaagcgacacagaactgggcctattgcaacttattcacagctcttcacctcgcaagcacactacaccatgacctcttttaagactcctaacagaacactagaagtcaacacagagcaggatgaagggctgacgaagcgcaagtcaaactcaactcaaaagaacaggagcatgatgacaagatgaacct

SEQ ID NO: 564687 - DNA, 832 bp, Homo sapiens
  misc_feature (2)..(2): n is a, c, g, or t
  misc_feature (89)..(89): n is a, c, g, or t
  misc_feature (129)..(129): n is a, c, g, or t
  misc_feature (151)..(152): n is a, c, g, or t
  misc_feature (155)..(155): n is a, c, g, or t
  misc_feature (198)..(198): n is a, c, g, or t
  misc_feature (202)..(202): n is a, c, g, or t
  misc_feature (217)..(217): n is a, c, g, or t
  misc_feature (238)..(238): n is a, c, g, or t
  misc_feature (241)..(241): n is a, c, g, or t
  misc_feature (245)..(245): n is a, c, g, or t
  misc_feature (297)..(297): n is a, c, g, or t
  misc_feature (325)..(325): n is a, c, g, or t
  misc_feature (342)..(342): n is a, c, g, or t
  misc_feature (355)..(355): n is a, c, g, or t
  misc_feature (429)..(429): n is a, c, g, or t
  misc_feature (451)..(451): n is a, c, g, or t
  misc_feature (485)..(485): n is a, c, g, or t
  misc_feature (562)..(562): n is a, c, g, or t
  misc_feature (572)..(572): n is a, c, g, or t
  misc_feature (590)..(590): n is a, c, g, or t
  misc_feature (794)..(794): n is a, c, g, or t
cnccaataaaacctaaccaagccagcctgacaggttatatcaatacagcgcgcagctcggagtgcggagcgcaaggcgctggtgttagnatagggcgtgggcgtacagcatcccggggcgccctgcgcngcgcgcgctcagtgactgcgcnngcnctctgccgccctcactcttggtgagtagctaatttgcagcgcnggcngcggcttcataaggnggggtgcagggcgcgcggcgnggnggcntgcctccgcaattgccagatccacttcctcttctccttctgctctcctgcgncacttaggtgcttactgagatggttttnccacagtaaagagaggngggggcagagggnggagggtcaggggtgtgactccttcccatgactcaggcctctgtgctagaggtgacccttataggaaggggagnccccaaatcctttagccaatgngtggtggggtcatcataccagagagccagcttgnctctgggcaggcaccatcacaggcacagcacccatgcggctcaagccagaggaagaaaccccaccaggggtgggggntattggttgngggtgggccccatctgtngtgggcggtcttggtgagggcagggcctggctggagagactgggcgtgggggtcaatgcaccaggccgtgggagggccatggggtggccggagggctcgtgcggaggtgacagaggaaagggtcccattcttggagattgtgtctgagctcttgggccagggcagggtccggggagcaatggcatcctccttgatatcattggntggctcctccagggccttgccccggcggtggtaaaaaa

SEQ ID NO: 564688 - DNA, 344 bp, Homo sapiens
  misc_feature (246)..(246): n is a, c, g, or t
tgagttggagtctcactctgttgcccaggctgaagtgcagtgggatgatctcggctaactgcaacctctgcctcagcctcccgagtagctgggattacaggtgcatgccaccacacccagcaatatttgtatttttagtagagatggggtttcaccatgttggccaggctggtctcgaactcctgacctcaggtgatctgcccgccttggcctcccaaagtgctggggattacagggcgtgacacncacacctgggccataatgtagtttttaatatttgaaaagaggaacttcactgtggggtaaaaaataatttgcatttggtttttcttggggaagtttac

SEQ ID NO: 564689 - DNA, 126 bp, Homo sapiens
  misc_feature (70)..(70): n is a, c, g, or t
  misc_feature (126)..(126): n is a, c, g, or t
ggtttttttttttccgtggagctgtcgccatgaaggtcgagctgtcaagtttaagcgggtgaaagatctnccccggaaaggggaggcgttacgcaaggacccacgggaaaggtttttccagttttn

SEQ ID NO: 564690 - DNA, 432 bp, Homo sapiens
ggatccccgatgtagacacaatgaggtgtcgaacccagacttggattacgagcgtctacattggacagaagctctctgaaaggttaatgagaactaatggtgttcagagcagtaatccggggcattttggaaagagcaggtgcgggcacagatggtggaagtgatgctgaggtgacggatgctgactggaagaagtgtgacctgatcgcaaagattaaggcctcttgtccccagcagtctcatatatcaccaaagaattactacaagggaacatctgcccccaggttctggatttatttacactttcaagataaattgacagcacagacaataacagagagttgccaccactacctttataacttagtcaagagaacgcccacatttggcagcaaagtatatgctccagaccagtgttcgctcctcttcatc

SEQ ID NO: 564691 - DNA, 717 bp, Homo sapiens
  misc_feature (385)..(385): n is a, c, g, or t
cgaaaggagagcgtggtgtctggaggtgatcggaacggactggctggagtgttgcgggctgacaggtctgaggcctgaaggacttccgggaaccgcaaagcacggtgttcctccgctgtcctgaagagaaagccgcgcgcggacgactggcaggccggcttgcagctcccagaagttgacaggcatcctccggtgaccggtgtgagctatggcatcatggatgatttgactgcaagcaacagaaagaatcaaacaaaaatgggctacagccaaagtaatgagccaaatgattactttcacattccacagaagttgtgggaggatcgagctggttaaacggcataattaagtctacgatgctcaacagttatcacccatggacccnattttcacctattgtgtgctaacagcgtctgcatcgccttcagtgcttgcatccatggacatgcagcatgctgacatgtaaatgacacccttagcagccagcaatgctccactgaccatgggagaggtgtctcctctctcctgcccctttctgggaggctccaccgtagagatttctcttcacattcctgtttctcattcctgaacgcagttgcttggcaacagggaatggacttaccgcaatgggtacagagcaagtaagattcgaccactagtgaaccatttagggatggccactgtgactcatttctggtcaccaaggtggtggaacag

SEQ ID NO: 564692 - DNA, 989 bp, Homo sapiens
gtgataattatggaaaaaatcgcgcgtgttatcaaacccttccggtgacaagacagtatcactaccatagaggatactccatgtggtatagagagcagaggttggagtgatgcacctacaatccaagaaacactgtggatggcagcagctgccagaagccagcatagaggcatggaacaggtgctccctcagagtcaccagacagaaccaaccctgctgacactttgatttcaaacctctgtcttccataaccgtgatctaataaatctctgtggatttaaaaaagaaagtaacacactagaaagcgtagcaaagataatcaccactaatactaaacagacacatatttacactggtctatacgcttaaatgtatataaatacttgctcttcttaccctctcccgaaggaaggtatctgtctcgacttagtttcttgtagatgctttgccccctcccctcccacgcgcggctccacttatctacgtccgctaggcctccctccctgcccagcccaatatctcccccataccatccataaaccttactccccaagatatgcgctcacatacctcgattacccgtatcttgcctattacacggcttacatcacccccaccccgcatagacaagactgaagtccgccgcaccgaagttattcggccgcgtcactcacatctatacactcatcgattattagttcgctttagcttccccgccacagcgacaccacctcaccctcctaacccacccccttgcttacaccgtctccccactaccactcgctagtcgcgcctttatcgctcagatctgcattccggaaagttagagctcacagtagcgactagtcagctctcagcgggtgattcactgtccgccacgtgacgccgatcccgccataaacaggacagtgcagagcgctagactattgcagacgtgtagtcgccgcaattaccccaccttctcctcagcgatcccgcccccgcgcccg

SEQ ID NO: 564693 - DNA, 319 bp, Homo sapiens
tttaattaatttgaatttaaaaactgaaagccatgtacatttttttttgttaaacaccaactttatgggaagcttgtaagtacatttgaggcaacatgtaggggtgggggggttagattccaccttttttactggtaaatttatgcaaatcaatcccaggtatttctgttgaaatcaagcatccaaaatgagatgtgctgtaaatgtaaaaaggaatatgaaatatctcagtttaatagttttttatactgattacatgttgaaaggacaatgttttggatatgttgggttaaatgaaatatattattacaattgtaaa

SEQ ID NO: 564694 - DNA, 358 bp, Homo sapiens
  misc_feature (8)..(8): n is a, c, g, or t
  misc_feature (313)..(313): n is a, c, g, or t
  misc_feature (346)..(346): n is a, c, g, or t
tgtttttnttccctaaacaatagccttaagaagggtggaaaaaggcccgtcttcttcttggatccttggttgggtgacaacctccggtggtgagacatggtgcctgattttcagttggggctttctgcttcccctgtttggttttctagggacaatttaaaagattctgcaagttaattactggagaagtccgtagatcctggattcatagtatcagattaattgtggtctttgagtgggaatcctagtggtttatttagactcatcagttgtcttattcttttttttaaaaagaaagaaaacattttatttncgtaagcttgtattgcccttaaaatattttctntgcaatcttagg

SEQ ID NO: 564695 - DNA, 305 bp, Homo sapiens
tcgtcccatgttggcgcatcgtggtcgggtgggtcatcaccgagatgtacggcaggcccgcggcgcgcaagttgccgagcgccgccgaggtcttggccatctgcatcagcgagaacaggctttcctgcatgcgcgcgccgccgctggcggagaagctgacgaaggggcagccaagctccagcgccttctccgcgcccagggcgaaacgctcgccgaccaccgagcccatcgaaccgcccatgtaggcgaagtcgaagcagctggcgaccactgtgcgggccaacccatggggggggatcctctag

SEQ ID NO: 564696 - DNA, 174 bp, Homo sapiens
atctacaggatctccgcatttgctcccatcagagaaatgcaaatcaaaaccacaatgagataccatctcacaccagtcatgaatggctaattattaaaaggtcaaaaaaataacaaatgctagcgaggttgtggtgaaaaaggaatgcttgtacactgatgggacgaagactgg

SEQ ID NO: 564697 - DNA, 390 bp, Homo sapiens
ctagctaatgatagctaagtaataatgatagtaataatgataccttctcttttatacaaaagagggggcatgttgggaaaaaagctgagtgttgggggggaaaccgaggcagggcttgcataatgtcctctggaatgtgtctagacttgctggctccttgcttctagccttcctaggctcctaggtccctattcccagtatctcaagtagcagaacatgttccatgtaaatgctaaaccatcacagttgtagatcatgcgcctgcccttttgacctccacgttatcaccacctgtttctttgttggattaccaataaacactgtgggctcccagagctcggggccttcacagcctccaaaatggccccctggtgtcccacctttctctct

SEQ ID NO: 564698 - DNA, 110 bp, Homo sapiens
aaggaaactttgaacctatgtaccgagcaatcccaggtgtagcaaacataattgtagtcctagattaacttattgaattcaaaacaaaaaaacacaaacaatagtaaaat

SEQ ID NO: 564699 - DNA, 242 bp, Homo sapiens
tctagaggatccggtggagaggggtctcactcgtcgccaggtgggagcacaggggcatgatcacattgcaggggagcttggacctccctaggctcagatgatctcccaccacagcctctcaagtagctgggaccacaggcacgtgctacacacccatgctaatgtgttttggttttggatatttatgggttggtaggttatggtatttttgggtaggtggtttggttttttggtagagacgg

SEQ ID NO: 564700 - DNA, 926 bp, Homo sapiens
gacatggagcggagccggggtccggagggcacgcgtgccctgagtctctcctgctctcccctgccgctaggcgagtcatgctcgatgcctaggtcgtggccctcagtcacatgcaaagagcaggccgagtagcggcgcgctttgtgacagggtgtccacggatgtaacgtcgagagagtctctttggggatcgtagtcactgttgaggtaccgcgggcgcatcgtgagctcaaatgacgtccgccgctcctgcttgggcgcctgtccccggggaaaacacgttcggtcaacatcacgcccagttgaggttgggtgttccctgtttggcaaaaggaccgggcaacgttttaccgttgaatgcggcctgaccactgtggcgggccaggaaaatggttcggtgatccggggacccactggctggcaggatggggacattagcatggcttcttcgtaccaagaagcaccggtgggcccccaactttcactgtcactgtcaaccaagatgacaagacgctagtctggctgatgcccaaccacgcgtgtcccgcggggttcgactcaacaagaatgtatgacactgcctccaccttcgccgtcccatactgacctcgtttgtcctttcccttaacgctcccaaagtttgaccctttcttcccattataacacaaacatttatttgtgcgcattacccataccttattggtgcaaaaccaattgctggggccaagctggatgaagaacttcccttacaattctcccgtgtgtggtgcaaccattgcatgggcgtcattccgacacacagtcttctcaacaccaaccagcgacatctacacagtcacagttgcacgcctcgcaacagaaaacaaaaacatgccgcgcgatactcgggccagcagacccacgtcgctcacacggcagtttctcct

SEQ ID NO: 564701 - DNA, 134 bp, Homo sapiens
  misc_feature (16)..(16): n is a, c, g, or t
  misc_feature (65)..(66): n is a, c, g, or t
  misc_feature (80)..(80): n is a, c, g, or t
  misc_feature (91)..(91): n is a, c, g, or t
  misc_feature (109)..(109): n is a, c, g, or t
  misc_feature (132)..(132): n is a, c, g, or t
  misc_feature (134)..(134): n is a, c, g, or t
ccctggggtgggcccnggtgttccagagaatgggagggtagggtgaggctctctcgtacacggcnnaggccagggccgcngaggtcccgcngggcggggcccccggggnccctgggtcctgggcgtcccccncn

SEQ ID NO: 564702 - DNA, 350 bp, Homo sapiens
  misc_feature (28)..(28): n is a, c, g, or t
  misc_feature (102)..(102): n is a, c, g, or t
  misc_feature (163)..(163): n is a, c, g, or t
  misc_feature (167)..(167): n is a, c, g, or t
  misc_feature (194)..(194): n is a, c, g, or t
  misc_feature (204)..(204): n is a, c, g, or t
  misc_feature (209)..(209): n is a, c, g, or t
  misc_feature (215)..(215): n is a, c, g, or t
  misc_feature (217)..(217): n is a, c, g, or t
  misc_feature (231)..(231): n is a, c, g, or t
  misc_feature (239)..(239): n is a, c, g, or t
  misc_feature (280)..(280): n is a, c, g, or t
  misc_feature (342)..(342): n is a, c, g, or t
aaggtacatgatatgaatggtttatgtnattttgtgcattcaaaataagagtatttagaacatttcagaacaatcagagaaaaacatgatttcatgataaanataatacaaatgtctggtgacattttacatgtgttcgcaattcctttcttccccttttgcnagtncaacacttcaggccatacacataatgnaaaacaaggnagatntaactngncacattggcatgtnagattttnttacactttttataactgtacaaagtgcacatgtgcatganttaaaaaacaaggggaatgtagagtgttaaaaaagaaatacaaaataaatctgagacatganaccgaaaa

SEQ ID NO: 564703 - DNA, 444 bp, Homo sapiens
  misc_feature (120)..(120): n is a, c, g, or t
  misc_feature (134)..(134): n is a, c, g, or t
  misc_feature (150)..(150): n is a, c, g, or t
tccgccgccccaccgcatctcgaggagggaaccagctcccccggcccctattgtggggggtaacaagggtcgttctggtccactgccccctgtacctttggggattgccccacccacaanacccggggaccgcncaggccgagggggccntccaacacacccactccagctactgacgtctggaccacttgccccccttcacccctggagctgttgggccaccaattgcatcaacagcggcaacaacggcaactgacagccaagctcccggggaattggaccagccctcccccaattcccctcctgctctggtgcctgccggggcctgggcccctaggtgggggtcggggagcgcttttggcatcaaatccggcagggaatttcagctgaacaaagaccctgggggccccagaagaggccaagagttggaggcaacaactcagg

SEQ ID NO: 564704 - DNA, 500 bp, Homo sapiens
ttttgtttgtcttgctctcgccgcttcacacatactcggcgctgtgcgtctcgtcttttctctctctcgtgtatgtgtttgtctcctgctctcctcgctcgctcgttaactctccgctcgcgcgcgcgcgcgcgcgcgctctctcgtctctttactttctcttctctctcacacaagagaaacacacacacaccctgctgttcttttctctctctctcctctcaacacgaaacgaacaccccccaccccggtgtgtgtgttgtttttgctactctcccctcttcccccgcgcgcgggggtcccccccctgttttgggctgttcctctttcccccgctcccgcgcgcgcgcgcgggcggcacccccatccacacacccccccccccccccccctctcctcctcctctctctctctggggagtgaggggccacccaccccccccccccccctcctctttttataatatatatattatttatctctgctgtgtttttttttta

SEQ ID NO: 564705 - DNA, 1085 bp, Homo sapiens
gacacggcccagcttccgttcaaaatgtctagctgttcacgaaatgctgtgcaagctcgatctaggagggtggatcactctacacccccgaagagcaatatgggtctggtcaaagtcctatactgaactatgcatgctgagccggggatgcctcctcgcaacattgaacacaggccgatcaagaacctaacaggctgtggccatgaggtccaccaatatgtcaaagcaagtactacagacgccaaccggcaagccaatggccaccacgcagacccaggcatcatgccgccgtgtgcagctcctacgcgacgcagcacaggcacgccagaggaagcaggcaactactgcgatcacgccacctcgcacacgtcaaggcacatctactcctcgcgtcgccacgcgttggaagaagctgcgactgaccttgtatcgtgggccgcgtacttcgcacagaaacaccccctagcatacaagttgattcgaacgcgccctatacatgcagccctaccatagacggcttgtccaaccgcacactgcggcggcctggggaacactcggacgcggtacgcgacagccctcctcacatctaaggtcgaatagaaattcaagatcagtgccactacaccagcgaacaacaccacacacccccaacggcggaggccctggccaacgggggacacagtttaccacccagcacgctctcggtaacccagcaggcgaaacacagatgcgctcacaagacgaacctctggacctccctagcggcacgcgaaacggggacaccactcgacagtctccgcaacgcgcaccgcaccccacagccctgaggcttgaacctttaccccccgcccaacagggcgctgaacctcgggccgttggaccccctggcggacaaccacggcagagcgctcccgagacacggcacagcccacgccacgcggcaccatggcgccccaccccaagcctccacgcccaggcacccgccgccgaaaccatctcgacatcagaaccagccacaaccacactcggcctaccgaggcgcaacatcgcatactcaacttgcaacagcgcctatgcggacacgc

SEQ ID NO: 564706 - DNA, 497 bp, Homo sapiens
ccgaaaagggaacaaaccagacggagaataagttgacaaattgacagaagtaggcttcagaaggtgggtaaaaacaaactcctctgagctaaaagagcatgttctaacccaatgtaaggaacctaagaaccttgaaaaaaaagttagaggaattgctaactagaatagtcagtttagagaagaacataaatgatctgataaagtcgaaaaaacagcacaagaacttcgtgaagcatacacaagtatcagtagccaaatctatgaagcagaagaaagtctatcagcaaattgaagatcaacttaataaaataaagcatgaagacaagattagcagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagc

SEQ ID NO: 564707 - DNA, 246 bp, Homo sapiens
acgacatggcataaagcaaaagaactctcagccaagagaagctgcataaatacacataatgcctgcatctgcttttactaattagttcagtttaaatagtaaactttatactcctgtggacattttgccaaacgttacaatacatataagattatcaatcttaaaactaacactgcacagagaaagacaaagctacttctttatataatttattaaaatccaagtttcttctaaattctatccttg

SEQ ID NO: 564708 - DNA, 422 bp, Homo sapiens
  misc_feature (270)..(270): n is a, c, g, or t
  misc_feature (291)..(291): n is a, c, g, or t
atcctaacctccctcgcccgtgtcgctgggctgctgtcactgcgctgcccggcgcagctgggtgccctgcgccaggtggacggtgtctactacaacctggactccaagctgcgggccccgaggccctgggggatgaggacggagtcagggccttcctggcgctgcgcgtgcccagggcctgtgcgaggtgctgctggtagtgaccaaggaggtggaggagaaggcagctggctgcggacagactgaccatggctgaccatgggcgcccanacacggtccctgggcatcccncctgccgctgcgcaggactgcatgcctgggaagggccgagcacttcatggacccggggggccccaccccctccgcacacgcgcgctgctccccagtggcgctggtggcctcaataaatctgcggatgggca

SEQ ID NO: 564709 - DNA, 276 bp, Homo sapiens
  misc_feature (113)..(114): n is a, c, g, or t
  misc_feature (236)..(236): n is a, c, g, or t
gatataggaatataatatatttatatactgtatatatgtagatttaatatatatgttaaataatgaaagtactggccgggcgcgatactcacgcctaatataccagcactttnnaggctgagggggtggatcgcctgaggtcaggagttaaagaccagcctggccaacatgggaaaccccatctctactaaaaataaaaaaattagctgggcatcatggttggtgcctgtaatccnagctactcgggaggctgaggcaggagaatcggactttgtc

SEQ ID NO: 564710 - DNA, 722 bp, Homo sapiens
atctccccgggggtgctctgcgtggttaaccttgggcccatccccgcccactttttccctcgcttctagggcgtccctcggctccccgtggcttgcgctgtcccccggtgcctgccctctgcttcttggagagtttgcacgaggtgttttggcccccgtcactggttcctcgccccgtggcgccattacttgggacacccttttgctttgcaggagccttcccagggtgctacatgcggcgcagcctctcaggcggttgttcccccattggggaggcacctctccaccgggcgttcacccgaggtggcggccccccccgcctaaagttagtacccacggggcccgccctggcctagaactcgcgctgtgtgccaccctgctcgccgattagtggtggaccggtcgtctttccggggcacgcccttgtttgtgttgaatgggctcacatgccgcgccttgtgttttgccccccgccgtgcggtggcatcagtgtactgtccctcacgtcctgtctttgtcttatctattctcctttggcgcccgcatcattccacgccgtatgtcgccgccttgtcatcgggcaacacggtggcatctccccccccgatggatgcctccccttgtgtacgacccaccaccgccctccctccgcctacactgtggccccgctcccctggtgggcacccattaaaataggggatggacgcccgcaaaacataaca

SEQ ID NO: 564711 - DNA, 390 bp, Homo sapiens
  misc_feature (207)..(207): n is a, c, g, or t
  misc_feature (230)..(230): n is a, c, g, or t
  misc_feature (232)..(232): n is a, c, g, or t
  misc_feature (242)..(242): n is a, c, g, or t
  misc_feature (244)..(244): n is a, c, g, or t
accgtctacccacgagaaacaaaaacacatgtcaggacaaaacttgcacatctgtgttcagagcagcagatgtgttcatagcagcagatgtgttcagagcagcagcatacatcacagcccgagaaatggaaaccgaccacagcaatatacatcacagctcaagagatggaaactgaccaggtgtccaccaacagatgaataactgtngcctatccataaaatggagtatntnccaacatatnanaacaaatggtccggccaggtgcagtggctcaaacctgtgatcccaacaccttgggaggccgaggcgggcggatcacccgaggctgggagtttgagatcagcctgaccaacatgagaaaccccatctccactaaaaatattaaatta

SEQ ID NO: 564712 - DNA, 504 bp, Homo sapiens
tgtactcccgggctgtccgtcgaatctcaagaatggaacactccttccgtggcggcggcgggggctcctccgtgctcgagggctccggggctggaaggcgaggagagcgaccatcgggacccagaccctcctatcctcgaggcatcaggctgaaacagcacggagcggcatggctctcaggcctctcataggcgaatgcatccctggcagagagagatgatgctgccaaggactgcccggcagacccagttggaccttctcctcaggaccccagcttagaagcctcaggcccatcccccaagccagcaggagtggacatctctgaagcacctcagacctcttctcccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgct

SEQ ID NO: 564713 - DNA, 514 bp, Homo sapiens
tcaacgctttatacttcacccctaaacacattttaatgggtttggattaacatattatttctctatttaaggggtggaagttgataaccagtaaaattcctgctacaatctacagcgcttgagtggattagggctgacactggtggttggaccttccatgacggaaggaggtcaggggtagaggcctcattgaactagagtttcccgactgtatgtttgataaggtcaattaatggctgatcaggggtaggatataggattaatgctcgttgaggttctcatgtgttgtaagatgagaggaatcattggtatagttaaaatgaagccaattatctgccctatgctgttatacagaatcgcaaggtacgggcgtagctgtattagcaatctgctcagctgtgtcctcagccagtttgtacaaccagacataattcctacaccttctcatctgatagaacgttgaccctatgttgttggcggcaactagagtccatatcgtggcgcggaccataag

SEQ ID NO: 564714 - DNA, 282 bp, Homo sapiens
ttccaatagcgatacccaacgtgtcccactccatccatcccccagtcaccattattctgtccgcatgaatttgattattctaggtatctcatgtaagatggaatcatacagtatttgactttttgtgattggcttatttcagcttagcttaatgtcctcatttttacccacgttgtggcatgtcgagaacttatgtcctttttaaaggctgaacaatattccactgtacatataatacctcattttgtgtatccattcatcgttgatgaacacttgggtact

SEQ ID NO: 564715 - DNA, 242 bp, Homo sapiens
gatctctcaaactatcactctatatttctcgatctcgctctcacgctctctcccacgctcgttttcattctctttctctttctctctctctctctctctctctctctctgtctctcgctctcgccctctctctctctctttctctctgtctctctctgtctctctctctctctctctctctctctctctctctctctctctctctccccctccctccctctctccccttctgtcgtcttctc

SEQ ID NO: 564716 - DNA, 303 bp, Homo sapiens
gaaattattagagggcgatccgtcgaaggccaaagccatcgccaagcggtatgccgacatcgccgccgtcatgtctaagtccggcgcgatgactgccgaggacatcacgcagttcggcaagtatgcctactcgggcgcgagcgcggcaggcatctcggacaccacggtcgccgccatcggtatggcgttgaaacgcgcgaacatgacgggccaagagtccggtacgatggttcggcagttggcgtcgcgtgttctgtcgccgacgcgagaagggcgccagtcggctatcgcgaacggtatcga

SEQ ID NO: 564717 - DNA, 924 bp, Homo sapiens
ccggaggagcgtaggcagggcagcagctggcgccagcgggaacaggagccgcgcgacggaaaaaatacacgggaggccgtcgccgaaatagagtccgaggatcctctctcgtaaacacactctcctccaccggagcctccccctccgctctgcgcagccagtcgccggcatgggcgcctcgaggccagcgtccgacatgcgtaatgtgaccagctgaggcttgcggagaggaagggtgacagggaagaagaggctctctcacgcgggagagctccttgcaggaccaggatttagcggtgccatcgtatctgcaggctgtcgccttcgttatggctcgtcgtcctgtcccgccatttgcgtgcaaggcgctaggtgggcccctagggatttactcttggctcttcactcgacggtcgcgcctagactcgtcgctcggtgttccccggctgatgcattggctgtacagaatggagggagcgtgcctgcgtgcagtatggcacttgacatgatgttgtctcacaaaggacctgactgcaacacggcgcacgacgcaattggctggcgagggcggggcgggtcagccgggacacgactcgacggtgcgaccctctggggagtctgcctcggatgtctgggccgggccaaatgattgctcattgccttgcgttgcggtacttgctacggacccggggttcctcgtgggggcggactaaccagggcgtcgcggtcatagctataccctaaaggggtttgcgcgtgccacactgttggcagccgttgttacaacaacacatgtcagttagctggttgcgctgggggctacatggtggctcctgttgatggcgctggcacggcgagatttccttgcccctgccggaagggagggaggtacgtcgccccgggtttgcgcttccgggcctccta

SEQ ID NO: 564718 - DNA, 178 bp, Homo sapiens
gtgagagtgatttggacagtagagtaaccagttgtgattagatggtgaaaaaggtcatcgaagaggggtcccaagagtcttgattctgtttcagttagcttgtgtgtaaaaaacagtccaaaatgtaggttaaaaaaaccacaattggtcatttttgaaaaatgattctatgggtggg

SEQ ID NO: 564719 - DNA, 168 bp, Homo sapiens
aaaagggatgaggttgggggacgttgcccataggaatccctgctcccactgattttattagcaaaacatctgtgtcttttggagtacgatgtgtatgtgcccattgggtggcctgttggtcactgtgctagcagtctgcttcccaataaagcgtgccctttctggtgg

SEQ ID NO: 564720 - DNA, 759 bp, Homo sapiens
cggcggcaggagtgagggggaggcggcggcggctgctgcatccagagctggccgtggcgtgcggcgcgccccgtcgcacaaaggcacccatgcacccaggtgagggcgatgaacacagcacatcccgggacccgggccccagctgctgctaccgatgctgtgcgctcagggcgctggggaatgacgccctggcgtcgccgggggccagcgggcgaggcgcgtgccgtgcgaccctgagcgcgggactcgtcgcacctccgggtcaggcgccaagcttccaagctggctagagctgctgggccttggagcgcccccaggatcgcttcagtaatggctgcttccccaactccaggcccgatcgcccggcgcctgaggcgccaacttctgccaaggaagcgctcctaagtccatggccatcctgcaagcagcagatgggggcgcatgcttgcctgggcagtcagcactatgaggactgccagcccctggccagtagcgagacgaagatgccggcactttggcaggggtcactacggagctgccccatgagatgggcagagaggctggacaagaaagacaccagctctcacaggggagtccagggaacctgcacatgctgctgggagactctttcccgaaccatggcagctttgccccctcttctttctattgggagcgttggggccccatgacagaagcccggtacagatgggcttgtgggacgcgtctacacgatactgagtcaagccttggttttcccag

SEQ ID NO: 564721 - DNA, 659 bp, Homo sapiens
ctcctcgaggaccacgttaatagccaccgcggacgcgagataatcatttcaaagacttccatttcagatcacaagcaggaagtctgatagttctcaaaggcacttgtcttctcccaagctaggccaccaagcagccacgagagttgctaacccaaatccttctccagccatgactctggtgactcttagcttgcacccacctgccccctccaatatccctcagatgatgaggagccagggctaagggggcagccttctctcttcccagtgatgcacatccttcacattggctggcttgttctggaatatggatatctcagcctggatgccgaggaagctgctggatgctttaactggtgctagaggctcgagtgtgtttgagaccaagagccagttgtccctcatgccgaacgaaatcctgtgttagcctcctgtatgagatataaaatctgccagttttataacattcactttctggctctcaggaacgatacaggggacaaaaatcaatttgtacagtcttaatattaaaagcggcttgactaagtacctgatttagcaattgaagacatcccccgtcctcatgacataccgccgatatctttgggggcctcttgcaaagaacaaaataaggagcccaggggcatctgctcacacca

SEQ ID NO: 564722 - DNA, 340 bp, Homo sapiens
  misc_feature (112)..(112): n is a, c, g, or t
ccggtgctttgctctcaggtagtgatcttaactagctccaagtagtaggatcacagatgacacatgccagtagtggtattgggagagacggatctctccatgtgccaggtgntctcgaacttctgagctcagcgatcctcccgcctcggtttcctaaagtgctggaattacaggcatgagccaccgtgctggacctacagctgttttaaatgtcgcctccttggtgacaccgttcacaacctaccaaggtccctctattgtattcccaaagcactctgtgactttgtcaatcccttccactagactcgactctgagctcttcaagagcagaaggtcgacg

SEQ ID NO: 564723 - DNA, 325 bp, Homo sapiens
ctgcctccgtatacagaggctaaattagaggcggacatacggaagtgattgtccttcggctggaaaaaaatccccagagtcagacctagatgttcagaagcattaagatcaaaaagggttgttctaaagcatggcattccacagcaatcatttattctatcttgtccagttttagcacttctttcaacaaacccagcgactaacggacatgcgaggttgatggtgtatgatacacacaatacagaccttacccacattacagtataggacccgatatacattacaagacgatttacatataacacaaacaggtgaacaacagtac

SEQ ID NO: 564724 - DNA, 206 bp, Homo sapiens
taataaagatgtggtatatacacacgaagtagaataatactcagcattaaaaagaaaagaaatgcgtgacgcaggctacaaggaggggagttaagcttgaatacattatgcaaagtgaaataagccagtcacaaaaagataaatattatatgactatcagggtattcaaattcagagacagaaagtagcatggcagtcgccagagg

SEQ ID NO: 564725 - DNA, 306 bp, Homo sapiens
  misc_feature (134)..(134): n is a, c, g, or t
  misc_feature (144)..(145): n is a, c, g, or t
  misc_feature (148)..(148): n is a, c, g, or t
  misc_feature (202)..(202): n is a, c, g, or t
  misc_feature (260)..(260): n is a, c, g, or t
  misc_feature (276)..(276): n is a, c, g, or t
gtgtactgtaaattattactatataggtagtgtggaatctaagacagtgttcaaattcaggtctaggttgacttaatttctctaaggtcttacttaataagttactttgtagggataatttcattcattttganaggatacatnntcnggttcttaggttgcaagaatgggtttcctaagctttaataaaccttatataganacagatactcttcattaaaaaatgtttatgctgcatattaagtaaaacatcaggaganactgatgtcctgtagnctaaagatggtctgaaccatatctaaatat

SEQ ID NO: 564726 - DNA, 248 bp, Homo sapiens
atggcccggtagtgcgttgaatggccagttgggcagctctttccacgatggctatgcggattacttggaggaacacattgtgagcgacctcgagcacagtaagatttgttgcacatcagcaagcactttcagctccttgacgttgtgaaccaggaacttccggaagccagtgggcagacatgtgccttgttttttgtagcttccataaacaatgttgggcatcaagatctggcccttgaatcttctaa

SEQ ID NO: 564727 - DNA, 294 bp, Homo sapiens
tgatctagcaggatcccttgctgaatcctcctcctcctcctccttatggcaggccttctgggcaagcaagctgagtaaatggtctttcactagcagtgtcacatgatccttaacctgggactgctgggctgcaggctggagcctggtctgtatagatttgagtgctctttacatttgacagacacacacttgagcacttcctcaggcagaatccgatggagggcccagggaaggcagtcagagaaggcttcacagaggaggagaagtctgggctgaggaggcaggaggaattcg

SEQ ID NO: 564728 - DNA, 1044 bp, Homo sapiens
  misc_feature (1037)..(1037): n is a, c, g, or t
gtggcactggcgaggactgtgaaggttatattgaaaacttctacagtgtataggaggttgctccatagaagtacagtcgttcaaaacaaccagtaccgtgaagaagaggaggaggcgcgaagatgctagctggagctgcgttgttgaggaacgaacttgtccaccagcagggaaccccgaagagcatccagagtagaagctgtgcaattatgtaagaagtttctgcaactgtcttcctcaataataaagaagtatggtaatccttacctgtatacagtgcagagccttctcagaagcacagaatatttgtatatttcctttatgtgaatttttaagctgcaaatctgatggccttaagtttccttattgacactgaaaggtttcgtaaacagacaatcatgtccatacacttggttgcaagatgtgaattattgacacgtgaacttaataactgtgtactgttcggaaggggtacctcaaattttttgacttatgtgtatgtgtgtcctactttcctcttaagttcttatgaggaggggagggtaaataaaaccactgtgcgtcgttggtgtaatttgacagattgccccatctagactagcaatctcttcagaattctctgctatatataaacggtgctgtgaaggaggggacaagcatttccaatatattggacattttgtacctggaaacttatctgcggaattaagccaatccagggtactaaattccacttcagcatagacactctgcacacaaggccaatatatatcctaatctccacgtgttagcactctggaagatggttccccaaagagtggacctgcgcacacaccgccaaaacacctaaacaaagaaggaggggaggagcagcgcgaagcgagaaaagagacacactaaaaagatccctgtcaaacaacaggcagcagcagaaaaaagtgccgacagaaaaaaggccgcacaaacacacaagaaaagacaacagagcaacaacgcaagaacacaacaggcgagcagccaccacggagcgcacgcangcaagat

SEQ ID NO: 564729 - DNA, 891 bp, Homo sapiens
ttccggaagtagctggaaaatggcccaggagctctatatggatgcatgaaaaactgatgcgcctggatgttgcgacggatgtgtgtgtgtgacacttgactgagctgtgacacgcaactgtggacgacctggtgaaggatggagaccatggaggttcttctgtcacctgaatgaaactcattccgcgctcgtggaacatccagtgatgttgacccttgtgaacgcaacatagttgtggaggacctggaacttcacgcactttgcgttgtaaaccccgtcgacaggcaggcctagcatgtgagctacacctgtagattgttagtatgcctgactgggttataccctactagatattggcaaagactgcaatggcagcggaggttagtaggctttgttgtgtaaagcgacggaagagacactgtttacccttggccaatgggaacaggacctgtctgttagcagtctacacccaggcacctgcccgttaccacttcggtaggccttccttacttaggtggccatgcttaggtggaactcttgttgggaaccgttgtgcggaccactctggagaaatacgacatagggccccattatgttggccggaaacgaacatactgaaaagtattggttaggccaccagaaataacaacgagagcccccttgcgagctagttactatgacaaatgaatgtaagggcgagcaaccaccccaacaagtggaaacacccagggacattgacagccaagagaaaccctcacccaccgtcatggcccactggagacagcctccctaagcactgggctacgacaacaacacacaggcagctggcgcaagtatacgggggcaagtcccccgaacactaaacccattgacggccggaccctgcccaac

SEQ ID NO: 564730 - DNA, 108 bp, Homo sapiens
cttgtcgtcatcggggtgccaccagctcgtaagtgtagcttataagaagtcttatttttatttattcattcatctattttgagacagggtctcactctgtcacccagg

SEQ ID NO: 564731 - DNA, 147 bp, Homo sapiens
tcagtggtacttcagtgcttgattgcaggcgggagctcaccgatgtgatcttgcatgtcagtcccagagctggaccccagaagtgttcagtgcgtggaccctgcactgtctgacatttccatcgatggcctgcaatcaagcctggaa

SEQ ID NO: 564732 - DNA, 119 bp, Homo sapiens
atataatgataggatatagacgatactagatacaggacaacgcatcagacaggttaagccagctagattcttagagtacggagcaatcgaggaggcataaccagcacttggtggtggct

SEQ ID NO: 564733 - DNA, 123 bp, Homo sapiens
gcctgcgccgaacaaacatacagaacgcaacgagtccctctgaaggcccaacacggatccgaatcacctggcccgaaaccacctacctagccatgatgaatgctgaggacccagatgcagtac

SEQ ID NO: 564734 - DNA, 205 bp, Homo sapiens
ggcgaccaagaggacccccaggtctaaacccctcaaaaatacaaaggcatactaactatataaataacatactacgataaactagtacagcctagctacaaggaaatccatgtagtacaaacaagctagctcgcagttaagctaccataaaccaaataggtaagctataacctcaaataatactagagcagctaaataagagcta

SEQ ID NO: 564735 - DNA, 88 bp, Homo sapiens
  misc_feature (5)..(5): n is a, c, g, or t
aaganattattcattttaaccctatgtactataaataaacaaatagttctattttgtgtccccgaatgagaccttgaagcagaggtga

SEQ ID NO: 564736 - DNA, 186 bp, Homo sapiens
acgggcgcaggaggcatgaggctcagcctaagcaggctcttagtgatccctgatgtcgataatctgagacgtcgtctcctaccgccgatcatccgctaagcgaaagtaatccacgctcagcttgtgaatgagatgagatccgacgcctcatcttagcggacgtccgagaatcgaacgccatggttc

SEQ ID NO: 564737 - DNA, 225 bp, Homo sapiens
ccaaaagataccataaataagagagacatcttttaaaaataaacctagctgggcatggtggctcacgcctataatcccagcactgtgggaggctgacggcaggaggatagttttgatttctggagttcaggaccagcttcgggccacacagtgagacactgtctctctctcttttttttttttttttttttttgggaaagggggttccccctctcgggggggggg

SEQ ID NO: 564738 - DNA, 668 bp, Homo sapiens
tgtgaactcacgctgcgggaaataatttccgcccccgcgggggtaccggcacatgagtagcccccccgcttctcgtccgatgcccctcgtctaatgccatggaccgctcgtgcaaacatgcttgcccccctcatggttttttggcgcccaaacaaccggtggggactaaatgagtgatgagtatgcggggacccccactgtttggtcgccacagaatgtgttgtctccccggctctgtctcctctggccccagtgggggaaaaatgtactctctttaataacccccttttaagtgccctcacggtaataaaaacattctctgtccggaaactacccccgcgtgattacaaacatatgctgtgacttacaatggcgaaaagtggaatctttctttattgttccacccgcttttggaacacaaccactgcaaggcattatttgtaagaaagcatgtaaacaattttactaagttgtgcacacccatccccctgggatccagacataacaaattggtgtttcacagaaataagataggcaccgaaaaaaatttgtggaccacacaatgcttgcatggagactaatttagaaggggaacctctgtattggcaggagcattttataccacgctttaaataaaactaaaaaaagcaccttatcagtgtcacaaa

SEQ ID NO: 564739 - DNA, 258 bp, Homo sapiens
cccgctctcgtgaactcatgcaaatagctgggccaatggcaagaaaatcaggaacctccagactgagggaaccacatattttgggctgataagtgctttttgtgtagacaaagaaaggtagaaaatggtgtgaatctccagggtgaaaatgttgcctgtttttattatgccctccttatgaaaaaaagagagaaaaggaatcaggatgggactagcattcctgagagggagctgtgaaggagaaaaggaacccacatc

SEQ ID NO: 564740 - DNA, 346 bp, Homo sapiens
  misc_feature (30)..(30): n is a, c, g, or t
  misc_feature (172)..(172): n is a, c, g, or t
tccagagcccctggcctttcagtttttaantatttccctccaggccagaaagttttttttgaggaaggagaggagagggtggcaatgatgcttttgatttggaattggacatttttttgttagagcacagaggagggttaaatcaccttttccctttcctacttggcccagntggttggaggaccgaccccatgggtgagaatatgacggcaagaggaacagagtttgctccaagtgggaaagggtcccaagcagtccaaagaaaatgtttgtgtggctttccctccctgcctcccccagctcccacactggcctttgtaaataaatggggtggtttttgttgtga

SEQ ID NO: 564741 - DNA, 853 bp, Homo sapiens
cggggtgtcataaggcgcggaggagcggatctgagccgggaggcaggaagaagacggaggagccgggcgacagctatcacgtgaattgcccgtgcatgctccttctatgcccaatctgctcctgttcatcgcgcttccccgtgcgcaatgagaatggtgccctgggatacggagttccttgaatctatgatccagccttttacacggcagagaggaatgacgcggacgccatggaccccatgggagagaatcccatgggccggtcactaggactgctgtgggcgtcgggagccttcagtctgcttctggagcaccaatccacaactgctgtaccccatgtgtcactgcggtggaggcggaacgagtggatggagccatctgcagtgaagagacagtagaagaagattctggatagtgctgtgtggtgaagctccctctctccgatcactgggtcctgcctgggggtctcccgggcatccgaggggatattgctacctcggaagctgaagcggcatccgtccgggaggaagcacttggtgcgctcgttttgataaacattgcctgaatgttgccggctatggaggttgtagcaattacggtctagcagtggcattgacccgaaggggaaaacaacgggacaaattgccctggatcgaggacggtggccgtcagcgtccacttccaggaccagaatgacgtggagctgaacaggctgaactctaacctgcacgcctgcgactcggggggcctccatccgatggcaggtggtggacaggcgcattccactctatgcgaaccacaagacctccttcagaaggcagccggtgagttcgggctcactactgactgtgcc

SEQ ID NO: 564742 - DNA, 103 bp, Homo sapiens
acgtccgagacgcactctccatggttacgagattctgaacggttttctttccgtgagtaagcatccatgtcgtgatgtttttaaacttttttttagaagaaaa

SEQ ID NO: 564743 - DNA, 755 bp, Homo sapiens
  misc_feature (1)..(1): n is a, c, g, or t
  misc_feature (89)..(89): n is a, c, g, or t
  misc_feature (91)..(91): n is a, c, g, or t
  misc_feature (96)..(96): n is a, c, g, or t
  misc_feature (98)..(98): n is a, c, g, or t
  misc_feature (124)..(124): n is a, c, g, or t
  misc_feature (217)..(217): n is a, c, g, or t
  misc_feature (252)..(252): n is a, c, g, or t
  misc_feature (275)..(275): n is a, c, g, or t
  misc_feature (279)..(279): n is a, c, g, or t
  misc_feature (291)..(291): n is a, c, g, or t
  misc_feature (397)..(399): n is a, c, g, or t
  misc_feature (401)..(401): n is a, c, g, or t
  misc_feature (411)..(411): n is a, c, g, or t
  misc_feature (418)..(418): n is a, c, g, or t
  misc_feature (569)..(569): n is a, c, g, or t
  misc_feature (746)..(746): n is a, c, g, or t
naaggggattctaagggccaatataaccagtggggtcccagggcagcatgatcttcaccttgatgcccagcacaacctgtatgagcaanangtggngnacagcagtataaacgtagtagtaaanagggtctccgctgtgggtaatcaggccatccacaaacttcatggatttagccctctgtcctcggagtttcccagaaaccacaacctcgcagcntttggccccactttccatgatgaaccgcagcacancatagcaggccctccgcacagcnagcnctcctaggagtntgtaacgcagagactctgcgtgggcaatggcacaaagacctctagtggccaccttttcagcataaagctttaaaggaagcgagggatatcctgttaccatcacgannntnttcaactganagtgganaatgtgggatttgccaaaaaagttttattttctacaccaagcttgcgcaacccacgggccgcatgcggcccaggagatggctttgattgtggcccaacacaaattcaacatcgtgattttttgcgctaccagtagtagtgtggcccaaganatttcttcttccaacgtagcctacggaggccaaaagatcggacaccaccatcatatacagcatataatttcagtatccctcaattcctaaagcacttctaccacctacacacaatgcaggtccttgccctcccaccctggctcctttggccatgcaagtacaccaatggggacagtnaatccatca

SEQ ID NO: 564744 - DNA, 233 bp, Homo sapiens
  misc_feature (222)..(222): n is a, c, g, or t
ctataatgcagatatgccctatttttccctttcagttcctatatagttttacctcatgtattttttttcttgagatggagtctcgctctgttgccccaggctggagtgcagtggtgcgatctggactcactgtaacttccacctcctgagttcaagccattcttctgccttagccttccaagtagctgggattacaggcgtgcactaccgcacctggctganttttgtattgt

SEQ ID NO: 564745 - DNA, 210 bp, Homo sapiens
cagccccggagggccatcaagcatcggtcttccaaggccaattttacctcgtgtctctcacggggggagacctggaattggttgggagacctaaggagatggcagtgagcttaagcccttccgggagcttaccaatcagtcgtcccttattcatccccaagcaaacgtaggggggtgttgtggggcccattactgaatactctgccaagt

SEQ ID NO: 564746 - DNA, 266 bp, Homo sapiens
atatcggctaactagtctgatgacaagttaacactaatggcataaagcagcaacaaagaagcaaaaagaaaactaataaaacctctacactattaacttatatccccctacttattaactaaatagtagtaataatgtaatacctatattatactagtctgtatctatgaaaggctgtagtaatattgtaaaacggtaacaactataaagtacttactacaagactagtcgtatcataaacacaaatatacagtagtaaataaata

SEQ ID NO: 564747 - DNA, 278 bp, Homo sapiens
ggtaaccttaattccccttctctgggtctatagctcggcttattacacgggagtgtttcgttgagatgcacacatgattgaggcagctcataggtttaaagcatattttacaagtttcaaagtctaggagatgattgcctttgctcaacatcttcagcggtgtacattcgaagatcatgtgacaattattgaatgaagtaactgaattagcgcttaatggagaccttatgcacagttgcatctcttcgtgcctatcgtgacatgcctgctgttgtgcg

SEQ ID NO: 564748 - DNA, 919 bp, Homo sapiens
gagttgcttggaggttggcggcgcgggctgaaggcctagcaaaccgagcgatcatgtcgcaccaaacaaatttactaattcggacaaatacgacgacgaaggcagtgtgagtactcgacacgtgtccattgctggcccaaaaggcacatagaccaagcatggtcccctaaaaaacccattctggatggtctgaatcttgaaattgggcgcgacatcttggggcgcttcaagcgacgaacgtccagggggcattgggggtcccatttacctttttggattcccatttgtaaaccaaggaaacggctttcacacaatttttttgggctgtgtttacccgggggtggccccccaagtataatcaccccaaataggaattaaaagccaacaatggaaaccacttggtgacgggccttggtgacgacagcgcgtataccgtttgttgttagaaagagcctatctaaaagtggctttttatcagccacaagtgcttgtgtgtaccattataaaacgttgttgcccactaatgaacaagtttccttgttgtccgtgtggacgtatacaccccgcttttacatttcttacatgtcgttgggcccactatctcatctgtggggcttactcagctccacaccccattttgggaacagcaacctttcttacaacacaacggtacgcttgttgtgttcaacagctaaaacaacagcctcggtgttgtcggcacagcattgggtgtcctgtgcggaaaaccacactggtggcgtattcgtgcagaaccactcgtgtcaggggatattggtaggtggcacaccccaaactacacagccatagtaatgtgtctcctacatgtcccaagaacagttaaattatggcttccctgtgtgtgtggagacacaaacaagtaggaccaataagatacacg

SEQ ID NO: 564749 - DNA, 273 bp, Homo sapiens
tcgtcccctttgtctgctcttactttgctgagaattgagaccttcacaagttccttaagcttccctcttcacgtcagttcgtcttcggtcttcctcattctttcctccttctctccttcctatctcatgttgtggtcagcttcctctctggggctgtttctgacctgtgggtgttcccctccctccagtcacagccagactgtggatggcagcctctgtgttaggaagcaggaccttaggcaggatcctggaaggctggaccagagagtgagg

SEQ ID NO: 564750 - DNA, 170 bp, Homo sapiens
  misc_feature (54)..(54): n is a, c, g, or t
aaatcagtcggtaccagatccccctttcatccagggtcacgccatgcacccacnctgtctcccaaagtgctgggattacagggatgagctactgcaccagcattttttttttttttttcgaaacagagtgtcctgtcacccaggctagagtgcagtgatgcgatttcaca

SEQ ID NO: 564751 - DNA, 733 bp, Homo sapiens
aattcgtgaccaccactttgtctgatggctgactatgatgtgtactataacaatgatcgttgctgtttcctactactgcctgacattgattatgtgtggggatcatacctcttgagatgcgtgcggcgggaactcaggacgtgtgctgtaccatagtccgcgatgaccgttcatgccagtcaatctctgtgatttatcacttggagatccactggtgctcaatttcctgttgttgctagtccacagctgctaaaggagagaagttgtcatgcaggaggagttctcgcgtgatgggaaggctctggagaggttcctgcaggagttactttgatggccatctgaagagatacctgaagtctgaacctatcccaagagagcaatgattgggcctgtgaagggtacgtggtatgcagagaattctcgactgaaactacgtgagactacactgaacagactaaacgactgttgctgatcgcaatttttatgcccctttggtgtggtcattgtaacgaacctggagcccaagtataaacgaacttggccgatagagctcatggaaagacccaaatatcgtcatatgccccagatggattgccgactaagccagttgatgtggccttctcccattagtgaagtcgaggagggtttttcctaactattatactttctttcttcccaaagccaaacaaagaaagtcttaaattcccaaacggaaacttcttcccaaccggtg

SEQ ID NO: 564752 - DNA, 144 bp, Homo sapiens
gactcccccatgttgccgcacgtgtcgtccatgctagcagttaatgagctgccctgatcatccacggtactgaaccagcagctgggctgcttatggaaaagggaccagttgctcaagtgtctcccttttcgggttccataactt

SEQ ID NO: 564753 - DNA, 135 bp, Homo sapiens
ctggcacatcgtgcgatctggtggagcggaccatccctcaattcaaggccatggatcactttgtaacaaatcctaccaaactgaccaataaaaaaaaatgtgggttttttttttttttttttgttttttggaaaa

SEQ ID NO: 564754 - DNA, 517 bp, Homo sapiens
gtttctaagaacgttcacatgaagatagattcctaggtgttcctgcatgagagtggatcctgtgacgaagtacttctgcgctcactttgccccagcagggatctgactgagtcatcgaaggctccgccagcgtcctcgtccgttactcagacattccggatagagcatgttggcaacgaacgagcttccccaggacagccaggaaagtcaccttgtacctgacatgcctaggtacgtggcccactcctttgtttagtccccaaccctaggcgcttctcatgacttccacggatacatctactatctagcctgaacatcacgagtttcagtgcaagtaaatatgttacagggtgcgggggtgaggactgaccacagattccctgagatagtgtactggtagattcctccacaggatagcgcacttggcaaatcatgcttggtatgtgtatagcgcccaatacatacctagttcttgctttctttaccttttcgtatcttgatgcaacaaatgttgcac

SEQ ID NO: 564755 - DNA, 165 bp, Homo sapiens
aagttcgtcacattgacttcacgtgacagtaccgttggtaataacacccaaacgttgtatacagatggggataagggattcttcttttacaccaagtatgagtaggcaaaaggtggctttcagttcaggctgtgttacatgggctttcttgacacgcaagcccat

SEQ ID NO: 564756 - DNA, 101 bp, Homo sapiens
gaggatccttgaagaataatagaagagcgagccctgattggaaggaaaaagacagacgagcttcccaactgtaacccttccacaccaccaggaattcttcc

SEQ ID NO: 564757 - DNA, 553 bp, Homo sapiens
ggtagtctcgagttttttttttctttggggtttcccaggaatccatttgtttatttacaacagctttctaggaaaaaggtagaatgggcccctctcctcagtgcccaaggggacaggactgaggcagccccaccttggcccatggctctcttgcaaagctctctgcacccttccccaggggttgtacacccacgagtggacaagaaggacgttcttttcaaccaccagggtttagactttggggagacggctgaactgggaaccaccgtctacggaccataccaacatatagcacctcccgtgggtggctcccaagtttctgaaagatgaaacccaaatgtgcagtatgagcccaccgttacagggttctccagcgtctcctgcagcgttaacaacccagagaaaaccacttgaagccctacagcattggcgcttgcacggggtgtggccagagacttgcaggagcggacaggtcacgagacttgaacaagtggtcgagatacacccgcatccccacattgcagcaccgccccaccaccctgccctctacaat

SEQ ID NO: 564758 - DNA, 235 bp, Homo sapiens
aggcgtcttatcctcagatgtaggtttataaatatgtcgagaaatgccttgtacccaaaacaagtgcttaaaaaaaaaaaaaaaaaaaaaaaatttgtgcgaaacaattcttaaaattcaaatatatttttttggaaacatctaaaaatggcaaaagttctaatattccaaaagctctctggtttaaagaacgaccctccattctcctttcgctttacaacaacgcttttcttgc

SEQ ID NO: 564759 - DNA, 144 bp, Homo sapiens
tgtaccgtaactgctgaggtatatcaacaaaactagactgaaaattattttaaaaatctcttataccccaaagtaaagaaggagccacgatgagatggtaagaggggagtttcgtggatataaacaagcccatccacaccacag

SEQ ID NO: 564760 - DNA, 130 bp, Homo sapiens
gcgtcgaccttcagcgcggtaccgatgctcaggctctcttcgtcgttgacttcataagaacggaagcctgggcttgcgactcggtgatggtcacggcgtttggcagcaagccgaagatcacgtccgccgg

SEQ ID NO: 564761 - DNA, 221 bp, Homo sapiens
tatttctctcttcaatgaactcgcaacctcagaatgcatttgtgagttctcttgcagtgtaaattatgagattattcctaaccttgtcaggttctggtgacattctgtttaccataatataatagaagcaattcataatttttttttgggggggacctgaactagtttcaagttctgtggcttagacaatgccattgttcctgcttcacacagaacattcg

SEQ ID NO: 564762 - DNA, 285 bp, Homo sapiens
  misc_feature (5)..(6): n is a, c, g, or t
  misc_feature (44)..(44): n is a, c, g, or t
  misc_feature (46)..(46): n is a, c, g, or t
  misc_feature (110)..(110): n is a, c, g, or t
  misc_feature (116)..(116): n is a, c, g, or t
  misc_feature (127)..(127): n is a, c, g, or t
  misc_feature (147)..(147): n is a, c, g, or t
  misc_feature (159)..(159): n is a, c, g, or t
  misc_feature (176)..(176): n is a, c, g, or t
  misc_feature (194)..(194): n is a, c, g, or t
  misc_feature (203)..(203): n is a, c, g, or t
  misc_feature (206)..(206): n is a, c, g, or t
  misc_feature (219)..(219): n is a, c, g, or t
  misc_feature (231)..(231): n is a, c, g, or t
  misc_feature (233)..(233): n is a, c, g, or t
  misc_feature (240)..(240): n is a, c, g, or t
  misc_feature (249)..(249): n is a, c, g, or t
  misc_feature (256)..(256): n is a, c, g, or t
gaggnngggtctagcccctgtatatatattttatgcatgcactntnaccttggggggagaacagaagggggacgacgcccccgcacctcctgcgatctggctggcttggntcccgnttttaacccgntcctgccccacctgccctanagttatggcctntgttctgctcccctggncccagtgcaccgtctgcnctgtgaacnccncccaccaggcccntcttaccccacncntgtctgncccccccgntctgtancgtttgtacataataaaacaatggagtgg

SEQ ID NO: 564763 - DNA, 707 bp, Homo sapiens
agctggagctcgcccctgcgaggaccccgccggattctgtgaaagatgcctccgccgcggagcccgcggccgccccgggatgcgtggttcttggacgaacttgtcccgggggcctttgcacgccctgtctgtacccaccctgcatccccagctgatagtcatgcctgatgcctgctggcccatgtctcgcctgcttccgggttggctgcttccaatgcttgcccagatgtgcttgttcgggcacttaaccggcctgacaagttaaactcctcctgcaccgccgtggtacgtcagctggggccgggggttggaacgcccgggaaacccggggcccggggccctttgggcccctttccccttttacccggtttttttttttggagaaaaacaccacacttgtaatttacccacgagtttttggggggtttttgggaacccacgacactatgagacacaaacaccaaaccgccactagtagatagaataagaataaaagtacacgaaaaacactcgttttggggtggtggtgtgttcgaaccacgtattttttttccccacgcccccgtgggatagggtgtacaacacacagcggggtggtgaaataattttaatgcatagaagcagcaagtagtaaactagaatgtacgactgagcccacccactaggggaggagtgcgtcgagggggggacgacaacaaaaaagtggc

SEQ ID NO: 564764 - DNA, 385 bp, Homo sapiens
  misc_feature (144)..(144): n is a, c, g, or t
  misc_feature (149)..(149): n is a, c, g, or t
  misc_feature (157)..(157): n is a, c, g, or t
  misc_feature (176)..(176): n is a, c, g, or t
  misc_feature (232)..(233): n is a, c, g, or t
gggtattttaagtgatgtcatagacaggattggttaaatttagttaactccatactcttcagactgggatattgtgtaaatgtctatctgccctggtttgtgtgaactgggatgttgggggtgtttgtggttatcttacctggnggagntcctatgnttatctggcttttcatggngctttctggagacatatctgaagagatggattagaatgctttgggataaggattgnngagcacattccattcattttaggatttgccaaaagggggttgggggggggtccaatcatattggagggcagggtttacccccaagggttttggccaaaagaaaatgggggttttgccctttttctaaaggggggggttaaaaagtaattatt

SEQ ID NO: 564765 - DNA, 322 bp, Homo sapiens
cataaataaatcaagtcacacatcacaaatgacatatacggatacaatcgggcaaaattagtataagtactagatatgatacagacacgagtcaaaataccgctcttattaactcaagatcgatatagtggacataaaaaacacagtataaggccattgaagtcaaccataataacttcttagctgtcccttagttctagggacttgctctagaaattcactgggtttcttataaagggcaaattcagtaaagatcattctctagcaatggttctcaaccagaggtaccatccctcaaggggtagctggcaatatctggaga

SEQ ID NO: 564766 - DNA, 420 bp, Homo sapiens
  misc_feature (200)..(200): n is a, c, g, or t
  misc_feature (244)..(244): n is a, c, g, or t
  misc_feature (273)..(273): n is a, c, g, or t
  misc_feature (420)..(420): n is a, c, g, or t
gtgactgagatccggctcagtgatctctaaatctcctctatgatccagcttcatcattcttggacaatccctcaggtggctgaatctctggatcttcaaagattgcatggcttcatcattctgtgctcttctgagggaaccaccactcgcaagacgcgagctgttcttcatccccatgagcactgagttcagtgtgttgnatgatacagttgctcacaggcttccttgacctgatcatctcctntggcagaactatgcagacatccttctggncccttctgggcagcatcttcgatcttgggctttttcttcattcatcttttatcttcctctttctttctcaacctttctctttccttctgccttcatcatcactaattttcctttcttctcgttccctttcctcccaaaataaagggn

SEQ ID NO: 564767 - DNA, 125 bp, Homo sapiens
tgcactgatgttgctgacagagggctatggggtcctggcttggaggagcatgcctgaaccatagctgttgatttgcatagcactgagctggctgccagctggtgacagatgaagtggatatagga

SEQ ID NO: 564768 - DNA, 565 bp, Homo sapiens
  misc_feature (271)..(271): n is a, c, g, or t
  misc_feature (292)..(292): n is a, c, g, or t
  misc_feature (303)..(303): n is a, c, g, or t
cttgccggtacataaattaaagtaaattgcacttgaaaattctcaaaattcttaaattcaattataaataacatatattaacacatcttgtctgtgctaaagtccatcccacttaaattatcctactagtaggctagaaccaaagttccttatggctctgtccctagcttatccatccggactcagctgctgtgaccatcttctcaaggcaggtagaagagaagagccacaaattcctatgagtcaactcaggttattgaaagcacatttnaaagtgcagcctctgttgatntgccttctccntgtcctaaggaagcagatctcatgtaattctgtaaaaggcttgtcagagcacaacactggcatgaactacagctctggcatggcgccccgggtcacacagatcaagcattttcccttagagtttcttctcattatgtggtttgtgagtgcaaagataagttatgtttctccaatttaaaaatattgtgaaaatcaacttgttactttaaataaactgtgcaaagtttcctagttggtgatggctaggacatcaggaggtaag

SEQ ID NO: 564769 - DNA, 126 bp, Homo sapiens
acccccccgactagcccgacaggggctgaggggagtgaggcagggaggatgcatggggcctgtgggaaccagagagaagctggggtcagaggtaggagctgtcgggctagtcgggaagatcctcta

SEQ ID NO: 564770 - DNA, 135 bp, Homo sapiens
acccccccgactagcccgacaggggctgaggggagtgaggcagggaggatgcatggggcctgtgggaaccagagagaagctggggtcagaggtaggagctgacgctgtcgggctagtcgggggggtaccgagctc

SEQ ID NO: 564771 - DNA, 135 bp, Homo sapiens
aaggtagcgtacgatagtattgctttgtatgcataagctttttgttgttttagatatataaatggtatggcactacggtgtcatatctccaatgagttaatccaaaacaaaacccccaataatctgttatcattc

SEQ ID NO: 564772 - DNA, 780 bp, Homo sapiens
taaaatgcagaagctgctgcgcgggagtcggccatggactggaaagaagttcttcgtcggcgcctagcgacgcccaatcacctgtccaaacaaaagagaaaaagtgaacaaggaatttaaagagatgaacgaacatggactttatttacaaaattattactccgaatggaaaggaggtagaaaaaacacaaattgaatttctattaagaccattccccggtttcatataggctgcctgctgaagactgaagtcttactacagaacattaagagaggaatcaagagctgtctttctacaaacgaaaaacgcagaagaaccgtgttagactaactgacggcaattaacagaaccttatggttttggctggacaaacaccagaaaccacctatgatgggagaggaagcgatgatcaattacgaaaactttttgacaggttgggtgaacacaggctggagcaaagtgcaagcaatttttcacagcaaaagtcttggctaaacctccttcatacagattcatatggaacgaatttccatcatgcagttctttaattatgtcatgagaaaagtttggcttcatcaaacaagactaggactcagttcatatgatgtcgctgggcaggggtaccttcgggaatctgatttaagacaactaccattttggacccttatccctacgttgccaccaattagatggtctggaagaatctttctactcctttaatgttgtaccggcagtaaggaagtacttctactttcagatcctttagaaccggagcgata

SEQ ID NO: 564773 - DNA, 167 bp, Homo sapiens
aagcagagtaggtaggaagttgagccaataatgacgtgaagctcgtggaagcctgtggctacaaaaaatgttgagccgtagatgccgtcggaaatggctgacggcgcagcactccaagtactctgcaggcttgtagcgagggtacaatagagcacccagctaaacaa

SEQ ID NO: 564774 - DNA, 125 bp, Homo sapiens
tgcaggatcccagattgctagggatggcgctccaatttggctgcataggtaggtgccatgcagtaatgttagcggattaggacgctacggccaggctattggttgaactcaataggctgattgtt

SEQ ID NO: 564775 - DNA, 279 bp, Homo sapiens
ccatgcaggcgtcagtcaggaatctacagctttctccggcagccagcctccacccaaacagggttacctgccacactcacaaccgcagacctcggtgaggaatcaactacccacaacaccaggccatagtgaagaatcagcaacagtccacagcagcccagatgcaatggcaacaacagtcttacctgccggctctacaccctcagttcttgttggagactcgacgccctcacccatcagttcaggctcaatggaaaccaaagccgtcgtaggcagtga

SEQ ID NO: 564776 - DNA, 447 bp, Homo sapiens
tctagaggatcccgtatatgctgtctcaacttacaaatggggttatgtcccaataagtctatcataaagtggaaaaatccaaagtcagactatggcaagtcaggtacatccggtgtgtattctaacacccatctccatcgcccaacaattaacagaacaagcagaaaaaaattaaggatactagtttgaacagagatggaaaagcctcaccttataatctggaaatacacattcttgtagacacacatagagatagtgatgaaaatctgcacaaactaaaactagcctcaacacatttcaaagaatcaaaatcgcattagaccacatttaataaacactttttttattaaaaagaaacagggtcttactctggtcatctaggcgagagtacagggggtgcaatcatagcttactacggcagcctcgaactccggagacagcatatca

SEQ ID NO: 564777 - DNA, 424 bp, Homo sapiens
  misc_feature (1)..(1): n is a, c, g, or t
nccatgtagcggtatggcagcaagtcaactggcaacgtcactaattgcattaaatgtcatagtctatcatccctcaatgccaagatctggatcgtcatgttagaattgaaatcgaggtcactatattagtggccatgagaatctctctgtaagtgctcggcacgccttagttattcatagtaaaggaaaaggcttctacacgctgtgctatgtcataaagcacgatcaagtgccaatagtaatgcagaggtaggctttagagcaaggtgctgtcaataggtaagatcgtttcatgatgataagttcatgacgttggattagccatagatttcttagacgcgccattatgtgcatcatgtatcaagtcggcattaatacattggactcagccttgattaagagcatagttcagtgtaggtggagc

SEQ ID NO: 564778 - DNA, 800 bp, Homo sapiens
tttttggttgttggctgtttttgttattaaaggtgagttctcactatgtttctcagactggtctcgaacctcctggcctcaagccatcttcccgcctcagcctctcaaatagctgggcttacaggcatgagccaccaacctggcaggatggggttgttaaatataaatctgatcacccccctgcttagaccccttctgctttctattacccctcatttaaaatgtaaactcttcaccttggttatgagaccgtggttcttgccttccccttgaacctcattaaatggtgatttcttgctaagctccagcccgagtggtctcctctcagcttctactttaggtgctctttcctgccctttatcctggggcacttctacagggtctccacccacaccagtcttgactcaggtggtgtccttcttcctcaagtcttgacaatatcccgggacccttcagtccctgagcagtactattctgtgtctgtcaccagatcttgtctttgcccctcatggacattaatgcaggtaatataatatgctacttacgtacttatccattctgtctcccctaccagcgctgtaaatgaggtgcagacaccttgttggttaaatacaccataatgtaccaggtgcttgcacaaataacgggcctttcataaaatgtgcgtcgcataacacgcgggcaagaacgccaagcaccttagttagcatcgtacttttgactaacgtgtcctttggacatataccgggcttaatattgactttgaccccagtggttggtaatccacggcatctagacct

SEQ ID NO: 564779 - DNA, 691 bp, Homo sapiens
  misc_feature (368)..(368): n is a, c, g, or t
  misc_feature (448)..(448): n is a, c, g, or t
  misc_feature (451)..(451): n is a, c, g, or t
  misc_feature (458)..(458): n is a, c, g, or t
  misc_feature (480)..(480): n is a, c, g, or t
  misc_feature (590)..(590): n is a, c, g, or t
  misc_feature (597)..(598): n is a, c, g, or t
aggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaaccctgcgtgggctaaactattgttattaactctgtatagctccaaacctggaacctcctgatcagtttgaaggacattgataaactgtgattttacaataacattatcatctgcaggtttttttttttaaaccttgggttttttacaagactgcttttaccttaaactttgtagatgtttacatctttntgtgtgttttaagatgatgttggtaatttgtgcctttagctctgttttattagacagagttaaagcatgttgtctctccnttntttgggngggggggggggaaaaaaaaaantttttttttttttaaaaaaaccaaaaacttttccaaaggggggggcctccttggaaaagggcagtttgatttttatttttaacacacttgaaaaaaggtggagtagccangactttnntcatatataacttggtgattatcaacctgtgtgtctttatttaactttttttaaacaaattttcctttttttttggaaaaaggggcccaaaat

SEQ ID NO: 564780 - DNA, 146 bp, Homo sapiens
  misc_feature (13)..(13): n is a, c, g, or t
accgtaatattancaaaaacactttactccaaagctattgaaataaaatatataatttaaaaacttataaataaaaatatataggtcatataactttattattttcatgagtaacaggcaaataaatgtttatgttgaatatccat

SEQ ID NO: 564781 - DNA, 402 bp, Homo sapiens
  misc_feature (214)..(214): n is a, c, g, or t
  misc_feature (288)..(288): n is a, c, g, or t
gtgcccccgtgggtatctccttccgcccgctggcgacgcaccggccccgacggttgctgtggttggccgacgctgtctccccgcagggacagatcgtcatcacagacggagctgtcgaagctgcgacgcagcgtcattcctcgttgttggcggtgggtgtgactcgggtacacggggatttccaagcaggcgacccagtgacgatcctggcctncgacggtcgagttgttggtcgcggtatcgcccagttctcccatgatgaggtgcgcgtcatgaggggacgttcgngtgcctggctggccgcagaaatgggcccggcggcctctcgcgagatcatccaccgcgatgccatggtgctgagtcgtcgtcgtaaagctgagccgtcatcgaagaaccaattag

SEQ ID NO: 564782 - DNA, 382 bp, Homo sapiens
tggtaccctcgctgtcgctgggattggggcatgcaccagcacgcccagtaatttgtgttttggggggagatggggtttctccatgtgggtcaggctggtctcgaactcccatcctcaggtgatccccccgcaacctctgcctcccaaagtgctgggattacaagcttgagccactgcacccagcctggaccagcttttaatagatggatctttagaagagaatgtgtgtggagggtctttcctggtagggttttttagctcaagagctccctctcctgtcgtcatagtgtgcctttcttgtagtcgaagtctctgattttcctagtgtttttttcagggggatacttattaccaggaatattgattttttttgccagggcca

SEQ ID NO: 564783 - DNA, 276 bp, Homo sapiens
  misc_feature (13)..(13): n is a, c, g, or t
  misc_feature (29)..(29): n is a, c, g, or t
  misc_feature (142)..(142): n is a, c, g, or t
  misc_feature (198)..(198): n is a, c, g, or t
  misc_feature (204)..(204): n is a, c, g, or t
  misc_feature (219)..(219): n is a, c, g, or t
  misc_feature (230)..(230): n is a, c, g, or t
  misc_feature (239)..(239): n is a, c, g, or t
tttgatcttcatncctgggtctgccgcangacccccatctctgtgacttcctggagactcacttcctagatgagaagtaaggcttataagaagatggtgccacctgccaacctccacaggctgggtggcggaggtgggtggngagtatctcttcgaaaggctactctaagcacgactaagagccttctgagcccagcncttctnagggcccttgaaagnataggcttctnctaagctancctccagcaataggagcttcttacttcctaacaagcc

SEQ ID NO: 564784 - DNA, 1265 bp, Homo sapiens
agcggggggtgccaatggggtgcacctggggaatcacggttgaaaacacactgatttcatagtcctagaaaggggctttcttgggtgaggaacatggagagacagggggatcaagacacggaccgactgtgctcctggccagcctaaaacacacgggttggggctgctgttttgtctcaagctgaactccccctaagactgggacagacggcggggacacgacgagactggaagacggaccacgcaagcagacaactgggacagcacgaactaaagacttctcgtctctccccctcccttcttcctgcttccaactattcttgtccatcattatatgctgtctctgatgggtcttcctaaatatgggaccccagctccacggcatggcaacaggacccaagttccaaatgctcagtggatcctacacaccagacactcaagagtcatgatccctactgagccatacggatggctggctgattgacaagattcttgaggagaccctgaagcacccagacaatttccgcgttccccgagaacgcacgcaacacgctggagttatccttttcattgactaacacgacagtatgagatgacagataagtggtagagcaagtacgactccaagatagataagtagcctggcagtaaggttcacattacacaagcacagtggtagacacaccaacgcggttcttgataacactcgtactatggggcaggcaaaatataccaaccaatttaacagtggcttattaggcaatccccgtgggaattcgcttttaaaaaccatacacagtcaggatacatttacatttgaaccaagaatacaatataacattagtattttggggagcccacggtgggaccacacaataggaagttgacaacgattggagagaataagcggggaggataaaaaggaagacagagacaggcaccatggtgatgggaccgttagcagccggggagcatggaacagcaagcgcaaagacagacaaggcagtaggggacaccgaccagcggcaggacgaagcaccgacagcaaggaaaagagcgaccgcaacaccgcgaacagaaacagggaagacggcagaaaacgtcgaaaggcggccaccaggagaaacaaaccagtgaaagggaacacgaacccaaaagcaggggcagcacacccgaaggagacggtaaagagcacagaaaagaacgacaagaagcagcaaaaacgcggcgaaaaggagggcacacccagcagggggaacgagaag

SEQ ID NO: 564785 - DNA, 424 bp, Homo sapiens
tttttttttcttcttttccccaagagtaaactattttcttcatggcaaatctctatcctaacaccaacaataccaccatcttcacaatccaactccataaactgatttgcttttgattgctgcctccaaagagagtctatataagatctagacaacgacaggttgaagagaactggaataaattcctgggatgaacctggttcctgggtatacaggatttctgaacttcacattgttttacccatcacagaattttgactattaagtgacagctgaattattgcagtgtcacagagtaactcagcaggatttaggattatgaaaacatttgtatcacttattagttaaatagcatttaaaaattaaacaactgatttgacaaatacggatgtagttgcccaatatagataatttttaagcgtta

SEQ ID NO: 564786 - DNA, 753 bp, Homo sapiens
  misc_feature (3)..(3): n is a, c, g, or t
  misc_feature (70)..(70): n is a, c, g, or t
  misc_feature (93)..(93): n is a, c, g, or t
  misc_feature (109)..(109): n is a, c, g, or t
  misc_feature (114)..(114): n is a, c, g, or t
  misc_feature (147)..(149): n is a, c, g, or t
  misc_feature (152)..(152): n is a, c, g, or t
  misc_feature (154)..(154): n is a, c, g, or t
  misc_feature (171)..(171): n is a, c, g, or t
  misc_feature (189)..(189): n is a, c, g, or t
  misc_feature (208)..(208): n is a, c, g, or t
  misc_feature (306)..(306): n is a, c, g, or t
  misc_feature (314)..(314): n is a, c, g, or t
  misc_feature (319)..(319): n is a, c, g, or t
  misc_feature (322)..(322): n is a, c, g, or t
  misc_feature (337)..(337): n is a, c, g, or t
  misc_feature (361)..(361): n is a, c, g, or t
  misc_feature (367)..(367): n is a, c, g, or t
  misc_feature (376)..(378): n is a, c, g, or t
  misc_feature (383)..(383): n is a, c, g, or t
  misc_feature (388)..(388): n is a, c, g, or t
  misc_feature (411)..(411): n is a, c, g, or t
  misc_feature (418)..(418): n is a, c, g, or t
  misc_feature (422)..(423): n is a, c, g, or t
  misc_feature (432)..(432): n is a, c, g, or t
  misc_feature (435)..(435): n is a, c, g, or t
  misc_feature (445)..(445): n is a, c, g, or t
  misc_feature (451)..(451): n is a, c, g, or t
  misc_feature (459)..(459): n is a, c, g, or t
  misc_feature (461)..(462): n is a, c, g, or t
  misc_feature (464)..(464): n is a, c, g, or t
  misc_feature (469)..(469): n is a, c, g, or t
  misc_feature (493)..(495): n is a, c, g, or t
  misc_feature (500)..(500): n is a, c, g, or t
  misc_feature (512)..(512): n is a, c, g, or t
  misc_feature (574)..(574): n is a, c, g, or t
  misc_feature (576)..(576): n is a, c, g, or t
  misc_feature (578)..(579): n is a, c, g, or t
ganctcaaatatatcaaaatgcacaaagcactagtcttcctccattaccgcttagaaagatatgattgtntctccatttacaaaatagaatcnggacaatttaaatttnccccnttttgcatgcaaaacactgcaattgcttatttnnnccngngggcactctcaccagcntcttctatacacaattgngtatacaatattgcatggnagaaaacagcagctcaactgaaatattagaaaaaaaaatcaaacagatacatacagatttaaaatccagtacttgggaaaagatatcaatgaataaanggcctacnccccngcngcttccacacactgnacctacctactacctctcttccgngcttancccggtttnnncaggngagcnatgcgtagaagaactacttgggntattcangtgnngtatttgancgntaagcctatngataanagtctggngnngnccggnggactttgttagtacactactatnnncgggnaaactacctgtntgtacttgatatagtgcatatgacatgcctgatttaatacaaaactacagaacatgcaaaantntnnctgagatgttaagtattacttcagtggagaacaaaacttacttaacctttcgctaatgcatgtagtaccagaaagcaaacatggttttagcttcctttactcaaaatatgaacattaagtgttgtgaatttgtctgccaagtggttcagaaatacattataaataacctagtta

SEQ ID NO: 564787 - DNA, 226 bp, Homo sapiens
tgatgatctagaggatcccatggtagctctgtctggtttggtggagatatcaactagaagaacagagattgggctggtttttcagtccgggggtgcagtgttgcaccttgtactgggaaaatttaggacgtggtttcattcttggagtctcatgttcaagtgggttttaatgttatgaagacactggggacgtaatcctgagggcagctggggggaaggaagtggt

SEQ ID NO: 564788 - DNA, 827 bp, Homo sapiens
aggatcacttgagtttgacatcagcctaggctgagacctcatctctacaaaaagtagtgtgagacctcatctctacaaaaaatacaaaaattagtcaggcatggtggtgcacctgtagtcccagccacttggaaggatgaggtgggaagatcacttgagcccaggcaggttgaggttgcagcagtgagccatgattgcaccattgcactccagtctgagcaataatagcagcaagactctgtctcaaacaacacacagctgctcatgggcaaggcatgtactttttaccttccaggagttccggttttaaacaaaaatgacagaaagtatactcagagtccttctactctacacacgggaccaagcactagtccgaccgtgcactagaccaggtcaccaccagcatttgatgaactaccacaacgtacgacaactgtgacctgcccagaaaagctctggctctggcaccgggcgatacgccgcagtacacccaaataactgcggcggtcccgacgtctcacctcttggcccaccatgaccaccgtccccgggccactggactggcgtctgcatcgctacaccactgtcgcttacggccatgtgaacgattctaaaacgggtccggcctgactaccatccacgtacatgctgccatccaccctaccactcaacaaacaggcttacacagcatagcccaattacaacctccgcccctatgtggcacgcaccctccctactaatacctaacgatcctcccatcggcggacgcgtcagcttccaccacattgggcgtgaagcacagcgcggcagagcacccggcaagcacc

SEQ ID NO: 564789 - DNA, 91 bp, Homo sapiens
ggcacctgcgtcctactttcacagggagcattgtcaagttcttaggaatcttaactatcatatttcagcaagagcagttctctaatttagt

SEQ ID NO: 564790 - DNA, 269 bp, Homo sapiens
tggactccagcctgggtgacagtgagactctgtctctaagaaaattacaaaaattacaaaaataaacacagcataacaactatttatatagcatttacattgtgttaggcattataagtaattaggtgtcttttgggtgggggtagtacatcctggaaccagtatctcatggatacctagggacaacgtccctactgacatgaagacgttgagcatctttacatgggcataggggccagatgcatatatgattaggagaagtatctatg

SEQ ID NO: 564791 - DNA, 115 bp, Homo sapiens
tctagagatcccttttcagtgaggcgttgtcagtgtgttggttagtaggcctagtatgaggagcgttatggagtggaagtgaaatcactgacaactggctcactgacaacggact

SEQ ID NO: 564792 - DNA, 436 bp, Homo sapiens
cataagtctacagtttgggaatctgctcttgtgttgaaatgaaatctagtgccaacagtgactgcacatagaggtgtggtaaatggtctgtaacggagaagtgcactagtgtgagggtatatggaactggagatgttggtccactgtaccttgggactgcccttgattcatttcaacttggtacatttgtgacttgtgctccagctgtgtggtgttctgggtgtaagcttgccttgtgagccccccaggcatgttggaatttccagtgtattgtttggaggtcatttgattggagagattgggttgatactgaagaattgatggcagtgatgcctcattacgttttagatgggattccgcttggtgaaaacgaggggccttcaattcaatccatcctggtttcagatagtgctgtgttgggggcacaaaatccccg

SEQ ID NO: 564793 - DNA, 378 bp, Homo sapiens
gaaaagctcaaggcatatcaatatattagtaataaaactagtttaagagcgacttttgaattcctctcagtctacatgagtaggtattcactatcaataaggacagattaagcttatggatttcccaacttaaagagcatgccttcctgtctctttagtgcctttatgcattaaaggaatgcaaagggaaaaaatgttgaatagtcctgagaaaagtgaggactgcctgttatgagcctatctttgttctctctcatacataattttaacctccatgttggcctctacagttttggttaagtcagtggatttgaccagtgtggttattttcattatgaaccaaataaaatctatgtacatttgcatatgaaaaaacaa

SEQ ID NO: 564794 - DNA, 486 bp, Homo sapiens
agtaaaagaaaaaaaaagaaagacgaagacacaaagaaatacaacaccaaaaactaaacacaattccaatccttttctggtacctcacgcgcataaattggctgctcctattttttttactggttatgtgtataagggatctaagttaaatctttgggcaatatataaaaatgtaaatagtaaactttatttattaagaatgtcatcctttttaatttataattacacaatggtccatctaaattaatttttcctatacagttttaaatactccagaatattttgcggtccatgatttttttatccggtcccccaatggatttgtttcccccattacggtttcctcttgatcctccaattcaccaggttggttctcacaaattaattaatgtccgagaccgaaattattttgccactgttgattactatactttaaagttctatattatgaaaatatataatagcttgtacgctggaatggaattg

SEQ ID NO: 564795 - DNA, 126 bp, Homo sapiens
  misc_feature (5)..(5): n is a, c, g, or t
tgtantagcaagctcattctggtcatgagattagatattttaaaaaattcaaggccagcgtgtaggtggctcatagactagtaatacccagtcgtacttggagcgtcgaggcgggaggatcactat

SEQ ID NO: 564796 - DNA, 236 bp, Homo sapiens
gtgactctccaggggtcctaggcctcaactcctcccatagatactctcttctctcatagggtgttccagcatttgtttgcatccttgaaaatatccccggggtggggggtggggggtggggtcaagaaccctgccatcggaactggtttccctcatcatggaggtctgcttgaaatgccgccaatgggtcaggtagggggggaaacaggctcggatgggataaggactaagcacca

SEQ ID NO: 564797 - DNA, 598 bp, Homo sapiens
gttggtacagctgttggtttaacttgcacatttgtacatatacttaatgttttcaagtgccttaattgtttaaaatctctggcttcaaagtttctgggggaaaggtcggttaacctcacattttttgtgtttccattagtaatattctaggtacctcacaaaatgtattcatggtgccatggctgtaagttttaagtgagtgctgtaaggattaaattcgaaaaatagggcagaattcctgattccttccaaggtgcaaaaatagctatactgatgtatgtcatttacctggtatgaatccctgacacacatcatgtcaatatgtagcaaatttggtgaaaacataaaattgaagcttctgtaattttggagcatgttaaaaaaagcataatataaaatagtagatttgcagtctaaatgagtctgaaagatcaagctttatttttcctaattagcaatgatatttggccatatttgggttttaaatcaaggattagaactttagatttattgttgtctgagaagtctctataaatactattactaagatttgtgcagcgattgggtttagattcattcagtctaaatgaacattgtt

SEQ ID NO: 564798 - DNA, 1636 bp, Homo sapiens
atcgctccctcgtgagtgtgagtacctgtgtgtttggttgttcgtcggcttcgtgagtgtcgtggtatgtatttagctggccgctggtgctccttctcctggattcgaccgtcctgtttttttttagatggtggggtcctgtccacgtggcgggtgagtgtctttctttttgttaattgtattggaggcctttgtgtgtactatgcttcgttgttttgtgtttctgtctcagcgcggggggtggccgccccagctttggttgtgcgttcgattttgtttttttctcgcccctgcttggttggagtttcatctctcgtgtggtagtagatggttgttttcgtcctgttgtttgtgtgatacagccccgacggtggtgtgtgtgtgggtgtgtttgttgtgtctattcggcgtatgtcgttgggttgggtctagctaagtagtgggttggtattgttgttactgctctgctttgtatggtgtgtgtagttggttgtttgcttggggctgcctcctattattagcgccacccagagatagtggtgggtccgtttcttttttttgtgggaagctacttctctgtttggttgttttttcctcgcggatggttgctctcctcgggggggtgtaccgcccttctgcttcctcagctgatttttttgtgtgtggggtgttgctgcatctgcgctgcgcgggctggggtctccttgcttcttgtgtgtcgtcgactcttttgttggggggggcctcttcctcttgtctgcccgaccctagttctgcgttgtggtactcgttgttttgactccccctcgttgtcgcctcaatatgggtttgttgttgttccctctcctgtcttttttttctctggggtgcgagtcgagatatcccaccccctcgcgcgggggagtgtgggggtctctctttttcttgtgttgatatggacagcccacggtggccgcgcggggtgtgtgaatttctctgtcagagttttctcccccccgctctttctcaagggggtgtcgccatcgctctccgcctctgtgtggagagagaggagaatatctctctctctggggggcgaacctgtgtctctcacactcttgttctctctctcctcgtgttctccctcttttttgtaaatctatcttcatcttgtataaaaacacaccgctctttatataagaccctctcttcctctcttttagaggaggagaaatacaagcgggtgtctctttttattgttgtatgataagaacacgcgcgctcttcttatatattattttgtagaagaatacaccaccgtgtgtttgtaaatctctctcgctgttttgttgcgcgagagaagaatttctctcacatatatatctcctggttttgtgtgagatatgtctctcgcaagatgtttttgtgagaagagagagtttttctgtgggaaaacttctttttctttgtgcccccgctgggaaaaaccccaaaaatccaatgtttgtgtggtggacctgttgttatataacgctcaggtgttggtaagaaccatcttttgttttttagggttttttttttgtttctttttttggagagcaccacacacacacctctccccccaaagataaaaataaaagatttttaggggaaatta

SEQ ID NO: 564799 - DNA, 146 bp, Homo sapiens
actacctttatgtcccggaaaaagcactgtaatctgggaagcgaatggacttacgattgaaaaaattagcatctaggcttaaaaactgcctgggccttgaaagtctttaatagttactaatgttctctactactttaactgactct

SEQ ID NO: 564800 - DNA, 144 bp, Homo sapiens
tgtaattttttgtgagtcaggcttgaaaaacccttccccagttttgatcccttcaagactttgtcacagcctttgtcacacatctgtttttctcgaagaaaaaaatgtaattattaaaaatgttctactcttttgcgctgttga

SEQ ID NO: 564801 - DNA, 208 bp, Homo sapiens
ggcggtcgttgtggcactaaacactgcttacgggactctacgtctaacgacgactccggttcgtcctttactgttgtgtctggttctcactttgttgtgacggttacgtttgacttacgtccttgttgggtggtgacttacgtcggttgttgatgcgctctttggcggtggggctcaatcgcgggggccctagacctgctcagtactg

SEQ ID NO: 564802 - DNA, 262 bp, Homo sapiens
cgatacgtctggatctctctatgactcattcagtcgtacatactaggttggctaccgtgccgccgtttgccacaggtcgtgcttggaaaacccgtctggatatatataataatatagcccagctgtaactgtgacaggtccattgttcatattcgtgcagcaagtgagtatgcggagacactgggttgcagcagagaaaagaggtttaattgtagggttgccaaaacaggaaacaggaggaaccctcaaatccgcctcccag

SEQ ID NO: 564803 - DNA, 965 bp, Homo sapiens
gtgtcctctgttaaacatatctggggctcaagtcctggctccagccatatgctactgctggtatctgcttacagggtgagtactggctctgagacctcaatatcctcaatggttaaatggagaagtctatctcacttggagttgctgtaaaaagataaacaaggattataataatgtaagtacgtgcttatgctgaagttgttgacgacatatgtaaagcaccccaattgttatggtcattgttacgtagaataaagactccattggtaagaaaagagtatgcagaggtctatataaagtgtatcaagcattaatttttatcaatgagaataagggtgttattaaaatgtattcactctagatcatagtacaaatgacgaggaataggaatattacaggtgtgataagcacttatagtattatattgtattgacaaactacgctacatatgtgataaatactatgcaaattcgtgaacggtcttctaaaagtgggttgcagttatgccctgtttaaatcactatatcgctgattggaaataaattttacttggtaattgtctgtgattttggtacatcgctaataataatgactttatcgagtatatttctttgagtaggcaggcaccaggttgatgagtgctactgtgcttacgtattatcttcactagtactttgaagtgggtactgatgactgtgcagtaatgcggagatgggaaaactgaggcgaaagtttgactttgggggctcactctgagtctatgatattttccgaacggtgtcattccccggtgcagagattggcttccaactgcggtgcaataaacttctttgtgggtaccccgcccgggttttcccgctattataactgggctactacggggaaaacgcgaaactcccctcaacacaccggggaggggtccagaaaaaacaaggggggggaaaaaaacggcggaggggaaacac

SEQ ID NO: 564804 - DNA, 1090 bp, Homo sapiens
aggttccaacgctacttgaatttatggaaacgtttgtatttgctattaaacttcaaaactctacaaactgtaagacttgctactttaacgattcaaacccagactcccaggaagaaaaccattgcgagcaatgctcaatgtcactcagaacccttagcacacaggaaactggattactcttctggactactaacacccacccttcacaaaactttctgtcttgccactgcacgaaccttgaacttggggactctgctcctcccacacgcagctaacactacgcacgaatctcaccttacacaacttcttgacgcgcaccggctaccctttcccaagcctcatcaaccacctctgcaccctttgcacgttctcctctcgctgacacggctggcgaactgcttccaccccttccgcggagaacgctctgactctccactaacgacacacaaggaccaccgcctctgaccgttgcacacggccctccccaacatggcgcacaggcaagtccaacgctcggcgcgcagcaagccctttaatggcatattctcttccccaccttcaacatacccacgcacgtcgccacacagaaaagcacacatacgctccctgttcgtccgactttcacaagcgcctttttcaaccgaagcttctgcaaaacgcccctcccttggttaaacgccaacggccagacacaaccgaacctattcctgcttgggacgccccaaggcatttctgccggcgccacttaacaacggctggacaacggacaccccggccccaaaccttacaaccaaacttctggcaaacccccacacccttggaaaaaccccacgcctggtggcaacaccacgcacgcacccaagtctcaccctcacacatactcccccaacgcacccccacacgccgtctgggtctcaattcccaagcgctcgcgccacccaacaattttcaacaattccccagctcctttcggcacaaccaaccttttccgaacccccactcctcacaatcctccgccgtcgaaaaccgacaacctctttggaccaattctccctttttagagcacagcaccttctactcggacccctcc

SEQ ID NO: 564805 - DNA, 402 bp, Homo sapiens
gtgatctattaagggatggtacacttaaaaagtcatgagacatttctgttcttgtaataaatacacggtcagtgggcaattattactcattagtagcttgtttgatgataggctatgaagtctgcccttgcttccttcttgttaatgccgacaaagatcatttatgttccagggaatgtacttcttgggattctccaaatactccatcagtgtttcctctccccagatgatgccttagtgcttattgggggccgggttagagtagtccaggggactgaccagtattccgacgcaatgagaccatggtgatttggaccagtcttgtgcttgtgtcccttttcaacggtgctggcacaggagacacttcataataaaaatcttcttgcctttctcaacatcacc

SEQ ID NO: 564806 - DNA, 455 bp, Homo sapiens
gagtcaaatcagtcaggaagcagccaagaaagagtgctgcccctggggatttaaggaggtgatgagtgagtacagtgatgtgatctgactggagacaggtgaaggaaaaagaattcacccacactcagagacctttctagaaaaggagaagggaaacctccatttaggcaagaccaaagggaagatgaaaaaaaggatatgggccacattgaattctttttattgctgtccaatctagctgccagtctgtatcatctgcttcagacctcccaattttgtcttgagacccggccagagatggagatatcatgaagctgatgaagcttaagcttcagggctcccacttgcgcaggccccttgtaagtcccaggagggccctaacactgagttcacaaggttatatcctttttgcgaaatttgtgaaagattacttttcttaatgagacttacctcac

SEQ ID NO: 564807 - DNA, 216 bp, Homo sapiens
cagtggggcaacacaggccacgaaggcactagagagaagtcacgaaggcttctcctacttaatacgtgcttcctaatccaaacatgttttagagcggcaattccccagtcgtgttcgtcacaccactgcgtggaggtactgtgctcttccagggcaggggtcggcacaattttttcagacgtctgaaaccccagctacaacacaggacgaagtatc

SEQ ID NO: 564808 - DNA, 651 bp, Homo sapiens
tccccctgaaagcccttgcccttaattgggccacaggggtgacggaaagcaaacaaaccgtttggccttagtaaatggcgtgttggtctgaggacaaaatgtgcttaccagaagaacgccagccatatctccacactctcccctgtgaaatgtggtgtgcataaccaccctttcaacacccgtgggccttgtgggttctcatacacagcctctcttctccagggataacaagggggcgtccttgtgtctccccgccttgttacacctcacacccatgtggagggcaagtctccagtagagttccgtggttcttccccctagagacactataaccctcttagtctcacaaagagactcctcgtgagaattgctctcatctccatgtgggtgcggagtgtgggccaaggggtgtgagcagcgttttatttcccaacaaagagagatattacagtctcaaacaacccagcgagaagctcttggcccccaaagccccccttgctctgtgtctcgaacgtggtgcgtggtgttggggggccctccccgcgcccaaacccgagaatattgtgccgcagcacgaggccttgttcttttgggtgcacacgagtatttttttatttcctcttttttctttccgagaaattcggggcaggc

SEQ ID NO: 564809 - DNA, 217 bp, Homo sapiens
  misc_feature (167)..(167): n is a, c, g, or t
ggagagcatacagacgatcctgccaaatgtacctgcttctagaaaaaaggaacttcggagcagtctagagcaggacagtgatccacagcacaatggacgatatttccatccagagcagggtactttacatggataaagaaaataagccattacaggaaaatagtctncgtctcacacagcagattggctttcttagagcgaattataaggagcatcc

SEQ ID NO: 564810 - DNA, 100 bp, Homo sapiens
ggacaacacgtttccaagaagatcaagttgtacataagcagctagcaggcatttcttatcaaagaggattggatcaagtaatcaataagttcctactggg

SEQ ID NO: 564811 - DNA, 812 bp, Homo sapiens
gaagcacccgggcaccaacggacctggcggctggcagtcgcacagtgggccccagctgccggccccgcaggcccagccccagacgtcagagaccggcggcggcgtgtcgggccaggaccgctattacagggccacatcgatcaggcctgcctcctccctgccctctgtcccgtccctggaagtacactctggggtcccgcctggcgcaatgggtctggtgccgttgaggaggccgatggcgtgagggtggcgcgtacgggccttgcttggctccatgcctggcttgatgccccctggtgctgcgtggctgcttgcgagtgtctggccgtgggcaagccgaggccgtgacggctggcacccggcttgagtcctgcccgtcccctcttcggctccgatttcgagaaagagcatagcatgcacgaggaatgcggactgtctaggcacgaacttgaactgaggccatgcgaggccggtgcagaggaatggcacgggcgcccacaaatgccagtgcgggaacagctacgtggcgctgtccgcctgcgccccgttcaatgctgcgcttcaagaaggatcacgggctggtggggcgagtgttcgccttcgatgctactgcccgtcctccaggatacgacgttcagagctgaacgctcttcaccgaagtaccccttgtggttccggcaatgtgtacgccggcgtcctggcagatggctcgccagatgttccacgatgctctgcgggagccgggcaaggcactgggattcttcgggcttcaaggtacctcgacatatgaacgccggcatggatcaggagac

SEQ ID NO: 564812 - DNA, 124 bp, Homo sapiens
gcttagagtccttagacccgctcggcttaacgttctgttgattttgctactaccaccaagattgcgctgtgcggtcgcccggccgcgcctaggttcaggctcgccgtagcgtggtgttgcgggt

SEQ ID NO: 564813 - DNA, 246 bp, Homo sapiens
ggatcttatgctcagtgatctcccgctcagcttaaaagtgtgacaggtgtgagcacgtgctggcagaacatcactttaaaaactctccaggcatggttcctgaacatgtttgaaatcatttgacgattgacatgtgaaaggaacagttaattggttgggggtttttgaagaacgaaagtgaaaggtaagaaggttttggcttaaaatttaaggggttaaaggtttctgtaactcttaattactaaa

SEQ ID NO: 564814 - DNA, 725 bp, Homo sapiens
  misc_feature (18)..(18): n is a, c, g, or t
  misc_feature (116)..(116): n is a, c, g, or t
  misc_feature (638)..(638): n is a, c, g, or t
  misc_feature (690)..(690): n is a, c, g, or t
  misc_feature (716)..(716): n is a, c, g, or t
tatagacgtcttaagccnaatcgccaccagcgccggctccatgaaatatgttgttcctcctcctggactattttttcctgtggtcaagagtacacaaacagaagtaccactgtctntcggagtactctctttcgttttgaacctttctaaattctttcctctacattctaagaactaaacgtgtctacatcgacgatctccttaactataggtgccacaaggaatacaatatttacagtgagacgggctacttttcgttttgatgcatgtagcttaaccgtctcatccttctcgactttcctacccagaccgttaaagggaccaccgttgtctttttcttttccaaaccatggacgggcccgccggcgagctttcggcttaaggtcgtgtgaccgccggcaatgatcacctaggctcgagccatggttcgaaccgcattagtaccagtatcgacaaaggacacactttaacaataggcgagtgttaaggtgtgttgtatgctcggccttcgtatttcacatttcgaccccacgattactcactcgttgagtgtaattaacgcaacgcgagtgacgggcgaaaggtcagccctttggacagcacggtcgacgtaattacttagccggttgcgcgccccntctccgccaaacgcataacccgcgagaaggcgaaggagcgagtgactgagcncgcgagccagcaagccgacgccgcgngccacatgt

SEQ ID NO: 564815 - DNA, 149 bp, Homo sapiens
gcacgatctttgcagtctccatcactagtgttgtaatatagtatcttattcttttttttcttttttcttgagatggagtctcagctctgtcacctcaggcgtgtagcaaaattcagtctccaacacaataaaaatcaaaaaataagaag

SEQ ID NO: 564816 - DNA, 451 bp, Homo sapiens
  misc_feature (364)..(364): n is a, c, g, or t
  misc_feature (416)..(416): n is a, c, g, or t
  misc_feature (442)..(442): n is a, c, g, or t
taatatgttaaccgtctggtttacagggtaggcaaaaccgaagtacagtgacacttagtgactacttaagcgccggcggacgtccagctggtataccctctcgagggttgcgcaacctacgtatcgaactcataagatatcacagtggatttatcgaaccgcattagtaccagtatcgacaaaggacacactttaacaataggcgagtgttaaggtgtgttgtatgctcggccttcgtatttcacatttcgaccccacgattactcactcgttgagtgtaattaacgcaacgcgagtgacgggcgaaaggtcagccctttggacagcacggtcgacgtaattacttagccggttgcgcgccccntctccgccaaacgcataacccgcgagaaggcgaaggagcgagtgactgagcncgcgagccagcaagccgacgccgcgngccacatgt

SEQ ID NO: 564817 - DNA, 1516 bp, Homo sapiens
gtgggcggacgcgtgggtgaaaagccatctttgcattgttcctcatccgactccttgctcgacgcagccgcctccgccgcgcgcctccatccgaacgcacgacggactccggcagcttatatctgccagagtccctgaactctcgactttactttttaatcccctgcatcggatcaccggcgtgccccaccatgtcagacgcagccgtagacaccagctccgaaatcaccaccaaggacttaaacggagaagaaggaagtagtggacagcaggcagacaacatggcacagagacgcccctgctaacgggcaatgctccatgcaggcaacacatggggcagccaggcaggctgcacaatgcaggctagcacgcaacgcaagcaggcacagcaagtgtgccggcgcaggccaagccagggcagagcgcaggcacaccaacccaaaggtgcaaaaggacgccagagccacagcacgacatgcgccgccattgcaacagcatcgcagcgcccagccccgcaactccaccctcaccggcgcccacagacggcgcccagccatggcaccggacatgcactgcacgcgactgaaccgcacctgataccgaactcaccccacaggcaacgcccagcaaacgaaccccggaccgacagagcacactgcacctcacgaaccaacggccacacacaagcgacaccacaacccacaccacccacggcgagcgtgcacccgcagccccaacccaagtgtcatgacaacaccacatccacggacatggcagtgcgcgccccacaacacacggcagtcaacaccagccgcaggtaaacaccaacagcaagagcacagtacaacactctacggagacaaacccgacaacacagatcaggaggaacgccacccccaacaagaaagatgaccgaaacagagcaccagagaaacatgtacgcacaaaccaggtccagtaatagagcacaacaactagcagacgcagaacccacggtacgaagccacaacaaccgcgacgatcaagtaagcaaatcttctgacatcaacacgacaaccacactgtccacaccaacacacactccttcatccaacaccacctacccactcacgataacatcaacaacagaaccacctcttatctacacctactcacccacttcactcctcaccctacatcagcacacacacatctctatgcgggtcaacaccaacctcgaaccagcaatcaaccaccatcacaccagacatacccacgcaagccaccacgacaagacggcgcgcagccacacatgacctaagcatccccgaatcaacacggcggtaccatacacgctacatactcacacccaatcaacctccagcaacaccactagccgatcccgtgaatgcctccgaaatagaagaaccatgacgaacgccaccactacgggacactcatgcatagactaccgaacaagcacacaccaacacccagcgcaccacagacgcaggcaccaaaccaccccagccccgac

SEQ ID NO: 564818 - DNA, 178 bp, Homo sapiens
ctgtgtgatttggctggatctttcccaagacattcggggcgaccggaggagggcagagcccacctttttcgtgaagtccagtccatgcctgtaccctagcaaggcttatggtggacagaagggaagggaagaggaaaggaaggggtgcatgccgccggagtactggccgtcctttcac

SEQ ID NO: 564819 - DNA, 499 bp, Homo sapiens
  misc_feature (256)..(256): n is a, c, g, or t
attttcatcgtggcaggtcttgcggccttggtagcttgcttctggtatggccatcagaatgtcacagacctttataaccctttgattcctaccaacattaagtatgagtttggccctgccatctttattggcttggcaaggtttgccctaattattcttggaagggcactgttttctggttcctgtcctggaaatgaaacaaaggttgggtaccgtgcaccccgcttttaccctaagtccaactcttccaaggagntatgtgtgacctgggatctccttgccccagcctgacaggctatgggagtgtttaaatgcctgaaagggcctggggttgagctcagcctgtgggcagggtgccggacaaaggcttcttggtcattttgtccctgcactccatgaaaagtctttttgggttgggggtgggggggtcccgttggtggaaaaaacaaaaaaagggagagtgtgctttttgtccagtaataaaaaataagttttggga

SEQ ID NO: 564820 - DNA, 861 bp, Homo sapiens
gaacagatgctcactgcgccgcaccagatgcggagaacgcatcgtgagtgatgctggcggggctttgtcagcgagtggagtacgtgcagcacaaactctcacggacgaggagctggtgactggaagaggcggcgacagattgccatgcaattggaggcctccgaccaacatctgcctagatcggttagaaaactggataacgtccttgagcgagaatctcaaacttctagacccgtcgaactaaattaagaaactgtgaggagttgcaggcaaaaagttctcctacaaaggggaccccattgtacagcaccggccgatgctggaggagagcaatcgtggagctgtgtagaaacttaatgacaagtgcttcgtggtgtggagcggcgggccctgatgcccgagtgcatccctgaccggcgcctcgtcatcaagaccggcgtgcagttcactactaaagtcaggtggctggtcaaattccctgagtagaattatcaggttatgattaaagtgtggattgaaaggactctggggacgtggcagctctcagaggatcccggaaattaacatgctgggcacaaacgacgagcagtgtgaaccttgggagaatccacaaacggagctctctggggaatggaaacttgacctgaggagcgaaatgtgcgactgggggccgagccaatggagggtcctgattgggacgacgacgtggccgtcccttgggacgagggtcaccaggcagatgcctaagacccctgccatgtgtcccctgcatgagccgggcgccttggaaggccagcaaagattccccaatagggccagcacccgagggccaaaacttcgtaagggcttcagggccaccca

SEQ ID NO: 564821 - DNA, 895 bp, Homo sapiens
cacctcccaggcggcgacgcggccccggcgcgctatctgggcgaggtgaccggtcccgcgacctggagacgctcgcgagaaagcggtagctagtgcgactcctgcagcgcgcggcagggccagccgcgagccggacgccaccgagctaggcccgggagcatgcagtggggccaggtagcagtaggctgagaatccggtgttcttccgtcctaggctagactcaaggtgcacgcagttaggcccggggaggccattactagtaatagttgccatccggtgtggcctttcacggatccaaggactgcctgtggaaggcaatctagcctccccgagcccccatagaggtctggacggagtctggctagagaagataacaagggccactggaagaagccctggcagtggctttctcgcaggtgctcagccatcgcggccacggaaccggtcacccctcctgcagctctcaagccgccctccaagccacagtggcaggcccgtggaaagcctttgctcctgacgtcgcccctggacggacaggaagaccccgcccctgagatacctagctctgccccatggtgaacctagctccggacccatggactcctgaccctgcgcctgagaaaccgtgctgagtcgtcggatggtctgctccaactggggaaagagtttgccgtgttgggactttgaggaacgattctacaaggtcctttgttctctggtctcccggaagtgggcggagcccaagctctaggcaggatgaggcgctggggactcgaccctgggtgcatttccgaagagctgcatcttggttgagagccggtgagtttaagggggttcaacttcgcccacgccttccgtgggggagagcaaaggagggggcgccggaacccaggga

SEQ ID NO: 564822 - DNA, 516 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttt

SEQ ID NO: 564823 - DNA, 145 bp, Homo sapiens
gaaggtgcaatgaatagtaggtaaaaaagaattacaacttaaaaagaagagttagaatgagaagctaaaaaagggcgtacggaggatgcctaggtagtaaaagccgaagaaggacgtgataagctgcgaaaagcttgggggagat

SEQ ID NO: 564824 - DNA, 967 bp, Homo sapiens
aaggataaaaaccatcaggcccgagtgcctatccatagtccatctccagagtcttcctccagcaaacctgggattcatccccgctgaaaaagcagcaatctagacagcaagggaacaacaaaatcatgctatcagataatactatgatgaagcagagaaacacgagtcgagcgaacagccgatccatgacagggaagtcccactggtcagattgcatgtggcatggccatggtacctgggcaaaacaggtcagcatccccgagaggacatccatgttggaagaattgatcccatctcgagtcaaccgtggtgcccaggctatttaagatgcgtcaatagaagagctgacaaatactacatttgaaaatttccagtatctaatctaggagcgcaaatcacaatcacattatggcgatgcagaatgggaaagtggatggaagtaacgtgtggaaggtggtttcggaggcaagcccccttgactcttcccatacatgcctagatacacgaagccctccctgatccagacaaaaattgctccaggatattctggaccactgaaggaaaattcctcctgaaaaattcagacaacaacagttgtacctaagtactatcaaatctctctgggaaacaaggccattagcaatgatccggagctttagaggcttatatcctaacttttcaagctgagggaaaggagaatgcctgatacggagcttacagggtggcagccattgggggttcgcacacgttacgaagggatttaagtccgagttgagcaccgatgcaaagacccaggtatagtcctgtaatctcttgggacggctagaagacccaaggggggattggacacacctgaggaagccaccagactaagcacaaacacacgaaagtgtccaacatcagaagagttgaaacacgcgaattttgcacgtgtctctgctaccatatacaacaaaccagcttctcc

SEQ ID NO: 564825 - DNA, 135 bp, Homo sapiens
ggcccggtttgaaatttatttatgctaatatttttaaccagtcctttccaaatatgtggttttccaattctccctaaaggggtgtggccctaactgttcagtattgccataaaaaatatttttttttttgtggga

SEQ ID NO: 564826 - DNA, 507 bp, Homo sapiens
aaagaaaagacgaaagtaggcaggagaggcgggtggtggaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttt

SEQ ID NO: 564827 - DNA, 514 bp, Homo sapiens
  misc_feature (18)..(18): n is a, c, g, or t
  misc_feature (30)..(30): n is a, c, g, or t
  misc_feature (43)..(43): n is a, c, g, or t
  misc_feature (63)..(63): n is a, c, g, or t
  misc_feature (70)..(70): n is a, c, g, or t
  misc_feature (89)..(89): n is a, c, g, or t
  misc_feature (94)..(94): n is a, c, g, or t
cccctgggttttcccggnccgaaatccgancccgtagcccaantgggacattgaatgggcctncggaaancccaacatcctagaagaancccancccacaaaaacttttgaggaggaggagaaaacttctcctacccctggtaccttttggttggttgtgggtggttttccttccagtcccattgtacctgatgttcacctttttccctctccttcctgcccaaaaaaagaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttt

SEQ ID NO: 564828 - DNA, 720 bp, Homo sapiens
  misc_feature (3)..(3): n is a, c, g, or t
  misc_feature (54)..(54): n is a, c, g, or t
  misc_feature (90)..(90): n is a, c, g, or t
  misc_feature (98)..(98): n is a, c, g, or t
  misc_feature (112)..(112): n is a, c, g, or t
  misc_feature (568)..(568): n is a, c, g, or t
  misc_feature (571)..(572): n is a, c, g, or t
  misc_feature (577)..(577): n is a, c, g, or t
  misc_feature (579)..(579): n is a, c, g, or t
  misc_feature (581)..(582): n is a, c, g, or t
  misc_feature (585)..(585): n is a, c, g, or t
ctncaaagtgatttttttccccacaaaagttcaacacttaagctagactttcantgttaactttgccctaaaaagttaagacattctggntaaccatnacagtcacatgatntctgatgctatctggtctgttaataataaagtctttatttggatgtatttttcctcaattaaattacaggaaactggatataggatttcgttgcaacgctattaaagttccaaaccaggagtgtgcagcactggaaaaggagatcagtactaaaacttacaataaatatcagagaagccgttagtttttacagcatcgtctgcttaaaagctaagttgaccaggtgcataatttcccatcagtctgtccttgtagtaggcagggcaatttctgttttcatgatcggaatactcaaatatatccaaacatctttttaaaactttgatttatagctcctagaaagttatgttttttaatagtcactctactctaatcaggcctagctttgctcattttggagcctcactaaaataacagatttcagtatagccaagttcatcagaaagactcaaatanggnntgatnangnnatngaaactttcaccaagtcagtcctctctggttagtactctgatcgccgatcagatcataactccagttcagagatatctccgggtatatgtttcctgctatagctattcctgtagagctatcctgtaagctgttcc

SEQ ID NO: 564829 - DNA, 1749 bp, Homo sapiens
  misc_feature (1749)..(1749): n is a, c, g, or t
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 564830 - DNA, 1879 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 564831 - DNA, 1740 bp, Homo sapiens
  misc_feature (1740)..(1740): n is a, c, g, or t
aaagaaaagacgaaagtaggcaggagaggcgggtggtggaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 564832 - DNA, 217 bp, Homo sapiens
  misc_feature (2)..(3): n is a, c, g, or t
annctgccgccgttacactgccgtcgttacactgccgcgtttacactgccgcgtttcactgccgcgtttacactgccgcgtttcactgccgcgtttaactgccgatgttacactgtccgctgttacactgtcctcgtttacactggcctgcgttttcactttccagtgttttatactttactttgttttacacttttcctttgtttatcactgttct

SEQ ID NO: 564833 - DNA, 2126 bp, Homo sapiens
  misc_feature (1803)..(1803): n is a, c, g, or t
  misc_feature (1809)..(1809): n is a, c, g, or t
  misc_feature (1811)..(1811): n is a, c, g, or t
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaaaaaaaaaaaaaaaaaaacccaaaattttttttcttttttttccggcttgttgggaagaaggagactacggccctctgaaggagaggccgaatctcccgggcgggttttccgagagccctctcaaaacccgcccccctatgaacggtggggccagaagcccgcaagatatgctctgcggctttttgtattaccggagtatgaggtgcctatccctgccaggaagcggcccgatatctctttccttgggggcaccctctctccagaggagtcttgtgtgaaccagagcaccctgtgaattttgtgaactccctctctgtgtgaactctgtgtgagagtgagagttctcccagacaaagagaatcccagagcccacaagaaaaaactctcccaaaaacagagatcagaaagagggatacagagagaacagcgaagttccctcctgtgtctctgggtgtgcgtctcgcgctcggcaaaaggggggagacagaatctctctcgggtgtctctcccaattgagacccagtgtaagagaagagggagacccctctctctctncccacnanaagagatgtatcactctgtgggtgtattttggttgcgctcgacgagattgtcaccccccttgttgcgtcctgagagagcttctgcgccgtgtgtgtgccccgccaggtgggtatcacggcgacagagaggctctgcgcttgcgtgcccaaagaaggagaattcccccacgtgttggtgggtggttcccccccattgggcccccccaatggttgctcccctgggtaaaaagagaatttttgttgcttggggccgcccaattccccctgggggggggtttcgcgggcgcgggcggcctatccccccaaacttcttgg

SEQ ID NO: 564834 - DNA, 430 bp, Homo sapiens
  misc_feature (378)..(378): n is a, c, g, or t
  misc_feature (385)..(385): n is a, c, g, or t
  misc_feature (426)..(426): n is a, c, g, or t
gagtctccattaattgcatatggcagcgaaaagtgatctcttgcattgtcgtgtattttttatcacgtttaatgtaatatcgtaaaccttaaataacaccatgagacctataggaagtaccacaagtgttgctcccaggaagcagagaaaagtcataacattacaagaaaaagttgacttgctcgatatgtactatagattgaggtctgcagctgtagttgcccaccacttcaagataaatgaacccagtgcaaggactattataaaagaaaagggaaatttatggaaggctgttcactggcagttatgccaggcaggcatggaaaaaccttgttacttttttgccaaaataccttttttatgtttgtatttgaaggnggcagcnttttatgtggggttgcagggattggctatggagggaagggnctta

SEQ ID NO: 564835 - DNA, 471 bp, Homo sapiens
aggactgctcgagtgttcaccagtgtctcctgtatagcatgcagcctccttattgactcctcaggactggtattgaagtaggagatctgtgtatagagcagttcagatctatatggcaactttaagtgaggcgcttgatgtcagtgctcaatgttgatggttgggaaggtgcggctgtagcatcagaagggctctccctccggccctatgaggaacttctcaaagttccaggccacatctgagacgatgcacagggctccaaatgatgagcttggaatcggtcatgagtggaaaatgagtcatcatcagggtaggggaacttgtccttcaggtaggcgaagacaggatgctcgtactgcccattcacctcacatataaggacaagggtgaaggtgggctggtatccacccccaggacggacatacttgagactgttcaggatctcctcatactgacagttctcctgatgtc

SEQ ID NO: 564836 - DNA, 1425 bp, Homo sapiens
gcaatggggccggcctcagagagagcgctgtgtgtgtgtgtgtgtgtgtgtgtgtgtgtgtgtgtgtgtgtgtcgccctcagacgcgcgctgtgtgtgtgtgtgtgtgtgtgtgtgtcgccctccgcgcgcgcggctgtgtgtgtgtgtgtgtgtgccgagcgcgctgagacgacgcgtagtgaagaagccgagacgcaaggatacaacacgacgcacccccaacatgtcacgtcgtgccatcaccccccactcccaaccagcacgcgccccacccaaccacaccacataacgacacgtccgtcgttcgctacgaagacacacaccacacaacacagaaacacacatccctccgtaccaaccaccaacacctgcgtcgttcgctctactccatcaccgtgcttcacactcccacgacgcacacccacccccacccacctacaacgaacgttgcttggccacatgcaccacacacgcaggacaggacaatccacctacgcttcctcacttacccctcgccacgtcagaccatgcacagcaacactcccctcccactctcccctctcaccgcgcggcagccaggcagcccggcccacaacacgccgaccccacacaacacacccacaccaacatcccccccctcaccgagagacggcagcccatcccccccctccccaacctcaccaccccacccacaacccgcgagcagcccaaacaaaacacagacatggcaaacgcacgaacaccaccccagcgaagcacaaccaccgcaagcccgacaccacaaacagggagcgcaccgaggcctcaaccaaaccacacaaataaatccatttctctcaactacataaactctctgaataaataataatttgcttcaccaaatatataataaaataacaacccaataccacacaaactgtacataaaccacatccctttaccaaccatatcaacctcacccaaatcaactaacatacacccacccccttcacaccccacaacctactatccacccaatacttgaaccccccagacacgcatgcgcaaccaacaatacacacacaaaccccaccctccactcctacgctccgcaagcacagcacctcacgaccgcgtacgagcagacgtcagcgtcggcgggacgccgaacggctagtcgtggctcgcacgcgaaatgcgcgcctgcgggtcagccagacccgatgcaccacaggcacgcggctgcgccacggcacacacctacagcacgacacaccagcatgatcacaaccaggataggggaggtgcgaggggaatgcggcgcagcgatctgcaacacgacgcccatgacaggactagagacgcacacacccagatcctgcggacctaatactacgcgcgccgctcaccacgcacgacaccacacctaacatcatcgtcacag

SEQ ID NO: 564837 - DNA, 1486 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaggaacacatattttaaaaaacacctcgttcacggtggacggttgctctcactcacccaacttggggccgttttcaaaaaaaaaaaaaataagtatttttcccatgggggccccccttgccccatttctttttaattttggcaaggttttgcctccggcccaaatttgggcctacttggccacattcccctttgagggggcggaatcaaatcccggggccgggttttcaaacgggggcatggg

SEQ ID NO: 564838 - DNA, 391 bp, Homo sapiens
atccgattcataggttttgtgtgtgtgtgtgtgtgatgtgtgtgcgcgctgtgcagaatctcgatccttatttatgtccatgttcgtcattgtttgctgctgtagaaattcttttgatgtcttagccataaattccttgccaaggctaatttccagaatggtatttcctaggttttcttctagaactttatagtttgaagtcttagatttaagtctttgatccattctgagttaatttatatatgtggtgaaaggtagggggccagtttcattcttctgcatatgactaggcagttatcccagcagcatttattaaatagggactctttcccccataggttaggatattaatgaattttaaaaccaatgagattctactttacatccagtg

SEQ ID NO: 564839 - DNA, 1762 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaaaaaaaaaaaaaaaaaaaaaaaaaaaaaaaaaaaaaaaaaaaaaaaaaaaaaaaaaaaaagcgagggggcggcgcgcgcccaaaaaaacacccccccgggggggcaccaacataacacaggccccaccctttttgagtgaaagcggaggggcccgccccaaatagggggggcgggctttatataataaccgcccgagccggcccgcggccgcagtaacaaacaccgcggccgtagcgagggagaaacaacactcccccccggacgacagtctcacttgcgagaagaaacgccccccaccccaggcgggggcgaacaacaactagggcggcgacacaccccgtcaacagagagaatatttaaaccgcccccacgggcagaaaacacacaaacaacttccgacagtggctcttatagcgcggtggttacccaccaacgcacgcgataataatgcccgcgcagacagacaactcttggacagcagacgaacatagtccaaaaaacaattttaacccgg

SEQ ID NO: 564840 - DNA, 163 bp, Homo sapiens
catacctcgaccttctggcatacctgaccttctggcatacctgaccttctggcatacctgaccttctggcatacctgaccttctggcatacctgaccttctggcataccagaaggtccaggtatgccagaagctcgaggtatcccggaacccgtgtctaaatt

SEQ ID NO: 564841 - DNA, 138 bp, Homo sapiens
  misc_feature (8)..(8): n is a, c, g, or t
  misc_feature (23)..(23): n is a, c, g, or t
  misc_feature (47)..(47): n is a, c, g, or t
  misc_feature (59)..(59): n is a, c, g, or t
  misc_feature (79)..(79): n is a, c, g, or t
  misc_feature (101)..(101): n is a, c, g, or t
  misc_feature (103)..(103): n is a, c, g, or t
  misc_feature (118)..(118): n is a, c, g, or t
  misc_feature (120)..(120): n is a, c, g, or t
  misc_feature (123)..(123): n is a, c, g, or t
  misc_feature (128)..(128): n is a, c, g, or t
actgtacnagagaccaacgatangttatgatcatgaataatgctacnttgtaaaaaganttcaagttattaggaagcanactctcgttttttaatcatcgnanaaatattccatgatncnttnatagnacaattctag

SEQ ID NO: 564842 - DNA, 727 bp, Homo sapiens
ggagagagagagagagaactagtctcgaggttatttttttatttttttccacggtccaaggttaatggggggttaagtgggtataacactgggatagtgggttgcttggttggtatgtaaatctttaacattatatggtaatgtacactactgatatagtctcacaaaataaaatccttgtggaaaaattatgcccaaaacatgatatgggattataccctggaccccaggatgtgactcactggggaaaacattgtgggactaggcttgtccagtaggaaggacgccaggaattgttatatacacacacggtaaacatccacctgggctcagggggcaaatgcagtacgtacagcattgggcagtggtgctgtcaagaggtggcacagaactatttcacactacccagttgaagactacccaagattaataccatccagcatcaggatatagctgtggatttgacaacccattcgttatttctaacttcaaggagtcgatgttttccccagtccatcttaaaatattacggcttataatcacagatcagataacaagggacaacatgcacaacctccacctagaatcctgtgtgtaagcctagacgaggtgaaagtgatatgacatcagaagactttaaacatgtgcagcccctttggaactcccccaaagtgtttctgcactcttctacaaaggggcctcttcctcaaaagtcagagtcaccttc

SEQ ID NO: 564843 - DNA, 336 bp, Homo sapiens
gtggtgtcgcgaccaggctgtgatgtcggggtgaggctggcgtcacgaaatgagttagggaggattccctctttttctattgattggaatagtgtcagaaggcatggtaccagctcctctttgtacctctggtagaattcggctgtgaatccatctggtcctggactgtttttggttcgtaggctcttaattgttgcctcaatttcagagcctgttattggtctattcagagattcaatttcttcctggtttagtcttgggagggtgtatgtgtccaggaatttatcagtttcctctagattttctagttcatttgcgtagaggtgtttatagtat

SEQ ID NO: 564844 - DNA, 1578 bp, Homo sapiens
  misc_feature (1578)..(1578): n is a, c, g, or t
tcctcatgtatcgtgctgtacagaaatatcctcccctggtcgtgtatgaacttcctcatcggagaagggtcgacacgactgacacatggattctactaacctcacattactcttgaatctagccgtgttagcgatagattggctagtgcggactttaacggatatttgactttcaactaaacctacccatgaggctgtaacgtatccacctagcatcgccaacactcctatcccgctactcgaaatggcagctccttgaatccatgtgccaagccccctgaggtctgcctaactctaaatgattcctttcccaaggtctcgtgaggtatcgccctcgcgcattttaggtgactcgatcattttagcaagcatcccgaaaaacacatccatatagaccaatcgcattgctttctctaatcctctagagccgaaagcggacgcgtatgaacgcccacgatctacattagtgagcctagaggatcttgaatcccatcgtattcgggggttcagtgggcacctctgtgtagacgattcccccttctcgcttgtgggtcctatcccccggggccaaccccgcgcacgtgaaaatacctacgccgactcgtgcggatgaaggggtacagcatcagtttccagtgtcccaggggacggccgaaacctcaagtaattggtgcctagcgaataaggccgatcatggtgttccgtcgaaaaggaacccgcgggatttaccaccgatgagagcaatttctcttcatggggccgaaaagaatgcgggagcgcttggagcaccctcggccccatatttcacttcttttgcacccccggaaggttacgtaagggaagctgtccaggaggttaactgggccgttattcaactgaattattcgaacacggacgcgcttatagtcgaaccagattccaatatcaaactaagattccaaacccaaaccaggcccggtacacatgggcagggtttccaaacacctcgaaaacgtcgggagcaaacccgtcgtcgcaaaagagaaaagaaccgaactattcctgtcccagtggcctccggggcacaggcgtggagggttctcacgaaggaacgtggggagaagcaaatgtgtgggggcaaaatttatatatctcccccggcattgtttaggggacaccatactcaaggtgcccctgacgccaatttgtggccaacgacaacccacgctgagcctccccacgtgtggttcctactactgtgggaggcccacaggtttctccaacttttcgccccacgtggtgttgagaatctcccttggtgtccacacctacctatttccagtggaattgcagagagagccataatgtaccaggatgacccaataaaccagagagggcacagaagtaaactacgaagggaactagttgggagcaaccccattcccacacatagcggcgccgcaacgggcaggtaaaaatagagtagaccactctagtttctcacgtaccagacagggggcgcaaccaacaccagtgtacaagagaccacacacaatcataatacagaaccagattatcagcggaagcagtacgacggan

SEQ ID NO: 564845 - DNA, 679 bp, Homo sapiens
ctaatttacatgtttaccaagctgtagtgctttaagaacactacttaaaaagcaaaataaacttggtttaacatttaaaaaaaaaaaaaaaaaaaaaaaaaaaaaaaaaaaaaaaaaaaaaaaaaaaaaaaaaaaaaaaaaaaaaaaaaaaggggggggccccattcccccggggggcccatcccccccagtttttgtgtaaaaaagggcggcccccaataagaggaaggctcctaataatagcaacgaagacgaacgacgagccgcgcgacgctgattaaaaacaaacgacggcgagcagggggaaaacacgtccccgtcgggaaacacctctgtgggaaggagagcgaccaaccacatatcgcggcggggggagggagacacaaataagtagcgcgaccaccacaccacctccactaaggaggaatatatatagaaagggctcgtctgaagagggaaggagaaatatatatatacatattgtcagagaggggtgtctaaagacgactgtgggtgtgtaccaacacaccacgctgatgatataataatttatgagtcgaggagggtggtaaaagaaaataagtttgttgagtcatactgaggagaaaaattgtagtgttatagaagaaatatttattaccgaagaaggaggatgtaacagaattaaaactgggggttt

SEQ ID NO: 564846 - DNA, 1044 bp, Homo sapiens
tggctgcagcgcagctgtccctagcaccgagcctcccgcagccgcctgagatgctgcgaacagagagctgcctgccccaggtctgcccgccggacatggtgtgcctgctgtgagtcccctgctcctgctgctgcttgctgctgctctgcctgtgtgctgctgggcgcctgcctgatggtgctccaatattacctcaaggattacagcctgaacaacatgctacatgttgtggaattgagatagatgatacttgttcgtcttttcttgtccattgattctcagcctcagtgcatccaacgcacttggaggagctttgctttatgattatgggaatgctaccaaagcctcaggaacacgatgacacaacagataatactaaacaggttcttatttcattattcgaagacacagacgttgggcaagtcaacatgtcgtgtcgtcagttgtgcatccgttgctgcagctcgttcctcacctgcatgagagaagactgaagagattcagagtggacgacgaattccaaagtccctttgcaagtcaaagtcgaggatatttccattcaggccacggaatggcccgacggtcagcagggtacatttacacatggatgccagctaattttccacagagcaatgctctggcaatacaacatgtactgacattagggtcccttctgaccaaaatcctggctaactgtacactgttgaaaatccctgtgtggtcatgtctcagttgtaaccatgttggtacactgtcgcacgtcgggtcggcacaaattacaaaaacttcttcccacttgcacgaacacaacatacacacttcccagcggctataaattgtgagggtgccgcgcaaaaacacgtatatgtgtgccattggtcacggttgtcccccaacgcggtctacatggacccccaagcatcgcgtcacccacaggggggtcaaaaacatgaccggggacacccccataaaaggcaacgcctacataattcacccagcacagccggttaccacgaactactgtctccgacatacacctgagag

SEQ ID NO: 564847 - DNA, 360 bp, Homo sapiens
atagttatattttcgctcctctcctcatcctacactttaccttcaagtaggttccagagtctgttgtttccttctttgtatcaatgtgttctcatcatttggctccctcttataaatgagaacatatggtatttggttttctcttcctgccttagtttgctaagaataatggcctctagctctatccatgttcctgcaaaggatatgatctcattcttttttatggctacatagtattctatggtgaatatttactacattctctttatccagtctaccactgatgggcatctaggttgattccatgtctttgctattgtgtacagtgctggaatgaacatttgtgtgcacatgcctcta

SEQ ID NO: 564848 - DNA, 676 bp, Homo sapiens
  misc_feature (512)..(512): n is a, c, g, or t
  misc_feature (517)..(517): n is a, c, g, or t
gtatttttagtagacatggggtttcaccatgttggccaggatggtctcgatctcctgacctcgtaatctgcctgccttggcctcccaaaatactgggattacaggcatgagccactgcacccggctggaagtgactttggaactgggtaatagacagaggttggaacagtttggagggctcagaacaagacaggaaaatgtgggacagtttggagctccctagagacttgttgaatgtctttgaacaaaatgctgataatgatatggatgatgaaattcaggctgaggtgctttcagatggagatgaggaacttcttgggaactggagcaaaggtgactcttgttacgttttactaaagcaactggcagcattttgcccctgccttagagatttgtggaactttaaacttgagagagatgatttagggtatctggtggaagaaatttctaagcagcaaagcattcaagaagcaacttgggtgcttgttaaaggcattcagttttttaagggnaagcngagcttaaaaatttggaaaaattgaagcctgacaatgcaattgaaaagaaaatccctttttttgaggagaatttcaagcttgctgcagaaatggcgttagcaacccgaggcaaaggttattccccaagacattgggtggttccaggcattttggtcttc

SEQ ID NO: 564849 - DNA, 198 bp, Homo sapiens
ccctagagttccccaggtagacctaacgtctttacgtgtgtacttgcgcttactttgtagccttcatcagtgtttgctgcagatggcggtatataggctaagcaagaggtggtgaggttgatcggggtttatcgattaccgaacaggctcctctagaggttaggtctacctgggttaggtctacgtgggttaggtcta

SEQ ID NO: 564850 - DNA, 275 bp, Homo sapiens
ccactgcgcccagtctacacactaattcttgttagcccaacagctgttctgttctatctacccctcatttcacgctcaaggagtcatacctagaatagttacacacaagagggaaacttgaagccaaacactgtacaggattgtgtaggagtcacccccctactccctttgattttacatgcggtgctgatgtgttttcgcagatgggctctcagatgaaggctcatggaaattgagataacccccaagacataacagattttgtgagtgataca

SEQ ID NO: 564851 - DNA, 679 bp, Homo sapiens
gcggcgagtaagatggacgatgaggaggtcgctgagagctgggaagaggcggcagacagcgggcaggaaatccaatatctcctcccaaagtgcccattgtgattcaggacgatagccttcccgcggggccccctccacagatccgcatcctcaagaggcccaccagcaacggtgtggtcagcagccccaacatccagccaggcaggcccacccttccagtcaagtccctagcacagcgagaggccgagtacgccgaggccccggaagcggatcctgggcagcgccagacccgaaggaggagcaggagaaacccatcctcgacaggccaaccaggatctcccaacccgaagaaagcaaggcagccccaataagtgtgatcagacagcctttgggtcctgatgggtctcaaggccttcaaaacagacgcagcatcacatgcaggcaagaaaaagatgccgaacgatatgctgacccgtcaccgactcctgggtcgtccgaccacgggatagcacctgccgtgggcagcacagctggacttgagcagacgggaaacacactgacttacttgcactgtgatcccactaggtcagcccactgtgaccattgacacccaatgaaatggcgacctccaccccacatcacactaccaatgtgattggccatcgcacacggctgacca

SEQ ID NO: 564852 - DNA, 175 bp, Homo sapiens
cgtatcagaggctcgcaaacatgcttaggcaatctccatatattatcacatatttaccagctaagtcactttcctaatgtctaccctacccaagtcactgttatgtttctacagaaggaggaagagtgcgtgtatcatctcatctcgacccaatattagtgtccagggcacacct

SEQ ID NO: 564853 - DNA, 861 bp, Homo sapiens
  misc_feature (28)..(28): n is a, c, g, or t
ataatccttatttttttcacaaaaaaanattttaataatagttgaaacttcggcactattctatgctcctattaggagaggacagctgtctgcagacatctgtatggaaacataggataggaaatttcagagatgcgtcatatgaagaagggtgtatttcagcgagtagtggcaatttttatccacttattgtgatgtcaatggagagccagttggagatgactacatttaattggtcctcctccttttcagctatttatgtcagaaagctagtatggccatcctagctgtcagagtgctccacaaggactagaggcatgcaatttgttaggttctggctcggttagcttttttgggaattgtatcatgttcatcgtaattgtgtactattatttgttcatatatgatatacatcgactcctgctggagttccaactttattcgctattatgttacgaaggccgttatcatgttttattagcgctgtacttttatttcgtctatttgtagtgattttggtgtaaagccatgtggcctcgcgtcccgtgtcggttttaccaagcgtttgatcctttatttatctttgagaagatttttttattcatgttacattaattattagggacacggtctctctcttttatacacttttgttttcgtcggtgggggagtatataacttctgtggtagacaagattaatcatatcgggacactatttttgtccacaccacccttttatttcttctgcctccttattctattatattctggcttattgtgtttttgcgttacgcaaattatctatttttatctcttgtaagttttattagagtaattaataattgcgagttccttcttcg

SEQ ID NO: 564854 - DNA, 228 bp, Homo sapiens
attcgcggccgcgtcgacaactttggcatcaaaaaccaaataccacatgttctcatttataagcaggaagctaagctataggtatgaaaaggcataaagagtgctataatggacattggagactcaaaagttgcgaaagtgagaggggagtgagggataaaaaactccctatcgaacacaatagacactactcaggtaatgagtgcacaaggaccccaaacttgacca

SEQ ID NO: 564855 - DNA, 146 bp, Homo sapiens
gccggtaccgtgatgtatcccaacactttcaaagaacacataacgtggcagaagcgatatgaaataacagctctagtatcaccaatcactaaaaaaatgcaaatcaaaatcacaatgagataccatctcggctagccagtcagaat

SEQ ID NO: 564856 - DNA, 939 bp, Homo sapiens
gtagcaaagttgtcaataaactttaagagaggcgtaaatgccaaaccaggggcgggttaaactatagcgcgcttttatggtataaaagttgtcaaaaggtgatgtgtgtttcgcccgctgaccgcatgaccaattggggtctcgccacccgtgacgtccaatgtggggattactgtacacaaggggaaagaactatattcttatatggggaactgtcgtctcaaacaatggtgttaaggaacatgcccctctcattagggaaaccccctgagccgcggagctattatagctcgtggcctcttctctcccgttgccaaaacaaatgaggatgtcatctcacgttaggggcttgatgaacaaaagttgagtggaagacaccctgtgcggaggagtttcagatgtcacggggttgcacaccacgttgcactataggaattagagacagttttcacaccttgggcgcctgtcaaggttttgtcaatgctcattcatagatcacacggagaatggtgcctggtcaacacgtgtccacaagtggagataaacgccaaacagacaggtgtgtgtgcagcacacgtttggattgtcccgcatagttccacaagaggttaagaatatctgttcccccaacccacatgtaagcacactgtgagaggagggtcttatgacgcacccaaaactgcggacactcccagtcgtactttttttgaggaacaccgcaaaatacaggtgttacttatgataaagagcatgctattgttagaaactactgggttatccacgggggaattgctgggtcacagacccccgctatcacgccagctaccttgggcaacgtgaaggggcggggggaattctaatactcgaaggtaccaaggaactgttggggccacataaaggcgggaaccccttactgtataaaaacaaccaaaaaaaaca

SEQ ID NO: 564857 - DNA, 301 bp, Homo sapiens
  misc_feature (2)..(2): n is a, c, g, or t
  misc_feature (40)..(40): n is a, c, g, or t
tntcggctacaacgccaaggcgatcgcatcgggttcgctnttccgccgcgtcgtgctgcgcgggatcaatggaacttttggagcgcgcgcagcgaccgaggctgcgggcggttcggtcgaaacggagtgatcccgctgtggcgacgatgaccgcccctggcttcgcgctcggtaaattcgccgacttgaaacggcgcctgtggtttctcgtcggcgcgttgatcgtataccggatcggcgcgcatattcccgttccggggatcgacccggtgcagatcgcgaagctcttcgaaacgcaaca

SEQ ID NO: 564858 - DNA, 655 bp, Homo sapiens
tagtgaacatttctttatatgtcttttgatgaacataaacacttagttcttttgtgtatacacccatgagtataataactgtgttacagtacagacgtatatttagctttaataggtttaacagctttagttttccaaagttagtgtaccagttgcctacctaccagcagcgtgtgagagtttactttacattctcatcaatgtttgatgttgtcagtctttaattttagctattctattgggtgttagtggtatcttgtggtgttaatttgcattttcctgagaaccaattcaaccagagagtttttaggtttttttttctttttctttttttcttttcttttcttttctttttttttttttgggaattttttcacaagcaagtggcttctgttgaaatctggattaatggagtctccgtgggggggggcctgtgtcacttagatttctaaattttccccacaggtgattcttaggctttaaaactctcgggataagatttagggctttggtcagctttggcctaagggttcaatttaaaggtctccaagattttttcacattctactaaagagggagtcttgacaattaaaaggtttttctacttgaaccagtttaacgatcatgctatgtcagggtctccagaagtcgagta

SEQ ID NO: 564859 - DNA, 230 bp, Homo sapiens
caaaggcagtccggcaaaagaatcactggtgttcagaccaaagtgattccaagtgaaatagtttgtgcacacatggtgtgatctttcaatatgcagaatccatttgtttttctcatttcagaggattttaaaatctaaggtccatactgttttggtgcagaaaattcactagttttactttcatttgcttatgttgaaaactgatattaaaataaattaaatgtaattta

SEQ ID NO: 564860 - DNA, 865 bp, Homo sapiens
atgaggatctctagcattggtattcgatagattgtatagagactgggtgtcagagtccggaccttgtctctagagataaacagaagaatggcatgtgtatgtcttagcttgagctccctcctccctcttcaactcttcttacatcagctcaccgggtcttccattgtgtaataacttgattggtgacgtgtatcttctgatatctgctccttctatctagatatacgaacctgacagatttttagtaagtgcccatattctcagccttcagtatgagaaacttgatttgcactaacatttacgcaagagaatgatcagtgagtacttgaactagtggtagtctctttacatagactatcggcatctgccagggccctgatgacaaactggtagacaagttgatctcctagcagcgtttataatatgactatgagtaatgcttactgccttaacatattccataaatatatcctataatctattgataaggtgacctgacgtgagtggacgtgccactttaacaacttcaagcttccacattcccagtaggggttatgtcactctctggctcctgggagtttagtgataccgtcatgtttctttgtatgttgaaattactttgttatttgatttacttcaaagttcggtattaccctttaaaaatcttattctattctttgataatttattgtatattatgccctcgaaacatccttctatccaagataccgtcatgttcccaggatcccttcccgtcgtcttttctctgccctttgctggttttctccattagaactctcttctttgaacccatccacctgttctttccagaactgagcctcagaactgagtcttagtgagaccg

SEQ ID NO: 564861 - DNA, 1291 bp, Homo sapiens
  misc_feature (640)..(640): n is a, c, g, or t
gacttcctctcaagctcggcgtcagttcggtggcggttacactgcgtggttctacatgcgtatcgaaaagtgttgatctctgttcggaggtcccattctatcctggtggcacggcatgatgttcgtccgcagatcgattgctaggtgttcagatttcgcaaatctaagatgtcgataaaaagctttaaaaatgaagcgctaattcgctcggcgaaagtttaggtgtgatcctcacatgcaatttccggagagagctatgctcggtaatagacgtagacttaatcagtttgggagtaactctcattgtgacattttgagaataagctgctcaggaaaattgaatccgttaatcagatatttactcaagccgtactaccgctaatgcgcatatggacaaaacgtatttggaatcgtcggattagcaaagaagaaggattagatacgtaataattcatagaaccaaggataggacagtccctagaagtcgtacaaagtcttaatttaactgcacaaccaggacattggaacggaatagacatagtcatagaagcaagacctcaccaagggaaggcgattttcacgcgcattaacccgatcatgaagaagttccatatgcaaaaaaacattccactattgcgtntgactcccagaaagcccgccttcgtttggccaggggctctagaatgggtggacaccccacagctttagaggacatggacgggacaacacattggcgctaaccattgcaagggtctacacccatggaggggaagtcttgtggggcaccaatttgcgaagagcgaatggcttctccgtttaagataaggtactcctttccttggtttataggctcaatttttggcttttttttaatttgttaccacgttatgtggacacacaaattgtctcccgtgtgtctggtgcacttatcgttcggcggaaacatggacgttgaaaaagtttttacttctttttaacttcttcgcttcttaaccccattaaagcgggttcccacttataattaatttgtgaaataaaggacggaatttaactaatggaatcctatcgttattgcgcgttgtccattgtgtcccatttcttgaactattaaattattccagggagttatttcacagggaatggttcagagaatttgccattccttcaagttggtttaaaaatgccttttactgtggaggctagcattgttaactttaaagggttataagtttcaagtggaaaaaaatttctaaagtttggtaaactaatttagcaaagttggaaacttggg

SEQ ID NO: 564862 - DNA, 196 bp, Homo sapiens
  misc_feature (120)..(120): n is a, c, g, or t
  misc_feature (176)..(176): n is a, c, g, or t
  misc_feature (190)..(190): n is a, c, g, or t
agaattcctgggtgtagcaggctgctaggccggcgccttgccgccctcctgcccccgctgagtctgtttctccaatcttcctccccgcttttcttcaagcagtgccaactctttctttanatagacataggttttagctgggtagagtacaagaagccagcttacgcagttcccanaagtaaatgccttngttaca

SEQ ID NO: 564863 - DNA, 260 bp, Homo sapiens
ccttcatctgtcctatggaaatgaaaatcatcaaccacccagaagttatgtcaaggccctgaagcacccatctcttggaaatgaaaacattcaaagtgctacctctgcctcccagtccccgagggaggaaaggacccagctctggtttgcaccactgcctccgggtcaatacaagatcacccagactttggccccactcccgggatcaggccaccatttaacaaaacctggacgagcgtcaggctcttattcaacgcaca

SEQ ID NO: 564864 - DNA, 1010 bp, Homo sapiens
gagacgtggcggactctcgcctggtgctgtttcgccgagcttcatttctcccgagtcagatttccagcctgggcttatccggaggtgctatggcgccgcctggtccccacctacttgtagtcatgatctccgttaagcggaacacgcatgaataagttggacatgggagttacaccatcgaatttggaagtgtttcatccatgattcatctatggaattgacttcgtcatttgctatgacgagagcagctacatggatattggcaaagtgtgcttagtgtatcgtaggcacggacttgtgcattatgtaatttgtgtattagagacgaagcacttcagacttgcttcattccaagataacgtaaaactgaagagctagagtgtttactttgctgaggtggaggctatatggtaagtccttatatttggtgtgcgcctgttgactaagtgcatagaatcgtatcgaaaatttacactggagtttttgagcagtctatggttcatgggagctatcttatgccatgtcgctagtatgggcttcgattaggacacagatgtgccatgctccattggaatccgcgtcccataaaatgtgatccttggcaactctagactcagattccgtcagatcaaacgtttgggcacgcaacagccaaataactcatgagtagtaaccgaacaagttgcaatatatgacataacgtcatattgagaaaatatagctgtaactttattcacgcgactcaagttgtgcaaccgaaaattagtttcccatgggcggggacgaccacgtttacagccttgaccattgcaaagaggagcccgtctggctgcactggcttccagtgtttcccaggggaggttgtctaacggacaccggctacatacggccataccaacaggttggaccgaggcacagtcaaaaactattaacgcgacgcgacaaaggccaaggtgaaccagtacaggggccgtgctaacgtcacaggtggaagccgaagtgagcgacag

SEQ ID NO: 564865 - DNA, 207 bp, Homo sapiens
  misc_feature (43)..(43): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (173)..(173): n is a, c, g, or t
ttggaagaatggtttgagtctgggaggtcgaggctgcgatgantattgatcacaccactgcactccagcctaggtaacagagcgagactctgcctcaaaaaaaaaaaaaaaaaaaaaaaaaaaacaacaacaaaaaacaaattngtactgcangtatangtaatatctctttntctctctctttccccacttccttctttccttctt

SEQ ID NO: 564866 - DNA, 279 bp, Homo sapiens
gacctgctgccgtctgctgcaagtgtgctggagttggctggaggtccactcagaccccgtttgcctgggtatcactgtcagaggctgcagaacagcaaagattgctgcctgttccttcctctggaagcttcgtcccactggctgcagtggccttactgagcacctgccagatgccaaacagagctctcctgtatgaagtgtcttttggcccctactgggaggtgtctcctggtcaggatacacggaggtcaggggcccacttgaggggcagcacccctg

SEQ ID NO: 564867 - DNA, 228 bp, Homo sapiens
gaaaggtccagaccacccaaacttggctggattctacatttctccacctgtagtatggtgcgtccagttgactatgtagcagaggcgaaaccgtgcatggagtgtttctactagagcaccagtgttcagctgctagcttcacatctaccagagcatatatgagccaaagtggcacggagatttggtattcttgcccatctgtaagcctgaggtcccccccgttgcctg

SEQ ID NO: 564868 - DNA, 214 bp, Homo sapiens
gagcaccgcggtatgaggagacccatttctataccatcacctattctgattttacggtcaccctgtaagttaatattcttatcctaccaggcttcggaataatctgcccactattgtaacttactgactccggagaaaaaagaacgatttgagatacatagagtaattgtctgagactatgactatcaaattgtgattccataaggatttatcg

SEQ ID NO: 564869 - DNA, 206 bp, Homo sapiens
gagaatggctgttactacgaagggctatgtggctgattgaagagtatgcagtttagcgatctcaggtctgtttgtcatctgcatatggtgcttgttatacattatgcctcatagggatattacaatgaaagtgtatgctatgtgtttcgtcaggcggttgccgaatgtctgtgaggcgtattataccaagcgccgtcgcctacaca

SEQ ID NO: 564870 - DNA, 107 bp, Homo sapiens
acctcgcttagtgctccttttggtacggaataacagtgagaaattactgctaataccgtatgatgacgtaagtccaaagatttatcgccctaggatgagcccgcgta

SEQ ID NO: 564871 - DNA, 211 bp, Homo sapiens
  misc_feature (16)..(16): n is a, c, g, or t
  misc_feature (91)..(91): n is a, c, g, or t
  misc_feature (102)..(102): n is a, c, g, or t
  misc_feature (152)..(152): n is a, c, g, or t
  misc_feature (210)..(210): n is a, c, g, or t
caaatgcttctgccanagtgaaagaattttatgtctataatgcttttctttaaaaaaaaaaaaaaaagtcaacattgaactaggacatgcnctgcttccccncccccattttgctgactacattttaaaaaatctattggcggaaaacaagnttttttcttcaaatagggtgattttgttttattgccattttgtttagtatatattttnc

SEQ ID NO: 564872 - DNA, 320 bp, Homo sapiens
ctaggcggaaagctacgtgggtacggttagagcagagagctgcggggtagatctgcagaaagggcaaggtggtctgccacattccttcttcctaaagcactatgccatctaggtgaaacggggctgttctaggaggggtagtacttccggctttaacactaaccaacttgaaaatcacacggggaacaaaaccatgacagccaggaacacagcaccagaaggtgaaacccagcccagagtatgtagccgctgtaacttacagcattaataaaaggcttacagaaaaccaaaggcctattaaatatccctgctccacctag

SEQ ID NO: 564873 - DNA, 490 bp, Homo sapiens
  misc_feature (10)..(10): n is a, c, g, or t
  misc_feature (38)..(38): n is a, c, g, or t
  misc_feature (59)..(59): n is a, c, g, or t
  misc_feature (66)..(66): n is a, c, g, or t
  misc_feature (100)..(100): n is a, c, g, or t
gaataaatcngggggtggttttaaaatgggattggacnccatattaaattatggggatnatatttngaatatggctattaccaatatccgtggaccattngaaattccatttgtgtccactttggatttatcttctagttagaaaagattgcattttttttttttttttttgcatttaaaaattattccagacccagtacgggttgcacgcctgttattccaacactttgggaggccgaggctgacggatcacttgagatcaggagtttgagaccagccttgccaacatggtgaaaccctgtctctactaaaaatacaaaaattagctgggcatggtggcgcacacctgtaatcctagctacttgggaggctgaggtgggagagttgcttgaacccacaaggcagaggttgcagtgagccaagatagtgcaactgcgctttagcctgggtgacacagtgagactctgtctcaaaaaaaacctagaaacta

SEQ ID NO: 564874 - DNA, 848 bp, Homo sapiens
ttgaccttgaaactgtggttcatagcaatgaacttccgacttttcccaaccaaattcttaaatgtataaacatggcgtaaactataaaggaaaagtccacaaatgggtggatgtctatattaatcttcatcttctagaatagctgatcactctctcctcgtcatcatcttcatcattgtgaagcaagaccagctctctgagataggaaaagaatttcataaattcatgatggataaggcataaaagtttcccatcttgagaaagaatgaaaagaggcaaacgagatttttcttaaactcactacctcaggaatatgtgtaaaaggatgaatgattaatatttaatgaatgtctgctgtgtgctatgcagtagtaatgacttatgtgtgttatctcatataaacctcgtcacaattcagtgaggtaggtatactcattttgctaatgaaaacatcagaggtcaaatgatttgctaaaaaataattccagaggtaagtggcagactctgttttgaatcatgtcttttagcactaaaatccatccttctttcacttcccatgcttctttccttagagccctgcatgaattggcccatgcagcactattaaaatggaatcagtgactctgctgctccttggacaaggtcaaactttctttcacttgagggccttgcttttcacctaggtatcctacccagttactccctcacctccctgaagtggtcctgcctgacctccccattgaaaaaatatgacttctgtcattcacaatcctcttacttttacttttcatcataggcctgtattcctacgtgacactatatatctatagagtatttgctaattttga

SEQ ID NO: 564875 - DNA, 680 bp, Homo sapiens
  misc_feature (56)..(56): n is a, c, g, or t
  misc_feature (101)..(101): n is a, c, g, or t
  misc_feature (207)..(207): n is a, c, g, or t
  misc_feature (223)..(223): n is a, c, g, or t
  misc_feature (287)..(287): n is a, c, g, or t
  misc_feature (398)..(398): n is a, c, g, or t
  misc_feature (666)..(666): n is a, c, g, or t
caccacacaagccaaaccaagccttcaggcagcatcgggtatcggcttgtcaggcntgaccccagcacgggccctggctctggtggaaccctgcccttacnaagctttgatgccagcggaatctggtgctggggcagcccggtcagccccggggagcccttggcttggtgacctcgccgctcttcttgaatcatgctggcctgcccntgctcagcaccccgcntgggtgtgggcctggtctcagcagcggctgcggctgtggcagcctccatctccagcaagtctcntggcctctcctcctcatcctcttcatcctcatcctcctcctcctccacttgcagcgagacggcagcacagacccctggaggtccaggggggcccgaggcagggtccaaacntgagtgagggcaagccatgcctcccctcccattcctctggtccctgccttggtcccttgcctgggaagagggcgaggaggccagtggtggggacgcaaagggtcctcagagcaggagtgacaagggaggaaagcccaaaaaaccacccacccaaaaaaaaaaaaaaaaaaaggaaagaacctacccaccaaaagagaaacccaaaaataatcccaacagaaaccagctgccccaaaggacccagaggtgaaaaccaaccaaaaaaaanccaaaaccaaccca

SEQ ID NO: 564876 - DNA, 926 bp, Homo sapiens
gagactacgtacataacctaaactactccaatgctaaaactaatcgtcccgaacgaattatattactaccactgacatgactttccaaaagaacacataatttgaatcagcacaaccacccacagactaatgattagcatcatccctctactattgttttagagcacaaatcaacaaaaaactctatgtagctgttccccaagcttttcctccgagccccgtaacaagccccgcgtcctaatagtaagcgtacctgatctgccgctaccgcctgcacaaatcatgagggagtccagaagggccaacttatccagttgaaccacctatcacgaaaagaaaactctacactactctatatctaattctcacctagagaagtctccttaattataacattcacaggcagagaactaatcatatttcatatcctcttcgaaaccaacatttatcctcgcacctttggcgtatgcatcacaccgatgaggcaagcaggtcagaacgcctgaacgcacggcacatacattcacgtattctacaccctagtaggctccgcgttcccctagtcataggacttaatttagacatcgacaacacctcgtaggctcacatgaaacattcgtacgtacgtcactcgtcacgtgccaagaactatcagactcctgagccaacaacttaatatgacctagcttatagccaatagcttatgatacgtcaaagatacctctttagcggactccacttatgactccctaagagcccatgtcggaagccccatcgctgggtcatagtacttgccgcagttactcttgaaactagggggttttggtataatacgcttctaaatcattctcaaccctgacaaaacataggctacccttctgtctatccttgaaaccaaaaaaagggggcgctaagattcccagggg

SEQ ID NO: 564877 - DNA, 452 bp, Homo sapiens
  misc_feature (123)..(123): n is a, c, g, or t
aaacgaagccagcctggaccatagcactcgcggaggctgtgtatttgctcccgtggagcgtcagcggggtggtgcaggctggcaaacgtcgagctttcagctgtgctttgtgcaaagaggctnggcggaggcgagccagtggggagtagcaggacctgccaagaagatgtccttctaactgaaggtgcggttgaattcagtgggttcagaaccaagatgccgacatcggtgtggactacgggacagggggggttgtggcttgttgggtagaaatgaaggagaagccgcggagttcacatgaactgaggcatgtcatgtattttttccttgttcttcttggctggttctttgttctgtcccccatgctctgaggcggtgccctagaaggggaaggaagtaatgctctaacgtgataggcctgctcgagggcagtggaaataaagaagagggaa

SEQ ID NO: 564878 - DNA, 587 bp, Homo sapiens
ggtacctggtatctgtcaagaaatttgtccatttcgtccaggttttccagttttgttgagtatagccttttgtagaaggatctgatggtgttttggatttcttcaggatctgttgttatgtctcccttctcatttctgattttgttaattaggattttgtccctgtgccctttagtgagtgtagctaagggtttatctatcttgttgattttctcaaagaaccaactccttgtttggttaattctttgaatagttcttcttgtttccacttggttgatttcacccgtgagtttgattatttcatgccgtctactcctcttgggtgaatttgcttcctttttttctagagcttttagatgtgttgtcaagctgatagtatgtgctctctccggttttttcttgaaggcactcatagctatgagtttccctcttagaaatgctttcattgtgtcccaaaggtttgggcacgttgaggcttcattttcattaaactctaaaaagtatttaatttatttctttattcattcttagaccgaggtatcattaaacagagtgttgatcagtttcaatgtaaatgctgtcgacgc

SEQ ID NO: 564879 - DNA, 791 bp, Homo sapiens
ggatctatgtggtcaccgccgaggggcttcggcctgtcaaagaggtgtgcatgtactggtaagattgcggtcatggatgcttctcatggcccaagggaggatgagcaaggacctgctgtttatcttgatcagctgagagtacaactgcctgcatcctggagtataaacagagtggcgagagcattgacatcattacgcgagtcccatggctatgtccaggaccgcacttggccgcccctcagagaccggcattattggcatcattgatccctgagtgccggatgattggcctgcgtctctatgatggccttttcaatggttagttccactagatcgcgataataagagaactcaagtgccttcactcatccgcctggcaggagctgcatgtcatctgatgtcaagttcctatatggttgccatagtcacctactatttgcttagtctaccaggaccctcaggggcggcacgtataaacctatgaggtgtctctccgagcacaaacggaattctataagggcccttggaacaatgcgtaaaatgtcgaagctgacgcttccatggtgatcgcagtgccatagccctttgggggggccatcatcattggacaggagtcaatcacctatcacaatggtgactaaataccttggctattgcccctcctaatcatcgaatgcatagcacgatcgctgtgccacaatcgactggaacctaatggctcacgatacctgctgggaacacatggaagtgccggctctccatgcctgcttgcgcacgacaggacgcggaag

SEQ ID NO: 564880 - DNA, 110 bp, Homo sapiens
gtcatctctctcctccacaccagataggaatacaggttctagtcctctgtgggaggagagagatgacatttggttgggagaaggctggagccaagttatggtgttcaggc

SEQ ID NO: 564881 - DNA, 175 bp, Homo sapiens
tttgtgagccaataaagtccctttctgtgtaagataatgaatgagtttctgttctgattaatataggttattgtattttcttatgattgtagaaaaccttgtaattttaaattctagactttatgcactatataagtttaataaaattagcatgggcctttccatggaaaaaaaa

SEQ ID NO: 564882 - DNA, 529 bp, Homo sapiens
ttcatgcgtctcatacctccaaccccattgtcttgacagaatatccttaccatccatgtcacagagaaagtggaagctcataggaagaaacacctgcagccttcctgccggtctcatctgcatgttcgtacctcccacccccattcattctgtatctttcctattacatgtggaagactatgagtgattccatcttgtcagaagctaatcttctactagccatagtctgctcatgtgtggaaaagaaacattaagagacaggaagaggcttttggacattaaaaatgggattatggagataaaaattcaacacaagggtcaaaagataaagttgaggacatttcccagtaggcagaataaaaagaaaaagagaggccgggcctggtggctcatgcctgtaatcccagcactttgggaggccaaggcaggcagatcacgaggtcaggagtctgagaccagactgaccaacgtggtgaaaccccgtctctaccaaaaatacaaaaattagccagacatggtggtgcgcttc

SEQ ID NO: 564883 - DNA, 410 bp, Homo sapiens
cattagaattaatgcactcttacatataagaaattatatatacatccttaaatctcagcttaccaaaatagaatagctataatttaacagcctaagctatagtaaacctgacaaatactgaaacttagagacacattaatgctgcaaaatatgtaatatcacctcaacatatctcactgcttatgctcataactaagtgtgattacatggagagagaaagttttgtaccagtaacacatgatttagagtaaaaaatcatatcagaagcatggcaatcatttaactataccttataaaaataagtggctaaatcaatgagaaacaccccaggggtttttggcttataattagaaaataagtattatcttcattaatagttcataaacaaaactcaccaacctaaaagtaaa

SEQ ID NO: 564884 - DNA, 352 bp, Homo sapiens
gtgaattcatatttagaatatgaattctaaaagtaaattgttgagttatttaacatgtaagaaggagaaatttcaaatgttgtcattgttttttttcctcccatagaccagggctagtgagatgtttcttgattcattcttcagtatcattaaggaatattgattgtggaagctaagtttagtaattttactatttaagtatgcattatcgtcttgtcctctatataaaactgtacaggcataatgatgataatgataggagctaacacttattgaggatcaccaagtactaatcattgtattcagtgctttatgtgttttattttctccctactatcctgcaaaataaagt

SEQ ID NO: 564885 - DNA, 774 bp, Homo sapiens
gtagaatttctctaccagaacaaaataatagctttaacaaatataagataaaaagccattcatagtctggcacgatggctcatgcctgtaatcctagcacttaggagaggcgcgagtcgggcagatcacctgaggccaggagttcgagaccagactggtcaaaatggtgaaaccccgtctctactaaaattacaaaaattagctagtcatggtggtacatgcctgtaatcctagctacacgggaggctgaggcacgagaatcacttgaacccaggaggtggaggttgcagtgagctgagattgcgccactgcactccagcctgggtgacagagcaagactcctcctccaaaaaaacaaaacaaacaaaaaggcctttcaccacagtccgcaatgtacaaagacctctatgaagaacatcctaaagtttttacaagaatttacaagaaaattctgcttaaagtggaggcatgcacaggatatgggtgaagggtgacagcttcacgcacaaattggatccattaacatttcacaggaaattaccaagtaaaaatcttacacatcattgttaaaagaactcgtgtttagtgagttggaagcgtgtcttccctcaaatttcatggcatggaagtccaaaaccctaaatattgcggggagtgggatgaatttgggaaataggaccttaaagaggtgacgtaaggttaaatgaggtgacggtgagatagaggtcgattaacaagaagcaattcaggaccccagaacacattgggggatgg

SEQ ID NO: 564886 - DNA, 621 bp, Homo sapiens
agctgggcgcggattctgcctgaggcacctgaggcactcagagtgagtgctgccatgtcatgaaccggctgggtgatgtctgtcagaacccatgcggcagcaaggcctgcctgcgcctcttcgtgcccagtgtgacagctgagcagctgagcctgcgactgtgatgctgctaatgtgctgtggctgcatccagtgaggccctgtgagctgatgtgaacttcgactttgtcaccgagacaccactggagggtgacttcgcctgggagctgtgtgctggtggccttgggccttgcccaagctctaccttcccactgggggcccctggctgagtgcctgggattgatgtttggtgctgtgatgtgcatgtgctggacttgtggcacctcaccttgctctgcttgcatgtggtgacatgcatgacgtgaatgacccatgttgtgaccttgtcacattgtctttgtaccctatgtgcgctcgcatcagtggtgagcatgtgcttgaacgtggtccccagtgtgtgaccctgggagactcctcaggggtccgaaaaacagcggtggcaagaccatgcaattgaccagacatttctaaccactccaaacagccgggcatgatcattct

SEQ ID NO: 564887 - DNA, 537 bp, Homo sapiens
  misc_feature (405)..(405): n is a, c, g, or t
ttgagactgttccctgggaaattgactctgaggtggagacttgcatgtagggagttatcaggagtgctctcagggatgatactcacgagagagtgaaggaagcaggactgggcaaagggaaaagatggacattgggcatgtacaggagagggctacccagatcccttggggcgttctggagctctgatagtcattcacagttgtttaacattgtggcaaacgatctggacagacattagttaagagttacctctggagagtagacatgaccttggactaggaagttctctttggcagagagcaattttcatggaaggctcagctgtgtgaggttagcgcccaatttcctgccggctgcgttccctggtaccccgggggttccccccccccttcggcgcccgccgncccccgctggtggaaatacgacattgtaccattgaacaaccccaggagtatccatgagcccagtttcattgaggtcatgtccatagtgatgtgaaattgctcatgggagctatgaatgtggcctagagatat

SEQ ID NO: 564888 - DNA, 488 bp, Homo sapiens
agccactccttgggtgaacctgccaccttggatcgtagcattggaccctgtgtcctcgtcttggcacgggctcctcagtaggcgagtatccggagcctgcagtcggaaaggtcgcctccgcttacccgaggtccaggtgcgtcgcacatgtgcgtctgcgcagcctaagtggcaacgccggccaggaacccgaagagttcgttctgggtgtccccaagataggtacgtgtccccatcgtgtcccttgagaggtcttctccaacccggcttcgtgcccctcgcagaccgctagccacaccctgggggtactccctatctacacattcaccacctcgggttggccgggcccccctatcgcgaatgcccaacggcccttcatcatcttgtccctcgtccccctaccccaactccccctcctagcccccgccctttacaacaccagtctggaatttaataatttcacataatgggtgtttaacttaactcca

SEQ ID NO: 564889 - DNA, 893 bp, Homo sapiens
atctggtctagccatgtgcaagtggtagcttggactcacaaggcccacctacttcatgtgagatgtcatcaactggtactacgatcagagggttacggcctgagttgaaaggagatagacctgggagtcattattcgaaagttaaaccattcaccacgatgtacacgtctagcacgtacgaacatgctctggcggtagtgaaagcatgaagtgtatctgatgggcttgtactgaccgattgttcccaccgagatctggaatgcaccgttagtgtcagcgtacgtatgaattacactatagacacacttgcagctgatgtagctcatgaggcatgtaacttgaccacgctctcctgagtgctcttccgcttgtagctggatggaatagcctagattgtgtggtgcaaccaaaagaaaggagagcgcataatcgagtatgactcactacacatctacgtacatgttcatgaggtcgtggaacaaacagtagtcggggcgatcgggacacaggtgatgaactctgactcccaatcatcgtgggtaatgcgacggattcctatgagggtaagcgacatcgtacccagcatacactaggtatcaatgactcgcttacgttatttcccaagtcaaatatggaccattaatggttacaaccaagcggctctcctttacggttacgtgactgatagaaatgttggcagcttttagtaaaagcatttactctgttaccatgagaaaaggttgggtgtcttctgtttggtcatagttttacatccttgattttaccagaaatggattatttgattttttggaagtttgagactttaacaacaaatggatcttaacttggaaatgggatggttggtgggaatacttggaaatgggggtattatg

SEQ ID NO: 564890 - DNA, 184 bp, Homo sapiens
  misc_feature (128)..(128): n is a, c, g, or t
gactacgatcctttagccaaaagcacagggagctctgggatataatggagctgtgattatgggcgtgcggaggccaggctgtttcctcctggttcggaagagggacagctcgcgggattctggtctcnctgaaaagcatgttggaccagctgggcgtccccttctaattgccaggtggcgtaca

SEQ ID NO: 564891 - DNA, 1240 bp, Homo sapiens
  misc_feature (505)..(505): n is a, c, g, or t
  misc_feature (1240)..(1240): n is a, c, g, or t
actgcgccgtggattgctgctgcagtgttgtgagttggaagctggtggatgctctggcatgtgcgtgtcccctgctgcatgccatggtggcccatcgtgggtttgggccaggagcgtgcccccgtggtctgattggcccctgtgtctgctcaggtgagcagctgtggccgtcgctgctacggtgctttggcgattgcaggtgaggcttgtctcctgggggccatgcagcaatgactggcgccgagttcccttgtgctgcacatgctggcccaaggggttgcatctcgtgtgtgccttggatgttttgcagacgtggtgcctgtccgccttaggcgctcggggggtccctttcgtaccaaagacctgggccaagacggatcatcacgtttgcatggtgacgcacatgcgcacccgggattggcgtcacaaagtcgacaagaacccaagtttattcgggcgggaccatttgggggactcagcgtgttgcgaccagggctttatagtncgcgcggaattccaacggttaactccccttgaacccgttaatattggctcaccggggtggtcttggcgcaggattacaaagcagcgatttccgcgcaattcctcgcggcggattcgttcgcaggcgaaccttaacctacaagacttggctatttttgcgccaactttggtcgaagaccagctttaagacacgtgggcgcacgcgaacaccactttacacttaatttccttgcggcctggtaaaggtttcccgtttgatttgtgggtgcacagacaaacccataatttgtggccttggtcatggcgccacacaccaaagaggggccattgcacttgatggcgatggaaccccgatctataactttggacgtgtgccccaaagtgaacacgcacgccgtgtctcccaaagagttcccggaaaggcaaagtgcaggtttcacacagtttccgggagggtgcaccacgtggaaagacatctcttccatttggggagacacaacgtgtgggcccacatatacaagtatttggtatcatatccacgtggagacaaaatttcggcaacaatgcgggtctggagatccccacacagttcccagcaaaggattaaccccaagaaaactttgggaagagcgctttagtggtggtacgagtgacccaatatacaaagaggcgcgacagatactttttccacagaagtggagaagtctgtgtatatccacacggtttagagtacccn

SEQ ID NO: 564892 - DNA, 901 bp, Homo sapiens
ttaacggggcaaggtcgtatccgggactgcgacatacaccaatgccattgcagcccacacggtcgttgtacaatgacgccctctgtccctctacagtctgtgcgcagtacgcttatcatcaacggcgaacgttctttccaaggctttgcgggcctcccatgaagaagcattgtgttgaaggagtccacgactttcgggtacaaaagtgtactccggcatggacacgacggctgtggaccccccccacttcgagaacgtggagtacccttacagccttcaggacaatggtgatgcccattgcccacgagttctcacctgatgtggtcctagtgctccgccgggtttgatgccgtgttgaacggacatctgtctcctctgggtggctactctcgtcaccgccagatgttttggccacttgaccaggcagctgatgaccctggcaaggggccgggtggtgactggccctggagggagcgccatgacttgagccgccatctgtgatgccttctgaggcttgtgttctcggcttctgctcagtgtagaactgcagcccttggatgaaggcaagttcttgcacgcttaaagcccactatcaacgcagtggccatcgctagatgataacttcattcgagatcccagagcaaaacactggaactgtgtgcagaagttgccgctggttgggccggtccctgcgagaggcccaagcaggtgagaccgacgaggctcgagactgtgagcgccatggccttgctggtcggtggggaccgaccaggccatggtgcggcagcccgggtacacagcctacaggccggcagaggagcccatgagcaggagcctgcctgtacgcgcggcatcccatccctctggcttacatgtgagtaagtcttgttataaacattac

SEQ ID NO: 564893 - DNA, 822 bp, Homo sapiens
  misc_feature (392)..(392): n is a, c, g, or t
tgctgaaccactgtacgtgctcttccgggccatccagtaccaggttgacaaaggccccgtggactgccgtgacaggcaaggcaaagcggaccctgaatgatagccgcgttgctgcgtggacgacgtggagttccagcccctgacgtctgtagtggtgctaggtgtgtgggccctggggactgagccggggccggccgaggcatcgagcggatgatgcatgcgctgtgccatgcccggggtgctcgaccacggacgaaccagtcacctccatggtcaaaggatcaaggtgttggagccaggtctacaaagggcacccccattctcccagatgcccctcaagtgcatgcccatagaccattgtagtggctgctcaggtcctggctgagtcaccntgaccctatcggacgacatgacttgaccctcgcgtgaccctagaaatccactggatacgaggacttcgaaacatcgcttgcaaagcaactacaacggtacccaggattgtgatggcaacatgtggcggctcgtcacgcttcaagacttgcaccgttgtgacaggcaatccatactcccagagtcctgtgccaccgataagattgccccgttggcgaagaagaacatacccacgcctgggagggattggcggacgtgacgtgcgagggggttgttgcctcctggcatccttggttgaataaagccacctgagcgaggcccagaagggggccgaatggtgcgggtgccaaccagcctgccggggaagctgcgagccccacgcaatgggccaaggccattccggaaatctaacctcaacccgttctgtgtcca

SEQ ID NO: 564894 - DNA, 187 bp, Homo sapiens
gacactgtactgtctcagtctcacaccatgatatacaaaagaagttgtaagctgtcgctctgaatggtggcatgtttttgtcagatttgttgaagattaaatggtttaggtgtgtggtgttgtttctgaggtccctgttctgttccattggtctatatgtctgttctggtaccagtacagtgatcga

SEQ ID NO: 564895 - DNA, 321 bp, Homo sapiens
tcaatggaaattagatatgacacaaaaagcacaagcgatcaaagaaaaacactagataaaccagacttcatctagattaaaaacttgggctgggcgcggtggctcactgtaatcccagcactttgggaggccaaggtaggaggatcgcttgagaccaggagtacaagaccagcttgggcaaaccatagcaagacctctgtcactacaacaaaaaactaatttaaaaacttagccagcggatggtgtcacactgccatgttagccccaacttggccagggcttgaagctggacggaactgccttgacgcccaagcgagcttt

SEQ ID NO: 564896 - DNA, 186 bp, Homo sapiens
tgtgtgacaaatactattgtgttgtatgtcagtgtacatgcagatgtatattgcagttttgaagtgatcattactgtggaatgctaaaatacattatttctaaacctgtgatgccctaagagcattaagatgaaggtgttgtactaatagagactaagtacagaaatttcagttttaggtggttgt

SEQ ID NO: 564897 - DNA, 305 bp, Homo sapiens
  misc_feature (5)..(5): n is a, c, g, or t
ggtgnccaggtttgggtttaaaaaaacccccaaaagggtccccttttccaggggttttaggccgacagggttttcaacgggttcctcatttttccatttgcctgagccagggaagggcccccccccccccccccctttttgggttccatgctccccctgtaaaatgggggggcttttgcttccccttcttaagggagggggctggcttttaaagcccccgggctgggtgccccctgacccctgctttaaaaagctcgttttttagaccccttcctggaataaacctctgggtttgggtttgctga

SEQ ID NO: 564898 - DNA, 760 bp, Homo sapiens
ggtaactgcgtctcccaagcgcaaggactgctgcaaagagccacaggctgttgaagacaactggctagagtattcgtgacggacactgacttggtcctctttgtgatgaataacgtgtaccgctttggcacagataagataatagccaatgtccactataacggcaagatcgcgcgtgtgtattctcctgccggtgtctggctttatggtggccatgacgacaagtatcactgatgggtccttaatgggggaagatggatttgtgctgtgctctgttggccataggtccgaaggtgagtattgccgggtgctagctagagcaatggccttgctctgctgtatactgcacacgcacgggcagccttgagtgctagatcattgatgacgtggaatctgctggcggagactgaatacatgagccataatatataaatctttgatcgccgaagatctatcactattgacgcgttcctttctgagcttcagactcctatgagttcctgggtgaatcgtacatccgatgacttgctgatattaggtccagatgatgttgtggaccccttgatgtaacggccagagttggtaaaaatcgaaaaacgtaccattgtgacaatttttggtatgtaactgtgtgtcttgggtggatcctgttgaaatgccccggaaccggtctggtacaattggatgggtgcatactctttaagcttggagacccgatgatcccaagtgatggattttaccattcacggagggcggtacc

SEQ ID NO: 564899 - DNA, 165 bp, Homo sapiens
ctcagtagactgagagattatactcaaaccacatcatcgcggaccccccaaaaaactatttttgactcacagaagccataatcacttgaagagaggtagcctcagcagttaccttgaaggactgatggcaagaactataccttcaaatgctcatacaggacgaca

SEQ ID NO: 564900 - DNA, 345 bp, Homo sapiens
aaaaacaattttttcccccttggggaaaaaaagggggggaaaaaaaaaaataaaaatcccaaaaaaaacctgcggtatccccccaccccttctttttttttaaaaaaaaaggcccggccctgcccggcctttttcccccttaaaacccaagggccggttccgtcccaaccccaacccctttatggggcccaaagaaaatttaggctttgggcaaaaaccccccccccagggggggggggggggcccctctggcaaaagacaacctttcttgcctgggcccccccccccctgggggtccccgaggaacccccaccccccgggtttaccggaaccccaagggggccc

SEQ ID NO: 564901 - DNA, 385 bp, Homo sapiens
tttttccttttgagacacagtctcactcttgcccaggctggagtgcagtggtgcgatctctgctcactgcaacctccatctccagggttcaagcgattctcgcgcctcagcctcccaagtagctgggattactggcacacgccaccatgcctggctaatttttgtatttttagtaaaggcagggtttcaccatgttggccaggctggtctcaaactcccgacctcaagagatccacctgcctcagcctcccaaagtgctggtgagccaccatacccagcctaaactggtttttgtttttttttttctgagacagagtctcgctctgttgccaaggctggagtgcagtggtgcgaatcttggctcactgcaacctccgcctcccgg

SEQ ID NO: 564902 - DNA, 2782 bp, Homo sapiens
tgattgttcattattttgcaaagtctccatggctaaggacccccttgtcaccctttctgtcctgcccttatttatttctaaggcagcagacctgaggtttcttttccagcagaaatcgggtaaacctcaggtctgtttgaaatgcttgttccccagtgccataaagaaatagcacttgaacattaatttcctcagcaaggccatttttttttactttctgcagaaagggtacactctccagcagttttgccaggagagtacagcgaacaaaggggacagggtcatttatcacttgatgcgtccgccctactgctgtgtccagtttccagggctggaatgggacctcacattctgtatttgtcccgattggccagcaccttggaactatttaaaagaggcaaaggcagaggagaacaaaggaaggaggaagtaacttgtggaatgctgagaaaggaaaaagcacttttagataaagaagaggaacaggctgtgacgtaatgcttgcttggaccagtataagcatgccagggctgatacttaggttaaattgtgggagctaagagcataaagtacattgatttctttatcacggctagcagatatttaggaatgttagcacaagtctttgaatgaagtttgcttctcagagaagttactatttattcctaattagatggggaggaaagtctttgaacaggaacctttattttttacaggcccgatgtcagattttggcatgtggctttctgctacccatggctgcgtgatgagacagtggctggaggcagaactgagcccctggaggtgttaatgggggagtcacttgtcctcatgcaagcattcaaacatgccttttgcacaacggcaaggcacatctcagaacatgtcagctgcaggctgcgatttcccgggtacgagctttccaagctctgtgatccactctgtctttggttacatgaaggtgggaaaattgctcagttgctaagatcacagtgttggggctcagaaaacaatcccctaaatttttcagaggcattagaaccagagcaactctgccatcttgaataggggctgcgtaacatgaggctgagacctgcttgggctgccttctctggaggtggatgaggcattctaagtcacaggatgacagaggaggtcagcacaagacacaggtcacaaaggccctgctgataaaccaggttgtggtaaagccagccaaatcccaccgaaaccaagatggtgacgactgacctctggtcatcctccctggtcatgatacgctaattctaatgcattagctgataagagacggtttacagatgccatgacatggtctaaaagggggatgaaccttcagctccgggaattggtcacccctgtcccagaaaactcatgagtaatccacccgttgtttagcatatgatagagaaataaccataaaaataggccaccagcggctctcgggatgctccatctatggagtacacattctttattcttctactttcataataaacttgctttcactttactctatggacccactcggagttctttctcacgagatccaagaaccctttcaaacccctgaaaggatcaggtgatccgcccacctctgcctcccagagttctgctgggattacagatgtgagccattgcactccagcctgggtgaaaagagtgaaactccgtctcaaaaaaaaaaaaaaagaaagaagaaaaaccttgcaggatctgtccagggtccctggggagaatctgtgtgacatacatatctctgtgatgtttcatatcatctgagggcatggttgtatgtcactctgaaacctctatcctctgtctcatcagaacacatggactcgattccaaattcacggccagtaacctgggcgaccagtcggtaccagaagaaaaactaggaggttgattggtttgtttttgagatggggtctcgccctgtcacccaggctggagtgcagtggtacaatcacagctcacagcagcctcgacctgctggactgaagcgatcaccccacctccacctcccgagtagctgggactacacgaatgcaccagcatgcctggctaattttgtaaaattttttggtagagccgaggtcttgctatgttgtccagccgggtctccagttcctagccccagcgatcctcctgctgtggcctccccaagtgttgggattatgatttgtgcattacaaagatgagaggtttgatttgtcctgtatacaaatgcatcaggccattcttcatgctgagacatgcagatggtctcagcctccgtaggagagtagcttagtatttcagagggcatgtgtgctcttcagacctctaggaagctcctcgcagcttcatcagtgaaactcagtaccccctacaatgtatacccctcctagggagcaaatgaacgtggctattacctctcttcccaccccagttgtctcaagatcaatgggtgttacaaaaaagagctatcggctgggagtggtggctcatgcctgtaatcccaacactttgggaggctgagggggaggatcatgtgaggttaggagttcaagaccagcctgaccaacatggagaaacccagtctctgctaagaatacagaaattagccaggcgtggtggcagtcacctgtaatcccagctactcgggaggctgaggcgggagaatcgcttgaacccgggggcggaaattgtggtgagcccagatcatgccactgcactccagcctggacgacaagagcgaaactccatctcaaaaaaaaaa

SEQ ID NO: 564903 - DNA, 805 bp, Homo sapiens
ctctactaaaaatgcagaaattagctgggcatggtggagggcgcctgtggtcccagctgcttgggaggctgaggcaggagaatcacttgaactcagtggagactgcagtgacccagattgcaccactgcactccggcctgggcaacaggacaagactccatcaccaaaaaaaaaaaaaatactccgagaccagtatctctgggtcacgccaagggccaagcaattaaccaattcttctcttagatcactttttttctcgggatggggtgtatgggagattggtgggagtcagggtgaaagatttgggaataacaagggttagaaaccctaggaacagggtgacggccaaagggaatggggtttaaggggagaggggagaatcaagaagacagggagtcaccaaaagggccacagggatccggtgggtccaattggtcagcaaacaagtctctggtgttacctggcactggtgggatgggactcgtcccctgggaaatgggacactcactctaggctcctacccggggccatgggacccacccagaataatttcatagattccacaaaggccctggggggatagcagcagagtaggtggggagggtctaccaaccccttccccagctggtggcaaactctatttccacagaactcagaggctctcccggtcacctgcatcctcaaatacgccttcttgtccagtctaatctcagcccatcgcctccgttggaggactgggggccgtgtgcaaggcctctgtggtcccagtttggtcccgtgagttgtggcaggtggtctgggggcc

SEQ ID NO: 564904 - DNA, 100 bp, Homo sapiens
tgaatggaaatgtcaaatttcctgaattgctatgtgtcttgggtttcatccatccgacattgaagtttgacttacttgatgggagaagatgcggggtacc

SEQ ID NO: 564905 - DNA, 539 bp, Homo sapiens
gggcatctcatgctggggggaagggactgaatacctttgttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctccctgctctccttcccagcattgagccttggttgcctgggcccaggctggggttttcagtatttgtaagcatttcagcagaacaataaagcctttggactacgaaaaaaa

SEQ ID NO: 564906 - DNA, 151 bp, Homo sapiens
atgccaatggtctcacactggtttctcgtgcccaccagcttgcgatggagggataccattagtgtcatgatcgccatgtggttaccatttccagtgcacccggttactcttatcgttgtgggaccaggctgctatcatggaattagataca

SEQ ID NO: 564907 - DNA, 504 bp, Homo sapiens
  misc_feature (60)..(60): n is a, c, g, or t
  misc_feature (89)..(89): n is a, c, g, or t
tctgtgtgtgatgggcattagttgctctgtttcagaggagaaatggagagctttggctanataagataatatgttaagtggagttcctntgagagacgttacatagtatttcactaagtgctgtatatataaagttaagaattacagtaaggggacttaaataaacaggaagccttcatgaaatagctaaattttgagatggatcttgaaagatgattagaatgtataatttgaggaaagggagcattctcaggaaaggaatgaacctactcacctacagccacaggttggtgttgggaaggagaggaaatttaaggtgtggtttaatagaataagcattaaattgtaagtctaaaggcctagttgcattcctacaaacctttttgacattttatttaggagataaataatgagggagaaaaagagtattctagtcgggagtgtaaggaaaaaatatgggaaagctacccacctcaaagaattaacatggaagcccagtgagag

SEQ ID NO: 564908 - DNA, 478 bp, Homo sapiens
ttttttttttttgcctcctagtaagtgggtgggtgtaatgactaggccatcttgcaaccatgaggaaaaaggcaagaaattttagaatcctcaccactgacaactagccagcaaccacctactattgacttattatgtgacagaaaaaaaaaattaccaacagggtcaaggtctaaaagccagttgataactggctattctgttacatgcagctcttctgttacattcattactgatgcattgctcctcaacacatatgtgaaataatacaaaacaaggacaaaatacacagcaaacagccacagaggctgactcataatgcactacacacacacacccacaaccactcacacacacccacaccccaccttctttcgtgatagtccagcttctaaaagagccaaatagaaaaatatcacctacactatataagggcaagagaaggacgtcgacgcggccgcgaatttagtagtagtag

SEQ ID NO: 564909 - DNA, 788 bp, Homo sapiens
gcagttgattcctaggggtggttttcatcctgttaccacttaagcacattaatcatttggttagaaaaataataggcccagtgcagtggctcatgcctgtaatctgcaggcatgtttgggaggccgaggtgggatggatcagctgaagtcaggagtttgagagcaggttggccaacatggtgaaagtctgtctctactaagaattaaataagtacaaaataattaaacaggcgtggtggtgagcgcctgtaatcctagggtatattgggaggctgaggcatggagaatctgttgaaacgcaggaggtgaggtaggttgcaagtgaggctgagattgaagcgcattgaattcagacaacctgggcatataagagagatgactcgcgtccttcgaaaagtacagataatggaagaacgaataataaagacatcatataatggaaagttgggaagtagaaccttagagggaaaaagtttactcgataggtttctaaaccgagataagtgtttatcatttcaagctggatattttactttacaggttgttaagaatgtcgtgagcttagggggatatttagacaagatattatactggaattcaactttggttcagaatttattacgagagtcttgtacataattattgtggatgggcacattatctggtgagtgggtatatcatagttaactgtagagaggaggctatcaataatttgtcatatgttgatgggtcattcatgggaagtagaggtaaatatcttagaatattaagttaagtagttaaaaatg

SEQ ID NO: 564910 - DNA, 498 bp, Homo sapiens
gggaccggagatgactatgtcatgaattactcactttagatagtggatatggcaggagagagctggcagtcatttcagtgtctcttgacactatcagtctgctctcagtacctcccagcctcctggatacatggagttgcactatctggtacttacaaatgaagccgattgtcaatcgtagatactgggacctgaatgtaagcaagccattcagcctgccttcaggctgataatttccctggccactgaaagagatttgggagcaatactgcaggacctagtaagtctttcctcgaccctggcactggaaccatggatgccagtcttggcacctttcagaacaagagcctagaagtacttctaggctgttcttacctagtggtgtactggatccacctatgggcactggtttttgaattctcagaaattccataagccaattattaacatagtcttaattgaaggagaaattcagtgacatagtcactgaggactcca

SEQ ID NO: 564911 - DNA, 1194 bp, Homo sapiens
atcagaggatggtggtgctaggctgctgatgcggggaccgctgatcttccctcccatacaggcctttcatcacctccttctagggcctatggcagttcgtcccaggatgtgtggcgagagcctgggccagtcccacaagcgttgcctagatcaggcagacagaccgtagggtcctcatcttggtcccgttcacaatcgtggaaccgcgtggcatggctcggtctgccagctacatttctcgttctccgagctgctgttttgtcataaagaaaaagacagcatgaagccctaaactagtgagagtaatatctaattatctcatttttgtaggtctgtgataaagaacttagtcatcccttccacctcctactgtgaagaacagagcctgggtcccacactgaaatcccctctagtcacccattcccaccccccagggagctgcctcccacagcaggggggtgcagaaaatgatgatgggctggggaaccctggagagcctcgactccggaagtctcaaggtgcctcctcctctccttagctggcccgttggtttttctgagcagggggctgaactgtgaacaagtcagacaaataaagcaagggtctgcaccgaaaaaaagaagacaaaaaaaagagaaaacatctaacacagcgagagaaagggagaaaacggacaaaacgagacagacaaaacacaaccaacacccaacagaagccaaccacgaaaaaagaggggcgggaggacgcactacaaacagccacatcccgggcgggcccagccaagaggacccgtcgccgcccagagaagacaaacgagggaacacaccacagacgagcgagataataacacacagggaacgaacgccgcgcgcgcggctcgcacccaccacacgaacggagacgaccgggacgacagaacaggcgacgtgcgcgacgcacgacactaggacagaagcacgcccacaccaccaccatcgtcgggggagggcaaaacaaacagaagaagggcaggaaagacgaccaaagaagaagacacaagagagccagacgcacacacgaacaccaaatgaacacatgacaatggaaaggagagagaacgagaagcggagcgcacacacacgaagatgacatcgagatcagggaggaaaacgagagggagcagagtcgtggggcggcgagacagagaatccaacg

SEQ ID NO: 564912 - DNA, 169 bp, Homo sapiens
  misc_feature (66)..(66): n is a, c, g, or t
  misc_feature (137)..(137): n is a, c, g, or t
  misc_feature (153)..(153): n is a, c, g, or t
aggttttttcaaggatatctgttgaattcactgcacatctgatctggcttccatgtcagggtaatntgttgctgttatgttgctaggtctgaaatgcagggatcaggacagtatatgtaattgagcaaccacttganagaatcaagtggcctncaaaaccaaacttttt

SEQ ID NO: 564913 - DNA, 102 bp, Homo sapiens
tattcacctacttacggggcttgggatttgcgggggggcttgtgtgtttcgttggcttgtttgccatgaaggtagatatgcgcgggcgcagtgatgctttga

SEQ ID NO: 564914 - DNA, 191 bp, Homo sapiens
ccgccatcagcttctcgagtagcttggattaggggtgcccaccaccatgcctggctaatttttgtatttttaagtgagactagggttcaccactgttggcctagggtgagtctttgatactcctgctcctcgtgtgtgatccacccactctcatgcctcccacaagtgatgaggattaccagccagtgagc

SEQ ID NO: 564915 - DNA, 141 bp, Homo sapiens
cgtccgaccctacagcgtcgggactggtagaagcactccaggggcacagtgatgctggccagagagagctcatctttctttttcttccgcgtttactcttcttcgtttctcctccattttccccctctaccccatgcttgt

SEQ ID NO: 564916 - DNA, 649 bp, Homo sapiens
gttctcgatggaccgagctctgaactgcgtggatgatactgtctgtgcgatgccttactggcagactaggacattcgagagcccagtagcaaccgaaccagtgtgccaggagacagtggagcagtgacgaaccacaatgtgctacttctcagcagagcttccatacagagagaccatcccttcttgagacacaccaggttagtaccacacaagacaccaagaagccaagacgcatacttgccctgcgaagcctccaaaatagcacggaattcatcaaaggtaggaatcaactccaattgttggacaaccgagatacaatcacgaccggaatgaagcagacagctaaccactgacttagcaattgaagtgacgtgcgcacagagcacacgcttccacagcaactcgggccccgtacagcacatacacattgacctatcgcacagacccccggtaactgcgagtattaacatacataagatagctttgtatctgcaccacgtgttcacggcacatgtccaccctgagacaaccataaaagttatacatcggtgtaaaacatgctatcgaacagaatgtaggacacccccctaaccccatgttcataacccattgcactgtttgataccacacgactgatcaaaacaatgat

SEQ ID NO: 564917 - DNA, 213 bp, Homo sapiens
cctctgagatggagttttgctctgtcgccaggctggagtccagtggaacaattctcggctcactgcaacctccgcctcctgggttcaagccattctcctgcctcagcctcctgagtagttaggagtacaggcacacaccaccatgcctagctaaatttattatgtagtatcaaccgccaagctcggtggctagcgcctgttatcccagcgggt

SEQ ID NO: 564918 - DNA, 278 bp, Homo sapiens
  misc_feature (187)..(187): n is a, c, g, or t
tttaacccctttttaggggggggggaatttttttaaaccagacccctttcccaaaggggttttttagggattaaccccattttaattttttacccgtggggggcccatgtttttatagtcaatgtaaaaaacccctaatgggtttttgggaaatccccggggggctttttccaacttagcaaatttnttttgttggccaaataaggttcccaattccctttctaatttttgggataattttcttttggtttcccataaaggggcccaaaagccccaca

SEQ ID NO: 564919 - DNA, 658 bp, Homo sapiens
tgtgatgcgtggtgcgttccctgataaatggcaccttgtggtgcttccctgccgcatcctctcccctcagtgaatgtgggacttgacctggtgcttgtgtgtggaatgtggactgtcagcaatggtggctctgaccctcccagtgtgactctgccaagcagctgtgtgcccccagtggctaccctacacaactgccctccccagtgcccccctaagctgctctcccttggaacctgcacagctctctgaaatggggcatttatgtttgggaccagtgacccctggcatggggaccacaccctggagccctggtgctggtggacctcctggacaccctgtccttcactcctttgccccaggacccaggctcatgctctgaactctggctgagagtgatgctgctcaggagccagcacaggacaccccccaccccaccccaacattgtccccattacaccatgagtggccatctgtgactgtagacaaggatgccagtgggccttggccagagactccacccaattgctggtggagcatcccttggacttgggtggcacacctgctgacactaccctctgtgtggtcaagggcaagagtggctgggagcctggggactgtgttgtctgagcacacgaaggacttgggatgtcgtccgact

SEQ ID NO: 564920 - DNA, 175 bp, Homo sapiens
  misc_feature (59)..(59): n is a, c, g, or t
  misc_feature (104)..(104): n is a, c, g, or t
  misc_feature (116)..(116): n is a, c, g, or t
  misc_feature (149)..(149): n is a, c, g, or t
tctcaacaccaccaagcttagtgaagaactgttctaccagatactcatttatgattttnccaattttggtgttctcaggttatcggagccagcaccgctctttnaccttgccatgnttgccttagatagtccagagagtggctggacanaggaagatggtcccaaagaaggactt

SEQ ID NO: 564921 - DNA, 244 bp, Homo sapiens
  misc_feature (41)..(41): n is a, c, g, or t
  misc_feature (43)..(43): n is a, c, g, or t
  misc_feature (160)..(160): n is a, c, g, or t
  misc_feature (189)..(189): n is a, c, g, or t
  misc_feature (216)..(216): n is a, c, g, or t
aggagccaggctcctttaaaccagtagtccccaacctccgntnccagggactgactgatttagtggaagacaatttttccacagacaaggggtcagggaagatgatttcaggatgaaactgtttcagctcagatcatcaaccattagattctcataaggngcacacaacctatatccctcacgtgaggngttcacaatagggtttgcgctcctgtngaaaatctgatgctgctgctgatctaag

SEQ ID NO: 564922 - DNA, 169 bp, Homo sapiens
  misc_feature (131)..(131): n is a, c, g, or t
gcggacgtccgtaggccactgagcaagggcagggatggaacctgcaacctcatggttcctagtcagattcgttaactactgcgccacgacgggaactccgcagatggattcttacctcactgtgccacagngagaactccttgaccagtatttatgaagcctacggact

SEQ ID NO: 564923 - DNA, 272 bp, Homo sapiens
tagcagtctatgatcatgcactgcccgtctgttgcacacactcagctgatgtccgttgcactgtccagtctgtcaaacatagactaggaaagacgcatgcaacgtatggtgatcacacaatagctgagatccacactgggagtagataccccactatgcttagccctaaacctcaacagttaaatcaacagaacaggctcctctagagggatatgaagcaccgccaggtcctttgagttttaagctgtggctcgtaggttaggtctacctgg

SEQ ID NO: 564924 - DNA, 240 bp, Homo sapiens
tgctgcgattattttagatagagatgaggtttcaccatgtgggacaggcgggtctggaactcctgacctcaagtgatctccccagctcagcctcccaaagtgctgcgattatttgtgatagagatgaggtttcactatgtgggaaggctggcatgggaagatgtgtcctagagtcaaggggcaagcagggcctgtgtttatccgtaggcccagatagcagagaagcacagagtccttgag

SEQ ID NO: 564925 - DNA, 657 bp, Homo sapiens
gaagaacactatcatcttgtaagcggagtgctgccaaggaaaggaatgcagcaacaccagcgatgccctggaccctcccctgaagaacgtgtccagcaacgcagagtgccctgcttgttatgaatctaatggaacttcctgtcgtgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcaccccctgcggtgctgacaccctctttccctgctctgccccgtttaactgcccagtaagtgggagtcacaggtctccaggcaatgccgacagctgccttgttcttcattattaaagcactggttcattcactgcccaaaaaaaaaaaacatt

SEQ ID NO: 564926 - DNA, 185 bp, Homo sapiens
cccgcgcagccccgcgaagacgaggaaactgagggacagaggggttaaagtactaggccagaatgtccacagctaccaaaggcgaaggccaagattttgaattccggctgtctggttgtcgaagtccatgttttttccactgtgcttgctgcttccaggcgccccattgctgcctgtcagggctg

SEQ ID NO: 564927 - DNA, 942 bp, Homo sapiens
  misc_feature (666)..(666): n is a, c, g, or t
gaagaacactatcatcttgtaagcggagtgctgccaaggaaaggaatgcagcaacaccagcgatgccctggaccctcccctgaagaacgtgtccagcaacgcagagtgccctgcttgttatgaatctaatggaacttcctgtcgtgggaagccctggaaatgctatgaagaagaacagtgtgtctttctagttgcagaacttaagaatggaacaccaggtgatggtgcagattgagctgtagactcacctagacaaatacccccttggggttcacttcctacccaagaagctggatgaggcagtggctgaagtccacctgcacaggctaaatgtgaagttgaccaagctgactgagaagcaggcccagtacctgggcatgtcctgtgatggccccttcaaactggatgactaccactactgagaaccaggcctgcccttcacctaccagctgctgtccttgccctggccctgcctcccctaagagcaaatgacaccaactttgtgattgttttcagtgtcccccattgactccctggggctggtcacttaggtttggcctctactgcatccctcatactgttgcaagtgtggcagggggaattgaaaagccccccccccctcaagctctggtcatgatgaaggtccaagggagacatccacagtgnaaccatgagctcagtggtcctggaattgctcactaagtcagtccttccttagccttggaagttggtcatgggagtcacaaaagcgcatgtactttacccatctagggcccttcacgctgggtcttgtggaacttacaccccgtgtggctgggtttaactggcttccagaaggtcctcaaaaccatgaccaatggcaaggaacactaaaactgaacaaaccattcaggaacctctttggaatttccctgagacacgtgacttactggtgggccttcc

SEQ ID NO: 564928 - DNA, 499 bp, Homo sapiens
gaagaacactatcatcttgtaagcggagtgctgccaaggaaaggaatgcagcaacaccagcgatgccctggaccctcccctgaagaacgtgtccagcaacgcagagtgccctgcttgttatgaatctaatggaacttcctgtcgtgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactggcagcccctaggacctccagggcacgcaagtcccccgaagaaaggaggcctggcaagagg

SEQ ID NO: 564929 - DNA, 168 bp, Homo sapiens
agactgtcgacaggttgagatggattgtccaaatgacactttttgagacaggttcttgctctgtcacccaggctggagtgctgtggcacaaccatggctcactgcagccctgagctccagagagcaaatgatcctcccacctcagcctcgctaagtagctgggatgta

SEQ ID NO: 564930 - DNA, 174 bp, Homo sapiens
  misc_feature (6)..(6): n is a, c, g, or t
acgtancagactgcgtctcaaaaaaaaaaaaaaagtagcgtcagcagtgtttaaaagtataaggtgagaattctgtatgggtagtggtgctattaaaaggagaaattctttattttaaggaaaatacctcttaacatttttaaggggtaagggggataaaggggtaaaatttta

SEQ ID NO: 564931 - DNA, 748 bp, Homo sapiens
  misc_feature (748)..(748): n is a, c, g, or t
gcttgtgacagctggcctggctctgcactgtgatagctccaagccagattgtgcaattgcagctgctgtgctgcggggaagaggggctgcacttcctgagctggtgcagtggcagagtggataatggatcagtgaccccgagccctccatgtgcccatccgaaggctgtgtggtgtgacacctgtgctgcacccatgtgctgtgacctcagcttgactgcctgatgatccacatgtgagatgcagtggtctaattttatgctccagccacaagtggtgcacacatgcccgagaatgctgtcatgcccagactgtgtgcacatgtgggcatgccatgtggctgctcatgtgcaacgtgggagcgagtgggaatgaccatgcccagctccctccagcactgtccctggccaagcctgcctcctgtgggagctctgacttggtccccatggcctgttgcagacatgccctcctctcagttgagtgggcaaggtcaaggtgtgtgcagccagtgaggtgctgtggtgtgacactggccctgcattcttggacaggggttgcgtcaggccagagcagtgcccagggtgcagtggtgtccctgctgcggagggacaatgggctggcttggttgtccaatggccgagaaggcgagtcctgagagctgggggccatgccagaagcttggtccactgtgctctcctgctggttgtgactcatatttgccttgacaggtggtggctcatgggctcacn

SEQ ID NO: 564932 - DNA, 498 bp, Homo sapiens
tgcatggtctggacatggtggctcacacctagaatatcagctacctgggaggctgatgcaagaggacttgcctgagcccaggagttcgaagccgaagtgcagacgcattcaagctggtcgagccgggaacgcacctgcactccagcctggcaacagagtgagaccctgtctctctttaaaaaaaggagggcctatttcccagctactcaggaggctgaggcaggagaatggtgtgaacccagaaggcggggcttgcagtgaacttgagatcacgccactgcactccagcctgggcgacagagactccaattcaaaaaaaaaaggatgataagacaaaccacgggatggacgaacatattggcaatacataagtctgatgaagactatgtgtctaagctgagcgtggtggtgacgcacacctctagtctcagctactcgagaggctgaggtaggaggatcacttaagcccgggaggtcaccttggccctatgtacaaca

SEQ ID NO: 564933 - DNA, 314 bp, Homo sapiens
ccgggtttacgccattctcctgcctcagcctcccgagtagctgggattacaggagtgtgccaccacgcctggctaattttttgtattttttagtagagacggggtttcaccatgtaggccaggatggtctcgatctcctgacctcgtgatccacctgcttgggcctccaaaactgtagggattatagatgtgagacactgtgcccgactatcatggctttgtgtaatgctccacatgttttgaaaaccatgtttatgggatacaaaattctccatatatacttctcaatgaagctcatagaagagaaaaaaaat

SEQ ID NO: 564934 - DNA, 947 bp, Homo sapiens
cactggcatctcctcacccgtctgaagagcatgaagggcatggagcccggggcagttcatcgatgactacttcctgattcagactagcttgcgttccctgcatggtgctggtctcaggtctggaccggcggcatatggccccgtagcccgttgctacctctggcacactcattgaatgacccagagacttccttcgggtgctgcgctgtgaaccgagggagcgattcatactgccccgtggtctattctccatgagcgatatgggtgggtccacgattaaccgtgctggttcggccgtccgactttcttgcagtaccgcgtcatgacgcccagtgtttggaggaccactcttttcgagtagagggtccggtcacgatcccccttgccatggatggaaccaattgaccttgaggcgtagcggtagttgcgatactttgtcaccagtcctcaaaccattgcgagtatcttcgagagcccgcgcgtgacaggcgtagcaatagtcgcatagcctcgcgtgctctctgtgacgctattcgccatactcgaaggctatgatggataatccatcggctccagtcctgccgtatggacgaaacgaagagcgcgtacaaaggtcggctctgttaggataacgtcgccccagtgcagcgtcccacgatatattggcctccggtagctaaccgagggatctcggcagtggcgaatagcccccctagagagagatcacgggcgcacttcgatttctgcataggtcggccccacggacttgttcgtccctcgtttacatattctggctagacaagctcgaacatacggaaacgctcgtcacagtgcgcatcatagatcctctctgcaggactgtcaaagtctagtcccataatagctttggatggcttcgtcgcagcctcgtagtctcgctttaccccccatatacctacgggagaccc

SEQ ID NO: 564935 - DNA, 266 bp, Homo sapiens
  misc_feature (43)..(43): n is a, c, g, or t
  misc_feature (155)..(155): n is a, c, g, or t
  misc_feature (260)..(260): n is a, c, g, or t
caaaaaaatgaaaattaaattaggtttgaactgtggtcgagcngaggcaggagtggggttgccctcttggggctgaatcaccaggcctcaaaaggtcccctgtggggatgaagaaatttataagatgcaaattgcacatttcctagattttgtanctgtggaaatggataagggaggggaacacggacaaattgcttgtacaatttgaaatgggcctcaatggtactccaaacctattgattattcataaataaaaacanaaaaat

SEQ ID NO: 564936 - DNA, 257 bp, Homo sapiens
atttaaggaagaaattataccaatcctatacaaatctgttccaagaaggaccagaaagccagaggggatacttcctaaatcattctatgaggctggcattaccctaatattcaaattagacaaagacattacaagagccgggtgcagtggctcacacctgtaatcccacactttgggaggctatggtgggaggatcacttgagttcaggagttcaagaccagcttgggcaacatagcaagacctcatctctacttta

SEQ ID NO: 564937 - DNA, 115 bp, Homo sapiens
ctggtctcatccagcactttgagcatatttagaaggcacttgatcccaggcagcttgtctgacttcattgctgcctccttcgtgatcttgttatagatcctgtgtggagcagatg

SEQ ID NO: 564938 - DNA, 341 bp, Homo sapiens
caacgatcgtcctcagttggactatgtatttttcactgaccattttcactgttatctcttatttcagtctttatcctcattttctactcaagagcattcattatttttaggaatcctgatgacatccttctttttatagatcgttttgatgtatatatcttccttgtagcagctaaaggtctatcaatatcctgcagtggtagagtttgctccattccagaagtattgcccaaaagaagctgatattaaaatatgcctagactggaagcatcgaagattatccagaatattagaagtttttagaaacctactgtgtgtaggaagagaagaccagtgccaac

SEQ ID NO: 564939 - DNA, 216 bp, Homo sapiens
  misc_feature (5)..(5): n is a, c, g, or t
agtgntttgtgtcgtgggcctgtgttctggtacgggtagtactggactccattgatggtgaagacgatgtctgcggcagtgctgcttgagtggctgagcagctgaccacctatgtcgccatctgagttctcgctggctccgattgtcgcatctgtgtctgtggtcttgtgtcgctggtggcagctctctgaggtgcatcagtgtacaacggtcccc

SEQ ID NO: 564940 - DNA, 298 bp, Homo sapiens
ccccccgggggttttttcccttttcccggaaaaagtttaattaaaggagcccccctcttttttttgggcggggaatttcaaaggggtatttgcccccttccccatttttagggaaattttatggggaattggggggtttttttcccccggggggccaaaaaaaacccttttagtgttgccccttaaacgggggtttgttttgttaaagcccctgggccccaaattttcccttttttttttaaaagggtaaagcctttaatttttttttttttttgctgggggataaaaacctgaatga

SEQ ID NO: 564941 - DNA, 405 bp, Homo sapiens
gccgtcgtcaagcgttgtgagagctctgtgtgctgcgctcgctggtaggtttttcttgccaggcagggaacccgtggccctttccttcctccagcagatccctgcaatctgggtggttctcaacagaagatcttctctctctgcagggcttcggacaggctccgctggtcctggatctcctgctggccccggcacttgacaatcatgtaacccttcttcaggtggaacacgaggttccgcaccacgtccacaaccttgtcttcagttcctttgtccaccagatcaggcttcgtcaagattccgatggtcctgtctccctcggggtccaactcctgggccatgctgagagcctctgtggtggcgatgtccacattactggggaccaccaccaggctgacttgtcgc

SEQ ID NO: 564942 - DNA, 726 bp, Homo sapiens
ggggtagaagcagggttcgtgtctgggcaccttggggggtataggttctgtctgcgattacaagcgtccattatcgcgttccgcaccctgggtcagcgcgatcagcaattccggcccggcacagtctaaaggttgcctgtgttgccactggggtcgcgggaatccgccattcatgtccctggactggcatgcatcagtcctcgtcaaggatggttttcttcgttacacctccggactgaatatgttggtgaccgaccctgagacaagagaagaactttggctttagccttcaagacgcactgattcagggctcgggagcgaaggtctgtctagagggtctatgagatctatgtgatcccctggatgtccagccaccaccacgctcagatgggagagattattagctgctgtggaggcacatacctacccagcatgacctcggtcctataagcctcagagagttgtgatcaaaatgccgctcaggacttccctgcattgctccagttccaactacgggttgggactgcccctcctctcgcttgagttcatgctgactggagtgctgaagcaggaagccaagccagaggccatttgtcctctcccctgttaggagatgtcatccacctgagaatctccactacccttgttccctcccagatccacgaattagaagatatgtgcaagaaagaacctcagggcgttagaaaggattgcgggtatacatat

SEQ ID NO: 564943 - DNA, 152 bp, Homo sapiens
agatccttgtacatagagtctcgggtatgctgttgttaaattgaaactgcaaagtagatggttgcaagtactggtatgttgctctgtatggtaagaactaattctgtaacgtcatgtccataattactaatcacttttcttcccctttacag

SEQ ID NO: 564944 - DNA, 303 bp, Homo sapiens
gccttgtaagaggcaaaaaacccttgccgaatttgcatttggcttccagtggtaagcccattcctcagcagggtcaagcccaccagtaaaaactcccaagagaacccgaggaaggcagaaacgatgtttagccccagtattttgcatggttccctgcttaagaaaatgccttttggaatatttgtaaactgaaattcgggatgggtaaaagatgtttaaaaatgtttgggtcctaaacagctttttaaaattaaacttgggaataaattcagcatcttttcaaataaactttatgaaagccca

SEQ ID NO: 564945 - DNA, 388 bp, Homo sapiens
  misc_feature (127)..(127): n is a, c, g, or t
  misc_feature (373)..(373): n is a, c, g, or t
agcgccaacaaaaccacacttcgaccccgcccgcgacacacaaacaaacacgctttagggccacccagtgctcctgctgtaagatcgttcaggaacacccgacagcattgcttcctcctcctcagtntctcacccaccaggcagctcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagacttgacctcaacaacctcagcagtttcaggggtatggccagcaaccaactttccngggaccagttcctgc

SEQ ID NO: 564946 - DNA, 304 bp, Homo sapiens
tcacctttctccaaaggcagatgtgaagaacttgatgtcttatgtggtaccaagacaaaagcgattaatgggaaatacctttggttctttggggcggcaatttcccccggttctatttggcctgaaaaaatttttagggaaggaaggccttaggccgggccatgtttctcacatctaacctgcctcctcccttgttgagacatcgtttgaggactcatacatctgtgattcaccatctggacagggctttgggcaaagctgggggattggccagctgactgctcaggaagtaaaatcgagtctc

SEQ ID NO: 564947 - DNA, 664 bp, Homo sapiens
tggctggtaggcccgggtggttgctgccgaattgggcaagtccatgaaaccggggaaggtggtgcttgtcctggctggacgctactccggacgcaaagctgtcactcgctgaaaaacatttgatgagtggcacctcagattcgccccttacagccagtggcttcgtggtgtggcgtggaattgtgaccgcataccccgcgcaaagttgacagcgtgccagtgggcaagaacgaagactcgccaagagattcaacagataacaatcttctgtggtgaaagtgtgtattaactacacatcaccataagtgcccacaaggatactcgtggtggattatccccttgggacaaaacgtgtcgatcaaataaggagtgtcttcaggagatccgtgctcttaaacgcaagggcccgaatcgtgggaggcccagaggttcaagcttttgaagaagaagtatacacagacacaggcacagaaacaaggtgcgtaactctcccagaaaaacgtgggggtttcaagagtcctaggggtatgagactacatcatcacaaattatcatacgagacaaaaacaaaacaaaaaaaaacaccacatcaagagccactcaacagactaagagtatttcggacaaaaaaagcaacgacaaacaatagtgtcaccttgttgtc

SEQ ID NO: 564948 - DNA, 152 bp, Homo sapiens
gggggggggcccccctttggggaggaattttttttttccccctgcccgggggaaggttgggaaaaatggtttggccccccccttaaagggggggccttttgggtttgggtttggtttccgggggggaaaaaaaaattttttttttcccccca

SEQ ID NO: 564949 - DNA, 344 bp, Homo sapiens
cagcctataggagataattccagagaaccaggcaaaaaaaaaaatcagtgggtgaggccaggtgcagtggctcatacctataatcccagcactttgggaggccaaggcaggcggatcacctgaggtcaggagttggagaccagcctgaccaacatggagaaaccccatctctacaaaaaatacaaaattagtggggcgtggtggcgcacgcctgtaatcccagctacttgggtggctgaggcaggagaattgcttgaacctgggaggcagagtttgcggtgagccgagattgtgccattgcactccactctgggcaacaagagcgaaatgccgtctcaaaaaaa

SEQ ID NO: 564950 - DNA, 155 bp, Homo sapiens
tggaaggtctgccgtcatgaccgcctttacagttactgccacttcttccgcggtcctgagtctcagacaccgctgtttgtacacctggtcacttaggggtctcctgtcaggattgctttccagcagcacgctgccccacaagttctgagatcctt

SEQ ID NO: 564951 - DNA, 153 bp, Homo sapiens
actctgcctgcactataaaatgaaccaaggaggatccagtttgctgtctgcactgacagatttacagacaggaaaacaaagccttacttaccaggaatccaaagtttatacatgaaaatttaaaaagggagtctatgcaaagcggagttcagg

SEQ ID NO: 564952 - DNA, 905 bp, Homo sapiens
atatctcgtctcacttgtccactccaccatgtgagattcagcatctgtgaactaggttttgctacctcctgtggtctctaaggaaaccctagtagatggttctcagagtgacattgacgaagcagcgacaacgatcacgcgcgcaagaatgcaaggctcgggaggaacgccggcgagagcgcaggattgagatagaggagaactaataaacaggggcaacgtacccagaagtccacattcctcctcgaagaatctacgagcgagtttgcctgccgtgtcaattctgtatacctagctccgtctgattctgcatttagggtcccgagccagcatcacgatgggaccatggtggcccgtctccgatattgctcgctctcagcagaagtccaggttacccattgcgagacttgttctagctagacacaccatcgggtcagccgactgccagtcagggacagtccctcattactgcgtcgggagtctaggagagaagactcctcccttcgcttccttcgtcccagatgctgagggttggacatagagcaataagcagatgtgtggccgaataactgctccataagcaaagatgagaacggcttagttccatcgctgtccctgtggacagtggagggggagagtgatagttctagaccggggtgcctggtgtcccacgggttccatggattccgttcagaccatgcttaatgaagctagccttgactgaaacgtggacaaagcagctccttcagatccctcttggagagaaatggggacgaaaggggacactgggaagcaaggctctggtaagagataacgtcccgcaaggacatgggccggcttccacggggtagagtgtgttatccccccggagggtggggattcaacgaaaaaaaccagggggggca

SEQ ID NO: 564953 - DNA, 553 bp, Homo sapiens
tctgtaactgtgcttgtgaatgtcaatcatatttaaagggaatgactttgaagtaaaaccttttttctgtgctactgaaaaaaatggagttgtttgggggtggtaaagtgttaaggaaatagggacagcgggctcacacaaggaactctggaaggccacatgtgaaacaccgtgtcactggcacagaggccagtcccactaagggtgaccagagggggctccaagcacaaacggccatgggcatatagatgggacggtgtccccccaaaattcatgtgtgggagccttaaccctcaagggtgagtggtattggagatggggccttgggataagggaagtttagatgaggtcacgagggtaggaccctcatgagtgggatgagtccccttacaagacctcgggactggggccgggcgtgggggctacacacctgtaatcccaacacttggggaggccaaggacaggtagatcaccttgatgccaggagttccagaaccaggcgtggccgacagtagtgaacaccccaatctctactagaaaaacaaaacaaagg

SEQ ID NO: 564954 - DNA, 113 bp, Homo sapiens
ttcaaaatgtcttccttccttatggtctataagccccgcagaaagtcttgcactcaatctgtcctttgttacatgcctttctgtccccagtttccaagctttcttcactttat

SEQ ID NO: 564955 - DNA, 228 bp, Homo sapiens
ctgatgtggtcagcaaaggcttagccatgatcaagttacagcaatatcagggctgcagaaaaatcaggctgctggaagtctcagggcacaccattggggctttacctctaaaccaattaaatcagaacctctggggacagcccccatcgaataggtgctataagatgcccagtgagtgccaaaatggggcatcactgaggggcacccatcgggtgttaaccttaacca

SEQ ID NO: 564956 - DNA, 803 bp, Homo sapiens
tgaatccacatctccttgaagttttttttgttttatttgtttttgagacagaattttgctcttgttgcccaggccggagtgcaatggtgcaatctcagctgggtgcaacctccgcctcccgggttgaggcgattctcctacctcagcctcccaagtagctaggattacaggccatgagccaccacgcctggctaattttatatttctagtagagatgaggtttctccatgttggtcaggctggtctcaaactcccgacctcaggtgatccaccccacctcagcctcccaaagtggtgggattacaggcatgagccaccgtgccgagccttccttgaagtttctgttggttttgatttgtattggtttagtatgtttgtttgttttctggagatagggtctcactctgttacccatgctggagtgcagtggcacaaatcttgcgctcagagcaacctctgcctcccaggctcaagcaatcctcccattcagttctaagtaagctgggactacaggcacgtgccaccaaggcccagtaaattttgtgtcggtaagagacggaggttttggccatgtttggcccagggctcgtcttgaaacaccgggggctcacaggcagttctgccccaattttcgctcccaaggtcttgacatcaggcggtgtgagtcatcaatgccagggcttcttgaaagtctactcaacacttgggattacttggtcggagcagaacgtgccattccatcaggctactgcggtctggatataatggagcacacaaaaatctaatgatttatcacttatctt

SEQ ID NO: 564957 - DNA, 126 bp, Homo sapiens
agtgtctgaatcctatctcagaaatgctcacaatgggctctgaaccctaaacaaccgtgttcatgtatgtggcaatgagcttgtgacaaacaaagctgggccaggcgcagtgactcacacactgta

SEQ ID NO: 564958 - DNA, 624 bp, Homo sapiens
agcggatgtggccgatggctcaagagagcgtggcgtcgcattgccgtttttgctcagaatcgcgactaatggcttttttatattttttctccctcttgaacggttagggctatggctgcgataaagggccgtcaactccaaggttgaggtggcgctgggcccaggcagcttggtgctgctcacatatatgcgccgcccgaggtctgcaggatgtccttgcggaccaacttgtgggtcctaaagggcaccattgaaaatgctggtcactggtgcgaggtgacattcaaaattcaccaaagatggcaatgtgcttgcctcgatgagatgcaaattcaaaattccaacagctccctttaatagcaaaagttagcaacagcctcaggattgacgtcacaggaggagtggtacatacttcaaagtgtccataattatgggacgagttactaaaaacaagctgaccgtgtaacattccgtgagggccgtgcacccgtggaacataattaccgtgaaggatttgagactcgtgcaagggattcaacagccttgtgagagttggggaggacattaacaagttgacaagaggacattaaacggaaaactccttctaatatgtcgcttagaaca

SEQ ID NO: 564959 - DNA, 339 bp, Homo sapiens
  misc_feature (50)..(51): n is a, c, g, or t
gcaagcctaggcaacaaaacaagactctgtctctacaaaaagtttaaganntgagccagacatggtggtgtatgcctgtagtcccagccactcagaaggctgaggcaggaggatcgcttgagaccaagagtttgagcctgcgatgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgacccatgaatgccccactgcactcc

SEQ ID NO: 564960 - DNA, 837 bp, Homo sapiens
  misc_feature (13)..(13): n is a, c, g, or t
  misc_feature (371)..(371): n is a, c, g, or t
  misc_feature (373)..(373): n is a, c, g, or t
  misc_feature (395)..(395): n is a, c, g, or t
  misc_feature (402)..(402): n is a, c, g, or t
  misc_feature (432)..(432): n is a, c, g, or t
  misc_feature (435)..(435): n is a, c, g, or t
  misc_feature (447)..(447): n is a, c, g, or t
  misc_feature (508)..(508): n is a, c, g, or t
  misc_feature (511)..(511): n is a, c, g, or t
  misc_feature (522)..(522): n is a, c, g, or t
  misc_feature (525)..(525): n is a, c, g, or t
  misc_feature (527)..(527): n is a, c, g, or t
  misc_feature (551)..(551): n is a, c, g, or t
  misc_feature (618)..(618): n is a, c, g, or t
  misc_feature (692)..(692): n is a, c, g, or t
  misc_feature (698)..(698): n is a, c, g, or t
  misc_feature (718)..(718): n is a, c, g, or t
  misc_feature (825)..(825): n is a, c, g, or t
gaatttacctacnagttgaaaatattcacaaaggacttgatcattcacactcatacacagagaaagtctgctgaataaaaaaatgctcctttacccattcgacctcctctcaggggctgcagtgggtttgccaattccactgtggggcttcagtcttcatgaatgttgaatagtttggctacttcattgagatcttcatgctgctcaccgtccttaatgatcttccttgctattggcattcggttaaagatgttccatagcacaatccccacgaccactttgtccctgaggtagaagatgacacctttgccgtagtcctccccctggacgggagctgtggaactgccgggggtgctgcggaggaataagtnantttccgaggcctcggactctgntctcacntcgtctgaatcggctaccacgttgcccgantgncccgtgggcagnattggggttgtcttgtgcagttgcttttttcaaaaacaccaactgtgggcaaactactgtnccncagaaccaatnagntncatagccaacatcgggggcccaantcactccagaacattgactgatgccagttcggcttagcagctccagtcatacttttctccagccaantcttccactcacaacaagcgtgatcattggtgctctaccccgcctccttccccaacttttatattcgtagaagnctgccngctactcctgcccacccagnatgtttagagcgtgcttgttagctctgcatttcacccgggaagccaccaaaaatctgagatttattttccaggccaccagtctttggccaactcaacaattgggctncaggcccacagc

SEQ ID NO: 564961 - DNA, 211 bp, Homo sapiens
atgctagcacgcacagagcgtaagagagctctgtaagagattttgaattctcagtgaagttaaaagtcactggccgggtgccgtgggtcacgcctgtaatcctagcattttgggaggccgaggcgggcagatcacttgaggtcaggagttccagtccaacctggccaacatggtgaaaccccatctttactacaaatgcaaaaattagctg

SEQ ID NO: 564962 - DNA, 268 bp, Homo sapiens
  misc_feature (102)..(102): n is a, c, g, or t
  misc_feature (108)..(108): n is a, c, g, or t
  misc_feature (117)..(117): n is a, c, g, or t
  misc_feature (150)..(150): n is a, c, g, or t
  misc_feature (152)..(152): n is a, c, g, or t
  misc_feature (217)..(217): n is a, c, g, or t
  misc_feature (220)..(220): n is a, c, g, or t
  misc_feature (237)..(237): n is a, c, g, or t
tgaggttcaataaattgaacaaccaatgttcaattatgttgtctcagtggacacaggtgtttgccaggaagcttaaagtcaatgggcaatatggctggccanactaanaaagacaanagggctggtccctgggccaaatccgaaattatnantccaagtctgggggaatatactaggagctgctgaccactggcctttcgttaatcaggaggctaanaangccacaaaaggcctgangttcaggcaccctggctggcccttaacggtc

SEQ ID NO: 564963 - DNA, 460 bp, Homo sapiens
  misc_feature (126)..(126): n is a, c, g, or t
  misc_feature (460)..(460): n is a, c, g, or t
ggagccatgtggctccggccggtgcgcgggcctcggaccctcagagaggcgagggttcgagggcacgagttcgaggccaacctggtccacatgggtaaaaaaaaaaaacaaaaaaaaaaaaaaaantttgtggggcgcggccgcgggcctagaaaaaggttttcaagaccctctcgtttggggcgcgcgggggaccaagtgagggtaactgaggagacaccttgggcccacaaggcggtggaccacaggggagactccgtggggcagagacataggtggtggggttgctctcaccccaattaaaaaaacgggcggggggggaaccggagggctctctgagacaaaatcccccaggggggggttccgggaggggcccaaacagcgggtctcaacaccacaggggtgcccccaagggagcgcccagatattcaaattttaacgccccgccggtcgggggagn

SEQ ID NO: 564964 - DNA, 1510 bp, Homo sapiens
ccctactatgagaaaaatgataccccatataggattgccatagacttattattcgcatgactgaaaagagtaattatagctatagagtgataaagctttgctctatatgcatcgatgcatatgcatgcatacgtcatagcaaacgcattttaaggaaacgggcgtaggtatgcgaataaagcataataataaaatacaaagtaattaaagcctataaccccaaatagtatacataatacccataataccaaattcaaatatataataccccccaaaagttgcttatgcaagaaaattcaaggatattatccaataaatatataaatattagatgatgtgtaatatccttagttatatgggaatggtttaaggttagttagcgttttagtaggttaatttgggaccctaatcgagtagcttttcgtgatgagtaatttaggtagttagttactatataaggtagtattagttagtttaccgtattagtttaacgtatacgttacgtatatcgtcttacgttacgtgtatatgcgttactacgtagtagtaacgtaagattagtagtatacgtagtatacgtggaataatgttttggggtttgtgtcgcgcgcgcatatatcgctattagctacgtcgtaaacgtaccgcgcttaagtaggaagagtagctcattacagtattaggacgtatactaattatatgccgtagtagtagctacgttacgtatacgtacgtagcgagttagttagcttacgtacgtgagccctacgtacgtattaaaaagtgtatatagtagtagtatgatatatcgggtattagttatacgtttatatatatatatacgagctacgttaacattagctgctacccgcgcgagagagatatatatacgtatatttgcaggatcgtagtgtagttgcagttacgtacgatacgtgattacgttagtagtagtttttaggtagtacgtatatcgtacgtagtaatagctttttaatacatatacgtgtcaatgcgttagctacggtgaaacacgtactcagcatattaaagtagcgtcgccctagtatcccatcgcccaaatgctatgctcggcgtccattgcatccaaatataatgagatgcaataaaacccccgggggttaaacgtatgtatgcataaattagtgaatatcaaaaaagtaaataatagaaaagtttaaaaatattaacgccaaaggataataaataataagacccataaataaataaaaccataaaataaaatcccaaccacaacgcatcacacccacacgtaactacccatcacaaaagtaacgtaactagcacagttaaaaggatatcgctactcggactacggcggactagactagcgcgatcggctaatcggatcgcgcgcggtcataccgcgtcgcatcggcgctgtatacgcgcgatcgggcgcgcgatatatcgtagcttcgattcgctctacgctcgcatgcgcgctcaggatgatacttctttttca

SEQ ID NO: 564965 - DNA, 941 bp, Homo sapiens
  misc_feature (1)..(1): n is a, c, g, or t
  misc_feature (99)..(99): n is a, c, g, or t
  misc_feature (106)..(106): n is a, c, g, or t
  misc_feature (116)..(116): n is a, c, g, or t
  misc_feature (136)..(136): n is a, c, g, or t
  misc_feature (142)..(143): n is a, c, g, or t
  misc_feature (145)..(146): n is a, c, g, or t
  misc_feature (156)..(157): n is a, c, g, or t
  misc_feature (159)..(159): n is a, c, g, or t
  misc_feature (210)..(210): n is a, c, g, or t
  misc_feature (218)..(219): n is a, c, g, or t
  misc_feature (235)..(235): n is a, c, g, or t
  misc_feature (247)..(247): n is a, c, g, or t
  misc_feature (250)..(250): n is a, c, g, or t
  misc_feature (261)..(261): n is a, c, g, or t
  misc_feature (265)..(265): n is a, c, g, or t
  misc_feature (278)..(278): n is a, c, g, or t
  misc_feature (281)..(282): n is a, c, g, or t
  misc_feature (287)..(288): n is a, c, g, or t
  misc_feature (291)..(291): n is a, c, g, or t
  misc_feature (296)..(296): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (321)..(322): n is a, c, g, or t
  misc_feature (324)..(324): n is a, c, g, or t
  misc_feature (327)..(327): n is a, c, g, or t
  misc_feature (334)..(334): n is a, c, g, or t
  misc_feature (338)..(338): n is a, c, g, or t
  misc_feature (340)..(340): n is a, c, g, or t
  misc_feature (345)..(346): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (369)..(369): n is a, c, g, or t
  misc_feature (375)..(376): n is a, c, g, or t
  misc_feature (379)..(379): n is a, c, g, or t
  misc_feature (382)..(382): n is a, c, g, or t
  misc_feature (384)..(384): n is a, c, g, or t
  misc_feature (401)..(403): n is a, c, g, or t
  misc_feature (412)..(413): n is a, c, g, or t
  misc_feature (415)..(416): n is a, c, g, or t
  misc_feature (781)..(781): n is a, c, g, or t
  misc_feature (802)..(802): n is a, c, g, or t
  misc_feature (914)..(914): n is a, c, g, or t
ngagcgaagcgttttacaaatattaattcacttaatactcacatcaatcttataaagtaagtgctcttgttatttccttttacaggtgaccaaactgangcatggnggtttaatangcttacccaaaactacacancaaggnngnngctgtgtcgnnantcaaactcagtcactgtagcccccaagtccatgctcataaccaccaggaanaaaaagannctcctattctaatttnagtctgacagtnggnccagtcatggnttcnatacagctcagcngannaatgnngcncatcncggcngcnacnctaaaatgctcagnnanggncaaccangcgncngaggnntaacatcngcnatngcncanccnatgtgnntcntgngngccctctgtctttattnnntttgggggnngnnatcaaggtcacgaaatcaagtgactggtgatggggcctagaaatgagtgtctccccccacccccggtttccgctctggcaggcgggtgttagcggatggtgtacttgtcccacttcttctcggggtcataggcctcccagcggctggcggggaagatgtgcttgttcttctcgtaccagctgcgcagaccaccttgcccgcgtgcgactcgtccttctccatggtggcgtcgctgagcaggcgcacgtcatcgtgcacatcgaagctgaagagcggcccgctcttgcccctcgccctggcgatgatgaagtcgtagaaggtgtggtagtgcggcaggatgaggtcctccttgatgaacatgagcngctccacgccggcggacgcancagagaaagtccttgcgcagccctgcagcgccttcttcaggactgctgcaccgtgttgccttgcgcaccgcaccgtgcgccggtcgcccgacccgtcccagtagctgaaggngacctccatctcctcgtccttcacttt

SEQ ID NO: 564966 - DNA, 131 bp, Homo sapiens
cagaatggaaacacggttacccacactacctcgcttgcacagctaaacagctagcatatccacgagggttcccttctttttcttggcaagtcagaggaatttacctccccaccccctctactacatattct

SEQ ID NO: 564967 - DNA, 437 bp, Homo sapiens
ctctctggaaggcctgggagctgaattccggaagatccccacatcgatgaaagcaaagcgaagccaccaagccatcatcatgtccacgtcgctacgagtcagcccatccatccagtggctaccactttcgacacagcctctcgtaagaaagccgtgggcaacatcttgtgaaaacacagaccagagatatcacctagaagggctcttcagaaactcgtggagcaccaagaaacgccaagaggcagagagccagagatcattttggccatagatcaggattgtggcaggagaaaagcgctgtgcccgtgatgggccttgaaagaacgaggacaaaagacaagcttttccagtttcgtgaacactggcggaaatatcccatcaaagttcactgacagagaagaggagtggataaggacgttatccaagaagtggaccac

SEQ ID NO: 564968 - DNA, 188 bp, Homo sapiens
gatgctccagctccaatccccagatgagcagttaagcagctgacagttggagggaaagccagcctgggggctgggaggatcctggaaaagtgggtggggacagaccagcccttccccatcctggggttgccctgggggaaaccagctgagtttgaattttgctttaaataaaggcggctcccgaagga

SEQ ID NO: 564969 - DNA, 239 bp, Homo sapiens
cacgcgtcgctgggcgccattcctggccctcccgctgcatcttagacctgacacccaacggggggatgtggtggccctgtgcccaccttctctccctcctcccgaccgcccctgccccacccctgtgtgttcgccagttaagcacctgtgatccagtactactactggtttgggttggttgttctgtctttttacttaacaatcaaccaacatgctgcaaacgcacagacacacacacc

SEQ ID NO: 564970 - DNA, 124 bp, Homo sapiens
accaggcgctcatatcatggcagcagggtcaggggggggccaggggcagcatacgtcccagccccctgttgggctgtctcgggcgagtaggcagggtgccctgttccgggtgtccctccacggg

SEQ ID NO: 564971 - DNA, 213 bp, Homo sapiens
gctaagactatggtgatgacatagctctgctgaagcaggcccagaaagtaaagatgaccacccatgccaggaccatctgccttccctgcacgatggaggccaatctggctatgcggagacctcaaggccgcacctgtagggaccatgagaatgaactagctgaacaaacagagtgttcctgctcatttagtcgaccagaatgggagaacacca

SEQ ID NO: 564972 - DNA, 126 bp, Homo sapiens
acccgagtataaatagactatgggttgcaagcactgagcactgtaacttctatcacgtctctctttaatttctgggatataaaacaggctttaagttacttggattagcccaagggcagagccagg

SEQ ID NO: 564973 - DNA, 395 bp, Homo sapiens
agtacatatactgtataaagaatgaagatgcacacatcagacagacaaggagcgtgtgatgctccgtggcgcttgagagctacacggggtgtgtgggtgtggaagggactatgccagaatccccagcagctctctggtttacagctcctaggtacagaacagctggtgtctagcacctgtgttagaggtttcgtcacaccgaggctgggcccagtcccctctttggcagcgtgccagttgctgagaaggtgattgtggtcacctgcagagggttcgagtcacttgcgctcagggcacacggcttctctcaccatactctgctttttgcactcactccctagttgagcctactggcatcttgctctagatgccctggcccgggatggctgtgcagc

SEQ ID NO: 564974 - DNA, 338 bp, Homo sapiens
attcagaggatccccttttttcttttcttttatttttgacagagtctcactgtgttgccgaggctggagcacagtggcatccacacatcttacctcagccttgacttcctaggctggtgcgatcctcctgcctcggccccccaagtagctgggactacaggcgcccaccaccacgcccggaaaatttttgcattttttcagtagagatggggtttcaccgcgttagctaggctggcctcaaactcccgacctctggtgatccgcccacctctgcctcccaaagcgctgggattacaggcatgagccaccgcgcccggctgaagttttgtatttttttt

SEQ ID NO: 564975 - DNA, 102 bp, Homo sapiens
tatcggtcggtacctgggacatggggggctgagctgcctgaaggaactcctcatcatgtgtcctgctgccattgctggtcccactttcttgaaccctgccct

SEQ ID NO: 564976 - DNA, 241 bp, Homo sapiens
  misc_feature (181)..(181): n is a, c, g, or t
gatcgacccaggcctcatggtgcacatctgtggtcccagctactcaggaggctggctaagtgtttgtatttttgatagagatggggtctcattatgttgcccaggctggtctcgaactcctgagttcaagcgatctgcccaccttggtctcccaaagtgctgggattacaggcgtgacacntgtacccggcccttcctcccttacgcgctcttttctctcttccctaatttatgatggtgc

SEQ ID NO: 564977 - DNA, 943 bp, Homo sapiens
cagttgtacaaaccccaggtataaacacggcagtactatacggtctaaggtagcgaggctgggtgggcataaagcctacgtttctgtggggcatcgtgacgccgctggcactggctttgggacctcttccagttccgccacgcttgcgtgatataagtgcgtggaggaaataatgggtgggcaaggaattaacgtttcatcctgccatcggcgccacgtaaatggaggtgccggctcttccactgcgtggccgcagtgtcattgacagtcacagattccttggacttcgtaaagatcatcaccatcctggtcacggccacagccgtccagcgtgggggcacgctgggctatccctgctggaggtgtcctcactctggccatcatcctcgaagacagtcaacctcccggtcgaccatatctccttgatcctggtctgtggactggctagtcgaccggtcctgtaccgtcctcaatgtagaaggtgacgctctgggggcaggattcctccaaaattacgtggaccgtacggagtcgagaagcaccgagcctgagttgatacaagtgaagagtgagctgcccctggatccgctgccagtccccactgaggaaggaaatcccctcctcaaacactatcgagggtccgcaggggatgccagggtcgcctctgacaaggaatcagtcatgtaaaccccgggagggaccttccctgcctgctgtgggtgctctttggacactggattatgaggaatggataatggatgagctaaggtctggggtctgctggcaaatctgggacccagggccagcacccctcaggacaggaatctggatgctggttgtggattctgtgttcaaaggttatcctcaaacccagtcctcatctgcgccatcaaggttgaaacagcaaacgaaaatatgtctgtgcttccactaactgtgctcc

SEQ ID NO: 564978 - DNA, 339 bp, Homo sapiens
catcctcgcttgtctttgatgcggatcctagtctatgtgcttgaactccctgggcatagttctgttgatccgcctggtgatagctacctctggtcctggcgtgcaggggaggctgacaggaggatcctccagcctgtgccagctatagagcagctaactgcatccgtatagcagactgtgctttgactctagaaagggtatagtactatatggaaaaggtattataaactatttgcctttgaaggccaaagtcacccctattgtgtatcagagcaaagttaagactgctttcctcagagaccttggccagtgcttagtgccaccttcctgtggctcaca

SEQ ID NO: 564979 - DNA, 177 bp, Homo sapiens
atttaaccgtgttagccaggatggtcgcgatcttctgacctcatgatccgcccacctcggctcccaaagtgctgggattacaggtatgagccaccacacccggccttttttttttttttttttggaaaggaattttcttttttgtgccccaggttgaattgaaaggttccaatttgg

SEQ ID NO: 564980 - DNA, 1070 bp, Homo sapiens
  misc_feature (363)..(363): n is a, c, g, or t
  misc_feature (376)..(376): n is a, c, g, or t
  misc_feature (467)..(467): n is a, c, g, or t
  misc_feature (493)..(493): n is a, c, g, or t
ccctcagagagacagcagaaagggagggagggagggtgctggggggacagccccccaccattcctaccgctatgggcccaacctcccactcccacctcccctccatcggccggggctaggacacccccaaatcccgtctgcccccttggcaccgacaccccgacagagacagagacacagccatccgccaccaccgctgccgcagcctggctggggagggggccagcacccccatggccccactacccctctgaggtggccagaatggatttgtggccaggggcatggatgctgctgctgctgctcttcactgcatgctgctcttacctgcatgaccaccctgatggttctgcaggccccagntgccaagtacttncttcaagatggccttctacaatggctggatcctcttcctggctgtgctcgccatccctgtgtgtgccgtgcgacggacgcaacgtcgaganaacatgaagatcttgcgtctaatgcntgctccacgatcaagatacgctgtaacgggactccgagtggaggttgcgagggggctcagacagtgaccctccctcgcaggccctattgtaggttgtctccaacccgaccagacgctcgtctcgactctgcactggcgaatgcatggagggtacttgcccatggccggtgatgtagcccaatttgccagagccggcgagcaactgatggggcttgacgtacatgccagggctggacttgcggtgctgggcacgcgagtccatccttccagacgagccggaagcgcgacggggggatagcccaggcacagagggaagacgtggtagtgacggggaccagacccaagaacgaccgtggcgcagaccagcaggaccggtcaagggagaccaggcgagaggaagcccatcagaagggaagcggcgaaagcgcgacatgggcgcccgaagtggaggggcccgtcaacaacggagtgcgcgccatacgacaaatgcaactcagggggcgcccgcggggaggagcaggaggggcgcgcagagaggacgtaggcgaccgaaccagcagaaggaagggggaacgag

SEQ ID NO: 564981 - DNA, 1271 bp, Homo sapiens
  misc_feature (898)..(898): n is a, c, g, or t
aagaagttattatctcgaaactgatcatctgatgccacaatcccattacaacgccagtctcttccctaaggctttcaaactagaactacttctccataatattcatccctgtatgcaattgtttcgttacatggtcgcatcagtagaatatactcactgtgtagtgatataaatctcgagatcctcgataatcattcaaatcatgtctaccttcagaagtattcttactccaatcattcgctagagttatccaattactaaaatcgtttaggttagctcgtgtaaatcaaccctatttcgccatactgtttgcatccgggcttgcaggaggggccgctagggacattgtattatcccctatgcatattggcttccgaagtccaaggtctcgaatggaactagcggcacgcagtacggccagaagtggtccaaccaagaatgcggaggcacacttttccacatggcgaaatccccttattgagctagaacacagtcactcagtgcctgattaattcagagtatttcactgccattcagtccattctatgggcagctgattggtttaggtccccgttagacaacttcttcgaataacggttccactggagaggaatcacccctaaggagagcccaaaggacttagtgccggcccttttcgtttagaaacctcggctctataatggttcccaacacggcgcggttcaaagcgctcgcttaacggtatctttgaaggggcctcgatccgcagtcgccagtaaggtctaggagccgacagacaaatgggggcgtacacaattttccaaaggccctccaggaggttagaacggggtgtcagtgccccaacagcaaccccgttggaaagagctgtactgcacaccactttcaaatgttccccaanttacagacaatgtgagacacacccgctaaagacacacacttataggttctttgctaaggcacctccaatcagtcgttcggcgaacccatcctgagaagtggctcagccttcatgtgtagggcacttactggctttgagagcccattgggggtaaaaagttccgcttcttcggtgttaaaccttccatagttggcgccgaggtgtcgttgccgaaagccaacctgcgcggtaagacagacagttcaacaaccgatttgagagacccttccaccagttggagaagtgtctctaataggagactctccgattagaacaaacgtgtaagttgcccatctcaagcgagccgtggcttgagataccacccctaggcatt

SEQ ID NO: 564982 - DNA, 655 bp, Homo sapiens
  misc_feature (363)..(363): n is a, c, g, or t
  misc_feature (376)..(376): n is a, c, g, or t
  misc_feature (465)..(465): n is a, c, g, or t
  misc_feature (467)..(467): n is a, c, g, or t
  misc_feature (471)..(471): n is a, c, g, or t
  misc_feature (474)..(474): n is a, c, g, or t
  misc_feature (480)..(480): n is a, c, g, or t
  misc_feature (489)..(489): n is a, c, g, or t
  misc_feature (503)..(506): n is a, c, g, or t
  misc_feature (522)..(522): n is a, c, g, or t
  misc_feature (542)..(542): n is a, c, g, or t
  misc_feature (545)..(545): n is a, c, g, or t
  misc_feature (590)..(590): n is a, c, g, or t
  misc_feature (652)..(652): n is a, c, g, or t
ccctcagagagacagcagaaagggagggagggagggtgctggggggacagccccccaccattcctaccgctatgggcccaacctcccactcccacctcccctccatcggccggggctaggacacccccaaatcccgtctgcccccttggcaccgacaccccgacagagacagagacacagccatccgccaccaccgctgccgcagcctggctggggagggggccagcacccccatggccccactacccctctgaggtggccagaatggatttgtggccaggggcatggatgctgctgctgctgctcttcactgcatgctgctcttacctgcatgaccaccctgatggttctgcaggccccagntgccaagtacttncttcaagatggccttctacaatggctggatcctcttcctggctgtgctcgccatccctgtgtgtgccgtgcgacggacgcaacgtcgcncncctnccnctcttncgtctactnctgctccccctccnnnncctgtccgggctccgngtggcggtgcgcggggctcnccncttccctccctcgccgccctctgttgttgtctccccccccccgcnctctctcgctctgcttgggctgatggaggtactgccaggccgctgtgtgcccattgccaagngcg

SEQ ID NO: 564983 - DNA, 989 bp, Homo sapiens
ggtgacaatgatggcggcggagcgtggtggagtgcaaaaacatggtgatgagtttacgagtctccgaccttcagagtgctcctgggtttcgttgggccggcagtaagagctggactgtaagcgacgaggctcgtcaccagggccctccagctggtgcagttggactgtatgccctgagctgttcacggaagatcaaggagctgtaccgaggacccggtacgccgaagacaggaactcggagcctgtccccacaggcgcagcgtgtcccctggagccccttgacactatgcactccgaccatacagagcggtgcctggcgtctgtgcctcaggacatccgcatggtaaggcgctccaagtattgacttacccgcgttgcatcgtacggaaagtacttaaaacggacatgggacggttggtcactgctcgcaaggacacctgcaaaggccatgagaggtcctgctcgtggttgaaaagcatagccgttgcgtattaagtaattgcctggattgtaggactggcatggagagacccaagccgaaatttagtgcccccagcagagaccaatcagagaaagcctttacacggatggagcgcccggttagcattctttacggcactttggaacggaccaaggaaggagggatgggaaggatcggaaacccaggagaccaaatcccagcgggtcaaacgtggcaggcacgcgggaagatttaaaggagcccgtggccaggaggtgcagatcccgtgaaggcaaagatctcttggtgaacatcctgggaagcaaaaccaacgcgtgggaccccagtcccacggggagagggacccaagagcataagaccccggacgccagaaacagatttcggaagttgagtagagaagggggtcaagacaccgacacaaggtaataagcgagagcttcccagagtccccatggagggcgtcaacataaaagacgcgattaccaagatataacgggggcccagaggg

SEQ ID NO: 564984 - DNA, 132 bp, Homo sapiens
cctcaactgcgcccgcgggaggtagtgacagaaaaataacaactacacggactctttcgaggccctgttaatttgaatgagtccactcttaaaatcctttgaacgatgcatccatctggagcggcaacgtct

SEQ ID NO: 564985 - DNA, 523 bp, Homo sapiens
  misc_feature (96)..(96): n is a, c, g, or t
gaggcttggggtaggcttggccttaaggggacagagtcagtttcacgctggttttgtaataaaaaggccccagcgggcccagtgtaagctaacagnaccgtaagccagggcaaatggttgggggacctcactttcccttttaggtgggccagggggttggaggcccctaaaaaaagataagtaagccccagtgtccccccagcccccatgtttatgtgaaaatgcgctgtgtgctgcttgctttggaaattgggcttgggtccaggcctagggtgagctccctgtccgtacaaacacaagatcagggttgagggtaaggaaaaaaaaagcttaggaaagctgggcccaaaactggagcctgtttgtttttcctggaaatgcaaaactgggcccgtggagcagcagtgtcagcatcaggggggaacccttaaagcagcagggggtgggcccaggcacccaaatgattcttatggccccagccaggaaaaatggcagtttttaaaggagaaaatgtttgagccca

SEQ ID NO: 564986 - DNA, 688 bp, Homo sapiens
ggttggagtgccaatagaaaatgaaaacaaatgccttgtatctacagggtcagtcctctgaaaggtgtaccacgataactagtcttcatctgtcgaccaactcggagttccctgtcttgctttgtgaagaaggggcttttgtaaccttgctaggcagatgccacctcaggaagttcacactgtgcaggagaacaggttttattctctcctggcatacattagaatgtcacgatgcttgcttccatgtggaccacgatggggctctaaaaattggtgggcacgggggtttgcttatgagttctctctggaaaccgattttactcctggatgctattgaatgccccttgagtcttaatgagtatacgagttccacatggctaaaatgttagacagtggagttctacagaggattccaggaagaggccatgtctgtgcagatcctagttccagacaggtgagatagctccacggaagctactggtctagcttgacatagtctgggtacaatagttactcattctcgggtaactggcttgaaacatctgacttctaggacgagtaattcctggggtactgtctgtggtagcatcaccagggatatatgggtgggacagacagagtacacacagctgcctgttctctcctgcccatcgatgtttggaccactagatgacgctgtactcagcaa

SEQ ID NO: 564987 - DNA, 398 bp, Homo sapiens
  misc_feature (7)..(7): n is a, c, g, or t
aagcttntctagaggatccctttcttgccaaagagttgagacagggcttgagctggtgtacaggacggaggtggtgaagaacaacctgaacccggtgtgggaggctacaaagtctctctgagtaccctctgcagatgcgaggagacaaggcctctaaagtgcctggtcttgggattacgactctcgatggaaagcacgacttcatcggacgaattctctaccaccttcgaggagatgctgaaggcctttgaggaaggggcagtgcccaagtgcgcctgtgtgaacaccaaatacaagcatgaagagacgcagttataacgaactcagagagtggtcgtccttgtgcagacctcaagttccacatgggtgtactccttccttggactatatcatgggcg

SEQ ID NO: 564988 - DNA, 302 bp, Homo sapiens
ctgctgaaagaaatgaaagaaggtctaagtatggtcatgtattgcttaaccatgggggcaccttctgagaaatgtgtcgtgtaagtgaattcgtcgttgtgtgaacatcacagagtatacttacacaaacctggatggtatagtgtactacacatctaggcaatatggcatagccttgctcccgggctacaaacctggacagcatgttactgtattgaatactgtagacaattgtaacatgatggtatttgtgtatctaaacatagaaaagatacagtaaaaatatggccttataaaaaaaa

SEQ ID NO: 564989 - DNA, 181 bp, Homo sapiens
ggtgagaaccagatggttagtattgatgaaatgtgcactgacttttcatgtacaatgcaagctagcgagcaatctctctgtcgcgacacacagacgatcaacctctcgataaatcgcaaaattgcgcacaagagatgtagatctacatgacacatcatagtcaacatatattactaatggc

SEQ ID NO: 564990 - DNA, 196 bp, Homo sapiens
actagcgcttatgagtctctatgatgattaacgtttctaagatatctgaagcaccattcagaaacttgttttggggaatgtgatagttattgatgtgcatctgtataaactgatgacagacataactcatcattccccagaaaccttttgtgattacagtatctaacattttgcctcctcttttgtggttttgctg

SEQ ID NO: 564991 - DNA, 566 bp, Homo sapiens
  misc_feature (167)..(167): n is a, c, g, or t
  misc_feature (173)..(173): n is a, c, g, or t
  misc_feature (175)..(175): n is a, c, g, or t
  misc_feature (180)..(180): n is a, c, g, or t
  misc_feature (186)..(186): n is a, c, g, or t
  misc_feature (201)..(201): n is a, c, g, or t
  misc_feature (553)..(555): n is a, c, g, or t
  misc_feature (558)..(558): n is a, c, g, or t
  misc_feature (560)..(562): n is a, c, g, or t
gaaacagtaactccctccacacactacctcatgcttatatcattaacagtgtaactcttggagattgtgcacacccaccaaaagagaattgcttgaacccaggaggcggagtttgcagtgagctgacatcgcatcactgcactccagcctgggtgacagagcaatantccatntngaagnaaaagnaaaaaaaaaaaaatncatgcacagaaaaaaaagttcaatcagtgcataaggacatatgcaacaagtctccctcctactgtttctcctgatctgcaggtcccctccctaatggcaatcactgttacagtgtaacagagattctgacataatcttattgtatgtatttccttcacccccacgcatggaaacagtaactccctccacacactacctcatgcttatatcattaacagtgtaactcttggagattgttgcacacccaccaaaggagaattgcttgaacccaggaggcggagtttgcagtgagctgacatcgcatcactgcactccagcctgggtgacagagcaatactccatctcgaagaannnganannnaaaa

SEQ ID NO: 564992 - DNA, 479 bp, Homo sapiens
  misc_feature (80)..(80): n is a, c, g, or t
  misc_feature (86)..(86): n is a, c, g, or t
  misc_feature (88)..(88): n is a, c, g, or t
  misc_feature (93)..(93): n is a, c, g, or t
  misc_feature (99)..(99): n is a, c, g, or t
  misc_feature (114)..(114): n is a, c, g, or t
  misc_feature (466)..(468): n is a, c, g, or t
  misc_feature (471)..(471): n is a, c, g, or t
  misc_feature (473)..(475): n is a, c, g, or t
cccaaggaaggggggaaattttacaagtaagttgaaaatggcgatcaatggccctccaggctgggggccagagccaatantccatntngaagnaaaagnaaaaaaaaaaaaatncatgcacagaaaaaaaagttcaatcagtgcataaggacatatgcaacaagtctccctcctactgtttctcctgatctgcaggtcccctccctaatggcaatcactgttacagtgtaacagagattctgacataatcttattgtatgtatttccttcacccccacgcatggaaacagtaactccctccacacactacctcatgcttatatcattaacagtgtaactcttggagattgttgcacacccaccaaaggagaattgcttgaacccaggaggcggagtttgcagtgagctgacatcgcatcactgcactccagcctgggtgacagagcaatactccatctcgaagaannnganannnaaaa

SEQ ID NO: 564993 - DNA, 785 bp, Homo sapiens
ggccgaggccgggtcccctcccctacgcgccccaggatggatgatgccctgcgcccgggtggtctcgtgctgggcggcggcggtcggcggccactgatgactcctgacggagccgtctcgggttccgtgcgcgaatgctggttcttgccgatcgcgcggctgctctgcgcctacgggcttcttcgccaggccatcaggccgtccgagccgctttccttgatcgcccgtacctgctggggtccggacaagaacctgaccgagcacgggatggtcttcaatgaaatttatccagtatggactaacgtctataccttaggttgctaacgtggatttccgtgtgtccttgccacagactacctccgttataaacctgttgttctactgcaggggctcagcttatgtacatggtttatgctgtctatgcccaggactgtggcattcaatttctagaatttttttatggatcgcacagccactgaaaagcctattacctaattacaggggggacgggcatgtccaaaagcacaagtacgtcgaagtgcattggtgggcttaaggggtctgtcctagggcaatctgtctcagggcagcgtcgctgtcagctgaatgtcatctctcttactgtgttcagggtttgtgggccggtttacctatcaaaaagctcttttacacatcttaactggcaaaggatggccccggccaatgggggtggacgaacccagttacactctggggagctgataaacccaaaaggaccggagcacaaacacaagctttagaaagac

SEQ ID NO: 564994 - DNA, 906 bp, Homo sapiens
  misc_feature (9)..(9): n is a, c, g, or t
  misc_feature (181)..(181): n is a, c, g, or t
  misc_feature (194)..(194): n is a, c, g, or t
  misc_feature (200)..(200): n is a, c, g, or t
  misc_feature (210)..(215): n is a, c, g, or t
  misc_feature (321)..(321): n is a, c, g, or t
  misc_feature (412)..(412): n is a, c, g, or t
  misc_feature (468)..(468): n is a, c, g, or t
  misc_feature (470)..(470): n is a, c, g, or t
  misc_feature (535)..(536): n is a, c, g, or t
  misc_feature (539)..(539): n is a, c, g, or t
  misc_feature (553)..(553): n is a, c, g, or t
  misc_feature (608)..(608): n is a, c, g, or t
  misc_feature (633)..(633): n is a, c, g, or t
  misc_feature (635)..(635): n is a, c, g, or t
  misc_feature (657)..(657): n is a, c, g, or t
  misc_feature (789)..(789): n is a, c, g, or t
  misc_feature (792)..(792): n is a, c, g, or t
  misc_feature (805)..(805): n is a, c, g, or t
  misc_feature (819)..(819): n is a, c, g, or t
  misc_feature (823)..(824): n is a, c, g, or t
  misc_feature (837)..(837): n is a, c, g, or t
  misc_feature (844)..(844): n is a, c, g, or t
  misc_feature (859)..(859): n is a, c, g, or t
gcttaatgnactatatgcacctttaaggtgagcataacacaagaagcctatatttagcaaggaagttaatttgtttgtcagcaagtctaatatcttagaggaaatatttatttcaaaagtaataactaatgtggtcatattaattaatcagttaacagttacaatgatggaaacccttaanattcatataaaanactgcnattccatttnnnnnncttgcatatttcacaattatatgttttccaatgatctattaacctaaactaaaaattaaatacacattaattcatcaacagtgatataacttcaaggctgagaaanatgcactaatcacaaagaatttcaattaaatgatatcaaggagtccagagagaagaaatatttcctgtgggagaagttctaattataaatnactgcgtattggtttaaagactaacatacacctagctttaccaacacttgtgaaananattacacattacatactttgttcaaagcctaatatgaaaattgtaacaaatcctctactgaaaannaanagtgactacctganagagattcataacatctcattaacaaagcaaaactgttaaactaaaaaggttcanaaaaaaaagtcttcagttacaaacnanaccgccctgattattccctatnaccgcttcttaaacaactaaaaaaatattttgtcaattgaaaaaacatcactgaatcaatgagcttttgatcattttattcacaaaatataagcgagacttacatccctttctggtgaaagttttcaaatanttntatgggtagggcnttgagatgtatcanttannaaaacatgttaanatgaaanattttttaaattacnaatacaaccaatactttatacaagattctctataagttcgtcaagta

SEQ ID NO: 564995 - DNA, 292 bp, Homo sapiens
gctgcaacctctgccgcctgggttcaagtgattctcctgcctcagcctcctgagtagctgggattacaggcacctgccatcacacccagctaatttttgtatttttagtagagacggggtttcactatgttggctggccgtggtcttgactcctgacctcgtgatccacccacctcggcctcccaaaatggtaggattacaggtgtgagcaactgttgcccagccaggcaaaggtttttaagtcttgcaggatctacatgatcctacctaatctcttcaggcctcccatacg

SEQ ID NO: 564996 - DNA, 272 bp, Homo sapiens
atattattctttagaaggagtgagtagtgtacaggagggttaaatgctttatagacaagaaaaaaaaaatgcgctaaaccaacttattcatcataatcatcttacttcttcatcttcatcttcttcatcttcctcctcctcctcatcctcttcatcttcctcatcttcctcctactatccgttcttgggctatgcaatgatacagactatgacaactccctattaagagatagcatcaggattaccttaaggtcgatagtgcagcaaatatc

SEQ ID NO: 564997 - DNA, 945 bp, Homo sapiens
ttgtgaaggaaggaatgtcgtctcgttcagcgcgtaccaagcagcgcggtcaagcgagaaaacacggagttcgccccttaggtggcgaaatgtgtcggatgcgaatagcgctggctcaggcgtacagagcagcagtgcgctggtaacgagaatgcctagcggcggggaactagtcgcgcctgcagctgcgtcagcgggaaggaaggcaagtgagaacagaacctgagacgtgacacctgcacctcagtcacaagaaatacgtccacattggattctaccgggggaacgacagtgggtcagaaagactctaccggaacatctacctgaccacatacgtcgaagaccatcttaagaagcaaactagagcattgccacaggacttacacctgagtagaactcgctggccagacagaaagatacaccaagaccacacccattgtgccgcttgcgtgtcctacaccaagcatacaatggcattcccttgaaacagaccagagactggcaaacaggggtcgaatgggcgtgatcttcgcatttgtataggtgcatcacatatagcctgggggccgtctgaggataataacggaagtttcacggagcactccgtcacaaaaaagcccgcgttcaaccgggtctttgcggaccaagaatgatctggaacccgagtgagcccaaatttctccatggagggccatcggcatatatccggggaacacatcgcctccactcggctaccagttagacaaacggggaacgtgaacagacacaaacacaacatacgcagcaaaccgccccagcacacggagcaacagacggcagcgtaacagcctcgactctcagaacaccaacgacgactgtcacgactgaaatgcatcgtaaaatctcagccccccttcatgcctctccaaatttttactacatacgaacaaaaaaaacaaagaagtg

SEQ ID NO: 564998 - DNA, 219 bp, Homo sapiens
ggttaatgtgctatagtcctgtaagtcaatagtcttccatatataattgtgttacatatatagctggtagactctcagaaatcaagggtagagcttttcctctgagcagtttaatgagtgattcagcagcaaagtcgcagaaatgggtctcagccagagaggtaatgttatctctgattgccgtttctctgcacaagtatatcgtattcagtgagaggt

SEQ ID NO: 564999 - DNA, 314 bp, Homo sapiens
tatggccatggatggttcatggataatcaccatgagcagtgaagcctgctgctatccatgggtggagtcatttatgcttgtcacctgcaatgttgccaagatgaagatacttgagagacacattcttgacattgaagcccacattgtacccgcagagaagagcttcgactcaaagcttcatgttgcattgtctgacagaattaacttccgttgtaacgtagactggatacaaaggtgcccaccataccgggttcgagaactccagtcatccactcggacaccaggaacagtctcaataccacgcaactgatgta

SEQ ID NO: 565000 - DNA, 116 bp, Homo sapiens
ttgcgaagtttccgaaagctagggtgactacatatgagattgtttgggctactgctcgcaatgcgccgatcaggcgtagtttgagtttgatgctcaccctgatcagacacatggag

SEQ ID NO: 565001 - DNA, 167 bp, Homo sapiens
cagcgtgcctggggcgagatcgcgcccgccgatcgcctgctgctgatgatcgatgacagcgtggaagccggcgatgaatggggcgatgaattgcgcgaaatcctgcgcaagctgccgcagggcctgtccatcaccgtggtgcgcaacaagatcgacctgagcggccg

SEQ ID NO: 565002 - DNA, 302 bp, Homo sapiens
gcactaccatgattaactgcgggatagaccacaacccttctcttatcatcctttcctgcagtactgcttccagctttgctgctatcttgcctgcaattaacccacccacttgtaccgctgctctgcacaatgaccttcaccactacgatgatgtaccacccttcacttaccctgtactgttacgaacagcacgtggaagaaccctaactagctgcctgttgatttttaaccaccagagcctgctggtgcaggtccgcagccaccagatgcgtataaatcgcctttacaggaaccggacgcat

SEQ ID NO: 565003 - DNA, 974 bp, Homo sapiens
  misc_feature (212)..(212): n is a, c, g, or t
  misc_feature (465)..(465): n is a, c, g, or t
ccggagccattgtttcgcagggcacagtgtgccccattgcctatttggtgcgcactgatgaccaagtgtggtcgcagaagacagggtggggcccctgcccgggcaattcccgcggtattgttgtgctcccccaccgggtcgccgcggcgttttggatgacgcacggatggttttttatcgcgcgcgctgagagttggtgtgtggacccctcnccccacgagggagcgcgtgttctatgtgggcgcggcccccctttgttccccggggagtcaccacagtgctgcacgccgatatggcccggggtgttcactaatatgcgcggcaccatcttcgctggatgaagatgccccccaggatcctcggggggggggtgccgcctcatctacgcgcctggtggggaatatcaccaccactaggggggggagaggccccttcggggccctttcattctcaacgaaagggggnttgttccccagaaggtcccccatccccccccgggcgccttggctcattctttcggtgggggggagaactctctcgtggtgttttgttgttgtgcagaccacgtgacacccccaccacctgttgttgttgatttcttcacaccgggccgacacgggaaactttttttgttttaaaatatgtgggttaaaaggcatggggggtggtgcccaccacaccccgctgtggtccactaccccccatacacgggagtgcagcccgcttagagagttcaccccatacaacacgcgagactgtgaatattttcacgacctcttaaggggaacattttggatgttttgaccacttcttttggtttgttgtttacgagggctctttcgttaattgattttttgtggggtttaaaccaaacgcggaaacccccccttgtttttttttttttccaaaattttcccccctgttttttttccaaaacccctccctttaaaaaaaaattgagcgcaaatggttta

SEQ ID NO: 565004 - DNA, 133 bp, Homo sapiens
cgggtctagccagatgaagagggtcccaagcactggaccaaagaaaggaccagtttctgatgaagctgaagcaggaagccctcacctgtgccaggaacgggggggccgactatatcctgttcgcagacccagg

SEQ ID NO: 565005 - DNA, 845 bp, Homo sapiens
ggatccgccatcttggcgctgtgggcctcgcgtcggttggagaatcccgaacgtgaggtagtatggtgggccgcgttctgtgtccttgagtgctctttagcttatacctgtctaggtccactgatggccgacagttatactagcaacactggtgatggaagatacagccgcgtcgtctgtccgacaatccgctgggacctcggttgctgctctatgaaggcaaccgtgtgcgtactcagaatataggcattctgagggcgaactttgatgtgtgtaaaagctcagcagtagtgatttgaggttaggacagtgtctagccctcatatttagctgcaggcgtagcagtgccgtgggattgatcgttgggctcattgcagtccttgactcctgtagcttcaacgcggatcctcttgctgaagccgtgctgtgagagtagcatgagacctacagtgttggtgtataaaacagaccaaggttcgacgagtgtcaacagcaacgattgaggaaatttcccacagtcaattaatggggaacttatgggtaagccaaggaaagcccgcaattgttccccatggaaactgagtgactggtttgacatgaagacgttgtgtgcggggtacttcccgggaaagtcaaactatctttgtggagttaacgagaaactgtgtttggcgagagaaaagtagcttatgttagtaagtggggtgtccgaaacctagaggtcatggtgcgacttcctttttatccgcttggaacccaggggtgcaatggttcccgtggaagccttatttacttgggacttggacagaatgcctcgcttaaacaggcgactttggcggcggaca

SEQ ID NO: 565006 - DNA, 590 bp, Homo sapiens
tccccgccatttaataatttcctggacaaattttctcttattccccccccccggaacaattaaattttttaaaaggctccctccctcatagaacacccactcgttgaccacacactggtatgtgtctcgcaccccccccctctttgttactagctccaattgtatatactttctctccctcccctaatataatcgttttcttagagacaacatcttggcacaacaaatcgcctcttaacaaacagttgttccccggcgcacacagcgtcacctacgagacttgtttatcatcactgcgaacataaacgtcccctaagagtaggttggttttctccccccaaggattatcctcacccgggcggttcttgccccgcacgaatcatgtaccacttgtggcgtaccccgtggggaaatctgttgtgcggtatatagaaagatgcaaatcacctaattctttttctcctcacaccacgcgcacaccactgtgctgacgcccctctttaaaatcttaggtcccacctcccttttgttgtcgattcttcacctttaaaaaaaggaggtatttatctttccacaacaataaacacaaa

SEQ ID NO: 565007 - DNA, 236 bp, Homo sapiens
  misc_feature (6)..(6): n is a, c, g, or t
  misc_feature (14)..(14): n is a, c, g, or t
tggggnacctacgnaagtggttgaaagaacttgttcctttttgacctaacaatactgacactgtttcagactttcagatgcccaaattattaagatcattaagaatgtcaaaacaggccgggtgcggtggctctcacctgtaatcccagcactttgggaggccgaggcgggcggatcacgagtcaggagatcgagaccaccctggccaacacggtgaaaacccgtttctgcttatt

SEQ ID NO: 565008 - DNA, 460 bp, Homo sapiens
  misc_feature (75)..(75): n is a, c, g, or t
tagaggatctcctcccaccagcaaagacaaaggatttttgtgtcttatcttcccttacagccggcaataatagcnatcgccccaacaataaattttccaaaggagaaacctacacagctcccccggtggggggcagaaggaatgtggggagaaaatgttaatggatttttctgcagtgtgatactatgggcttatcaaaggcttatcataccaggcagaggcgaggtgcgcccgaagagtatttggagggcttggaaaacactcctggtcttttgccaagggtaaggctgcaaggacttgtgaaatctatgattgatgaggccgactccggaaggtgtaagaatgggactgagggcagaaggcgggcagagagcaatgggagtttgcaggggacactccgggaaggaagcccggagtggatttgtgaaaccagatctctctcagcactcccggatgctct

SEQ ID NO: 565009 - DNA, 297 bp, Homo sapiens
catggcaagctcccctccagggttcacgccattctcctgcctcaggtcccaagtagctgggaatacaggcgcccgcaccatgcctggctttttttgtatttttagtagagacggggttttgccatgttggccaggctggtctggaactcctgagctcaggtgatccatctgccttggcctcccaaagtgctgggattacaggtgtgagccaccacgcctggcttgttttactgtttatgacgcggctctgctgctgctaggacagatacttgtacagcccgattcaaagagtcgacg

SEQ ID NO: 565010 - DNA, 260 bp, Homo sapiens
  misc_feature (142)..(142): n is a, c, g, or t
  misc_feature (151)..(151): n is a, c, g, or t
  misc_feature (174)..(174): n is a, c, g, or t
  misc_feature (234)..(234): n is a, c, g, or t
  misc_feature (252)..(252): n is a, c, g, or t
aaaatccacctatgcagggcacagtggctcatgcttataatcccgacactttgggaggctgaggagtatcacttaaggccaggcgtttgagaccaccctgggcaaaatagtgataccctgtctctacaaaaacataaaaaantacaaaaantcagctaggcacggtggcatgtntctgtggtcctagctacccgtgaggctgaggcaggaggatcacttaagcttaggagtttnaggctgcactccagcctnggggacag

SEQ ID NO: 565011 - DNA, 273 bp, Homo sapiens
  misc_feature (5)..(5): n is a, c, g, or t
  misc_feature (17)..(17): n is a, c, g, or t
  misc_feature (127)..(128): n is a, c, g, or t
  misc_feature (263)..(263): n is a, c, g, or t
aaaancagttggtggancttcactacgatgccatctgccagtacatgggccctagtgacgcagatgatgactgacccatgggactcctcccatgcccccaggctggtgccagttctgtcccatatgnnacagttgccttcagcagctcggaagattattgttccatacctctcacttctggtgcagtcctggcgtcaaggacaatgggaaagggatgggtgaaccagttgggaagctcagaaacaaacccaatattttccaanatttagggta

SEQ ID NO: 565012 - DNA, 196 bp, Homo sapiens
gggggggggggaaaaaaaggggcttctccccccccccccctttttttttgggggaaaaaaggggatttttcccgcgggggggggggggaaggggcccccccccaaaaatttgtttcccctttttttttttttgccccccccctttttttttttttttccccccccgtttttttttttttgggggggggggggggga

SEQ ID NO: 565013 - DNA, 873 bp, Homo sapiens
gatagggagcagtttcgctggtctggatcctccaggagctggacaatcttgacgggcttttatgtcttgggtaccagccccctttcccttcctcctcctccagatgccttatactctgaccctccatcgcccgggtacagacatttccagcgcaggctggtgatcgtggtagtccgtcgtcgaagcaacatatcattgggattacggctcgtttcactctggggatgttgttgaggagggagagtgcccccctcctccacgatggaatgttactcccttgccgaaatggacttgcatggatttctacttacttccacgtttagtgaccaattccctaggcgtatgtcggtggtagttccatttattcaaatacatactctgtacaatggagaacgaaatactaactccccttctggagcagttcatgaccagccctttggtcacttggctcaccaccgtttggacctctggccgcaggaaatgggaccaaccttgatgaatatgtggctttgctggatggggtatcttgaaccaaggtcatggctcccaatttaatcctaaattggcagacgtcagcgacgccactcaaacaagtcaacaattgctgcctcaattacgaatggcgaatctaatacattggtgacaacaggattgaattcattaccaggcgcacttggcagcttggttcatggatggtgtgggccagatgttaaagtcatgtggaagacatcctttcggagccaggccagaggaagtaacacgggatagactaatggggtgcgccgcccaggtacaaaacagaggatatgtgagacctacggtaacttgagacacacaaggggccacaatacaaggggacacacaccgaagagg

SEQ ID NO: 565014 - DNA, 700 bp, Homo sapiens
caagtcatcaatacctgttctctctgtaagggcagtggtgagggactgctgtgcagacccaagcaatcccaacctggtgctaggtcatttcacttttctgaaaacctcacatcaggctgcatcctcttctgtccctggcaccaggcttgtattacacttggagacaccttggtgtgggtcaccgggacaggtactcactctcctgcaaccagcctccccttccccgaggatgtggtggctgcagatctcaggaagagcttggtacttgtggggacattctgtttttctccctgtggagatcagttgacagactgagaggcaaagctgccttcaacctgagtccggctcttcagccagagctgcacaagatggcagcacactaattctgcgtgactccaggctgggctctcacacccaagattaggtctgctctggcctaatggatcttacatgtataaccgggccggctgcccttggattgtacaaatgctatagtggatgcccccgagacacttgacatactaggccgagaacgaacctgctagcttgacataaccccatggggataatccttagggttcaggaatggtcaacagagaagcgaactccctcgactgaacaatcatactccagccagcacgatcaagaatacctgagccaatttcgtcatacaatcaggagcctggactcttacctcagt

SEQ ID NO: 565015 - DNA, 404 bp, Homo sapiens
atcctggctcaaaaacagtaaaaggatgacttgtgcgggtagggaggaaaatatgatcgtccccctctaccagaatatatccaatgtccccctaactgaggatacgctggttagaatttggtttacaggctactggctgacaagcatcgatgtaggatgctcagaattctcctctcagtttgtccttttgccccagagcttatagtgaccctatagcgcaaggagcggagtacttccttgctttaatgcattaatccggaaggcagctggaataatggttcagatcattcttacgatggttgttatggaggatggggtgggcattgcctaagggccgggtctttgctcctcccccagctggagcctcctccccctctgagctctctgtttcttcccggtcgctg

SEQ ID NO: 565016 - DNA, 564 bp, Homo sapiens
  misc_feature (27)..(27): n is a, c, g, or t
  misc_feature (61)..(61): n is a, c, g, or t
  misc_feature (93)..(93): n is a, c, g, or t
  misc_feature (99)..(99): n is a, c, g, or t
  misc_feature (116)..(116): n is a, c, g, or t
ttaggtttagatatttagttataaggnagtaatgatattggtgaggaaaggagggatttgntaatataaggggtaaatgttaattattgggangaaagntgaaaatgaattgtatnttaattatatattaagttaaattttaaatgggtttaaaagtattaggaaaaagtgaatttttttattattggggagtgggtaaaatttttttaaatatgatttaaaatttaggagtgataaaagataaaatgtatattgggaaaaaagttttataatatagtatatttttaaagtgttggtgatttgagtgggaagtagggtagtgattgttggggattgagggtggggggatggtgttgaatgggtgtggggtttttttttggtgtgatgaaggttttggaagtatatagaagtgatggttgtatgttatgaatgtattaaatgttgttaaattgtagattttaagagatggttaaaatggtgaatttttttaattatttataggattttgataaaaatgttgttttatgtatattttattttaataaaaattataatttaaaatga

SEQ ID NO: 565017 - DNA, 185 bp, Homo sapiens
gtggtgaatgacggcgtgaggcacctcgactgcaactacatctccctcatctacaccaactataggcgggcaaggatgactattaaaggcactcccgggcactgaagccttttgagaccctcctgtcccagaaccagggaggccagaccttcattgtgggataccacagtctccttcgctgacta

SEQ ID NO: 565018 - DNA, 1241 bp, Homo sapiens
gggtacctgcaaccccctagccaaacccgtcgcaaggtgtcgtcgagcatccaggcctgtgccggcttcacgtggcgtggaagaccctctgcaaggaggagacagagcaggcccctccaggcccaccagcccagtgttcccgcagagcccatttggatcagacattccccgacacgggcacctcgttacttccacaccctgtcctggtggggcatgtccggagaagacacctaaccctgatgggcactctagggatgtgcaccagacccaggccactggctcaaggggaggacctcagggttccatgagagcattccttgcaagtaggaaaatcacatgcacccgacattcaccaaacggaacctgtgcaccgatagaaagggcccacttgaattacacggaccacaattcagtgatacaccacaaaacagacgctgctagggtcccgtgcccaatattcaccagggagagaccacagcatggccccccctgcataggcaaagcatgaaacaaccccatgtaggaggcggcgatgcagactccagacataaaccgctggaacacccagacacctgcattcccgacacaggggcaaccccccattgcagacgactacgaggaacggaacaccagacccgtgatggactcccccaccctccacgggaccctcagcaccatctagacagtgaccgtcccacaataggaaaaaagttcctcaaaggaagcaccatcccagagcatcaacgaaagccatccggcgaacaagggactcaatgaactggactaactaacccataggcattaacaaagccaagccagcattcgaaaacgacggatcaaataggccgggataaaatgtagggcccaggtcattaagcacagacatgcaggctgacagcagataccgagccagggacgcaaacagaaccccagcatcgcaagccaacaagggccagcaagtccaaaacccaagaacagacgaccacgcagctgcaaccgaccaacggacaaaggaatggcaaacacccagggggcagagcgcaagaaagagaaaggaaggcgcagaaaaacaacaagcacgcaaaagaaaaaaaccaacgaaagaagagggcagacagcgaggcagaacaaaagcaagtacagaccaaaaaaagagagaaagaaagagaagcggcgaacaggaacaacgacgagaaagaagaagaggaacgacagacgcgacatagaacgggaaggtcgga

SEQ ID NO: 565019 - DNA, 247 bp, Homo sapiens
acgggggaacgctacaaactaaggtccataacagctacggataaaagagatcgtgcgttctcttttagctttatagcctcattcatcccagaattgaagaagccagaaatccaacacaccaatatctacacacaaaaaattactaacagatgtaagcagttatcagacacagatccaggaaaggaggagcctcacaaagcataacaatttacgacagcaacccctctactccagtcaaacaccgtag

SEQ ID NO: 565020 - DNA, 103 bp, Homo sapiens
  misc_feature (18)..(18): n is a, c, g, or t
  misc_feature (44)..(44): n is a, c, g, or t
  misc_feature (101)..(101): n is a, c, g, or t
ccaaaaaaaaaaaagaancctggcagctatagaatacactatgngcatataatagctaatatattgtagtatcaacatttttaaattaaatgttttacatncc

SEQ ID NO: 565021 - DNA, 910 bp, Homo sapiens
cgcgagctgccgtcggctccgcagggcggggcgtggtcgggccatccaccgggctcgcgccagtgatcgctcctcgtcttctctccttccgcctcttcacggaatcgctgcaggacacgttgccgcgctgaacttcactggcatcggacacgacgcctgattcctactcaatccgcacatgtaaaatgtgccccgtgctgcgcagggcgacgtgctcacccgttttggaggtcacgacgcgagaagcccggaggttgcgcgtgatgcttggccgtgctcgctgggtcttggatgtcgggttcgaccacttggccgatgggaatggtctgtcacaattctgctccttataaaatttgtccagccacacgtaactgacgatgctcctttaaactaaaggcgttaagtgttcacaacgttataaacaaacaaaaagacaagaagacacacaaaaacaatataagaacaaaagaacaaaacaacaaaaagagacacaaaaaacaaacaacaacaaaaccacacaaaaacagacaaccacaacaacaaacaaacatgacaatgacagcaacgacccaccaccacaaagaaaagaaaacaaaaacacaactaaaacaacaaaaaaaaaacaaaaacaaaaaacaacacaacaaatactaaaactcaaaaacacacaacaacgtacaatataatatctacatccaaatcaaccaacaaaaaagaaacacacaaaacaccaaaaccaaagaacaaaacacaaccaaatcacaaaaaaaacacaacatcactaaataaaaacacaaactaacaacacaaaaccaccacaaccaccaacaaccacaaaacaatcacacgaaaaaacacaacaaaaaacaactaacaaaccaaataaacacaatacacataacaccaacac

SEQ ID NO: 565022 - DNA, 934 bp, Homo sapiens
gcgtagatctcgccggcgttgacgttcatctgggtgtctgaagtaccctccgctattctctgcctaggcgacgagacccagtggctataatggtatacagcatgtctatactcgagatccgtgccggggagatctgcgaatcgcgcggggaatgccacatggttgaggtctcgatgctctgtcatcgtcatgaaggtctctgtcagagctgttgtgcccagtggtgcttcagactggtcatcgtatgaggtgcctagagcatccgggacagtgatacatgactcgcgtatatggggaagggggtctgcgaaggtctggtcgtagcagcatcgttagaagagctgaatggcggcctgtccgctggtggatgcacgcaccgctagaacgtgcacgagaatcaacgaggagagatggcacggagattgcatggatgcgagagtggtatggtagaccagagaaatacgatctaggggttgggctagcgagagcggctcagtcctcttggagggcggtagatccgcgtatgcgctgtccatggacatagggtctgggtggccgagcatgaccacatgagagaggtcgccccacctggtgaaccagcgcgactaggtccgacgtgagtcgatcgagactgagtagagcattcgtcgataggatcaggtcgactaggcacgatccccctcgggggtaacagatgggatcccaatcgcagacgtgaggcaggggttctcctctcactgggcctggaggccaaacgtaaaggctggggaccagtcgccacaggaggaaggtttccacttggaatctcgttcccccagggatcggtgttggccatcgccaacaagcgttgcaggcgggaaaggcccattggcggccattttggtgtaagccggagcgacgggggttttaccccgactaaaccctggacaggaac

SEQ ID NO: 565023 - DNA, 1201 bp, Homo sapiens
gagacgatcttcgccgagagtcgtcggggtttcctgcttcaacagtgcttgtgacggaacccgagcgctacgattccccaccaccggaacggaccgacccatagaccagccctccgtcacctcttcaccgcaaccctcggactagccccaaggaccccgactctaccttaagtacgccgccatgacagaccgcgatccaccatcgcaggtgcagccagaacataccaccaggactcagaggccagccaatcaaccgccagatcaacactggagactctaagcctcctacgataaaacctgtccactgtcttaactactttgaccgagaatgatagatggcattagaagcacactattgcccatatacatttacatatacaccaaatctcatgcaggagagggaacaatgctggagacaacctgactgaagctgcagataacaaaagaaggtgaaccgataatcattccatattcagggcattatcaaagaacaacccagactggatgatgaatgggacgcgcggtagcatgaatgccaaatggatatgtgcaattataaatataggaaaacaaaatgatgaatacaaacaaaacatgagaaactgaaaaaaaacatggccaatgacaacaaaagaacacacaaaaaaagggagaacaacaagaaaaacaacataacccagaaatgaaaaggataaaaagcaacaaaaagaaagagaaaacaaatgaacaaaataacaaacaggagcatagacaccagacagtcagcacatggaaaggagatataaccaatagacaagcagcaccctgggcacacagaaacatgacagaataaccaaggacaagaatcacccaaagaccggagaggacacactggaaccaaggggacgcgtacaaatgagaaccaaaacaagcgtacagggacaaaagtacaaaagttcgagagtacaacatgacaagagggaatcacaaaacataaaacaaaggggaagtcacgaagatgaaactgggcggaccagataaatgagggaaaaaaaagaagagagaacacagggatgagtaatgaggaggaacaggcacaagaagaagtgttctacaccagagcagcgaaaagtcaccactcaccagtaacgtgaagaggaaaagcgagggacaaacaaaaaagaaaaacagataggacgaatgggaagacataagtaaatag

SEQ ID NO: 565024 - DNA, 771 bp, Homo sapiens
  misc_feature (207)..(207): n is a, c, g, or t
  misc_feature (225)..(225): n is a, c, g, or t
gctccgtgatctcttcgtctttgcggcgtagccgcgagagtcggtcgaggcgccgtgcaggatctcagcagccgatgtcgaagcccgcctatagtgaagcactgggacttgccattcagtatcatgacaccacgagacgagcttgcacgctatggcaatgagcatgaactacgatgcacttggtgcagccatatgtcgcgcagacgntggcaatcttagatctcnaacatacccgagtcgacatgactcgagaacagattggacggtctagtcgtagtgaccgatttggctcgcgtagcttgtcccatgaatccagatgggtaggcactggttgccacaggcagcatgtgatccaagtcttggagcacgtagcatctggtcggcatcagttccattgcaacatatcgtcgtctatacgggaactctcccatgcagttaactccagtgccgttagtatccatcgtaaggatatggtacgcggcacacaaaggccattggtacaaagctgtttgccttcataggcaactgctatcacgtactgtagcgtggcacagtgtgcatggtcggcattctaaaggatcgagttacaagggacctgtaggattccgtagactggggccttcgatcacaggggcgagcaggggcaacttgcgatgagggtgtgaagctgcaaggcaagggaagcccaactcttcacaaagtcacggctggaatacaccgctctacaatgggcaaacacagtgtggacgagtaacattccttgtggactgg

SEQ ID NO: 565025 - DNA, 595 bp, Homo sapiens
  misc_feature (322)..(322): n is a, c, g, or t
tggaggctccagggtcccgtgggggtgggggtgggctgcgtgaggacatccccttaccccctgaatttccatctggtccagccctctcatcttgtacgtgaggaaaccgaaggcccaagggagaaatgacttgccaggaacccctgttaaggaaaattaacaaagtgtggttattaaagaagaactgagttgggagtcagacctggaggcccacacccacagttaagacattataccaccttgagtctggcctgttgactgaaggtgagccactccatcctcatgtgattgtggggtcttaacctcaaagggtttcctacangaagaagcaaatggatttactttcctagctctatccagtacattagggaccctgatgactgaatagattcttggagagccatctggtatatatcatggatggatctttttagaaagtcaatctacccattagactaactcatcctgaatgaactatctataatctttaagaattatctatatacttttaaagacttcttcacctttcaccaaaagatcccgctgcaattaaagtggtaaaaccttaactttataagaccttatatttacctta

SEQ ID NO: 565026 - DNA, 128 bp, Homo sapiens
gagtgcactcaaaggaagtagaagaaagcctaatgctggaggtgtctaaagctgaccagactggggtgttgtgtgctacagatgtcagttgcaagaggctttgtacaacaggaaggcatcagaaatag

SEQ ID NO: 565027 - DNA, 175 bp, Homo sapiens
  misc_feature (14)..(14): n is a, c, g, or t
agcatttccagcgncgccagcgaggcctccttctcctacaaggaaaacctgagtggcgccctcttggcgatcttcgggcacctcgtgtgcagcattgcacttaacctggagaagtactgccacatccgcctggccggctccaaggatccccgaacctatttcaagaccaagacat

SEQ ID NO: 565028 - DNA, 235 bp, Homo sapiens
  misc_feature (208)..(208): n is a, c, g, or t
gaaggattggggccattcaaccaaggcagttcgccttcacagcagcttttccttcttattgggcttgaggacagaagacagaacccttaaaccacaggttgcttaaaagccaggagtcaaaattacttagcgcttttacttccaccatttgcaacgaatctctcttgggcaggaggtcatcttcgggagaagcccttcttgcgtggtntctttgagaccttttcgcaacactgcg

SEQ ID NO: 565029 - DNA, 448 bp, Homo sapiens
  misc_feature (41)..(41): n is a, c, g, or t
  misc_feature (50)..(50): n is a, c, g, or t
  misc_feature (157)..(157): n is a, c, g, or t
  misc_feature (159)..(160): n is a, c, g, or t
  misc_feature (249)..(249): n is a, c, g, or t
  misc_feature (262)..(263): n is a, c, g, or t
  misc_feature (287)..(287): n is a, c, g, or t
  misc_feature (332)..(332): n is a, c, g, or t
  misc_feature (344)..(344): n is a, c, g, or t
  misc_feature (415)..(415): n is a, c, g, or t
  misc_feature (444)..(444): n is a, c, g, or t
acatacccatggggactgaccaccttagtgccttcaaaagncagtggatnctggctccttccaggcatatactgtttccaacttttatgcatcttcaacttacacactgtatttgcaagtttcttcaattccccctttctgtcgtcttctgcggcangnngacgacggccgcgaatttcgggcgtgcaatttgcggtgggtgtcatcaaagcagtgggacaagaaggctgctggagctggccaagtcancaactctgcccannaagctcagaagggtaaatgaatantatccctaataactgccaccccatcttaatcagtggtggaacaanggtctcagaacngtttgtttcaatggccatttaagttagtagtaaaagatggtaatgacaacaatgatcgtcctcagaagganggcgtgtttgtggaccttggtttctttgngggg

SEQ ID NO: 565030 - DNA, 173 bp, Homo sapiens
accccggagcttgctagaggcccagaccttgctccaatcagcctctacagaccaagctcatgactcacaacggactaagtagacccataccctacgggacgctaggttcagaggatgaccctactgcgacacaacagcttccacaggctcaggtccatcgttacaagcggcct

SEQ ID NO: 565031 - DNA, 119 bp, Homo sapiens
ttctttagcatttaggtgactgttcagcagttttctatatggccattgttggcctaaaactgcgctagtaacaagcatggtatttatcttgtattgaaaataaaaacaaagttttggta

SEQ ID NO: 565032 - DNA, 399 bp, Homo sapiens
gccctgtctcatcttggctctgctctccagcttggcagactctggctttccgagaagcccctttcggctgcttgggaaacggagccttccggaaggggtggccaatggcatcgaggtctacagtacctcaacttcaaggtgacctcccgttttgctcacaatgttgtcaccatgagagccgtcaaccgtgcagacacgggcaaggaggtttcctttgatgtggagctgtccaagacgggcttcatcaccaacttcaccttgaccattgacggtgttacctaccctgggaatgtcaaggagaaggaagttgccaagaagcagtatgagttggagaagttcacagtctctggcaacgtggctgtaggcagcgtcaccttcgagctcctacgagggctgctg

SEQ ID NO: 565033 - DNA, 441 bp, Homo sapiens
ggcctttatggccgggaaggctttgaggcagccagcgcaggggcttttgttgaggggccagccgaacctggaggaacccgcagataagttttttcctcttggaaggatagagattattccacctccttaaaaattttagccattaggttcctaaaatatggcttaccgttaagtttttaccgtaattttaatagcttaggattttaagagaaaatatgaggacttaaaaaagtaccttgaggaaggaaaggttaaagggtttttaaaccatgacggaggttgaaatgaagcttcttcatggggtaaaaaaggtttttaaaggaaaattgagagaaaggcctccagagccccgaattattcccattggaagggcatggcttttagattaaaatgaaggtgacttaaccagtttaaagttaagtttaaaagttgtaggtgatt

SEQ ID NO: 565034 - DNA, 290 bp, Homo sapiens
  misc_feature (219)..(219): n is a, c, g, or t
  misc_feature (274)..(274): n is a, c, g, or t
ttatccaaagttaaggcaaaggacagaatcttaagagctgtgagacaaagcaccaggtaatctataaaagaaaacctatcatcagattaatagcaaatttctcagcagaaaccttacaagctagaagggaatgggaccctatcttcagcttccttaatcaaaacaatttatcagccaagaattttctaaccagcgaaaataaacatcatttatgaaggnaaggtacagtctttttcaggccaaaccaaaggcttgaggggaattttgccctttncctattcacaccccca

SEQ ID NO: 565035 - DNA, 979 bp, Homo sapiens
  misc_feature (1)..(1): n is a, c, g, or t
  misc_feature (3)..(3): n is a, c, g, or t
ncnccagtgcagagcggaagcagcagttttccgacgtgtagctggtgtggtatgtgttcgctttctctgggtgttgtgttcgggtagagaggtggtggtgagcgtggaccacgcggtccgttggacccgttcgccttcggggtcccccgcgggagtgtgtaaccgccccatgggcgtcttctcctttcgtagcggcgccctacttttgggggggaccccccgcacaacttggtgttcgcgacccctatcagcgctcccgtctcgcgctctcgcactaattcccggcggcttctcgccctttctcgccccgtggggtagtttttttcccgctcgcacataacaacggggggacccccgcaaacatggggacaatgcaattccagacggcagcggcaccacacttgggggttaccaccggtgactccggccccggcccaccagagcgccccgtcattgtccccccggtgggggattggccaccgcccacactttgcgggcggcgtcattattacctctaacacgtgagtcaggtcatgcgtttctctaattaagggcgcgcccaaattaacttcgcgtgtcggtaaccaccagtggcccggacaaggcgccggttgcaggggtatattcaacgagccaaccctgcgcgagctttcatggggcacccacgccccccgcggctcggggggtgcacctcatatggggcccccgcccctctccggcacctggaagcagacgtcccccactcagccgcgggacacgccaacaacacgggcgcggcacaagagggaatcatagcgcgtcactgacgccgggcgccccctttctcatggtcagaccacggacatctgttggcagatggaagaaccccgggtgcacgaacactgggacccggcacgagtcccccacaccgcgaagcccacagaccccaaccccgctttttcagggccggctcaaaaatatttttttgtcccacaaaaca

SEQ ID NO: 565036 - DNA, 104 bp, Homo sapiens
gggggtatcatgtctccatcgagatacacagtgggcaatggtggaggggctcgcgaacatggtatactggggattaagccgggccagctcctcgatttttttgc

SEQ ID NO: 565037 - DNA, 475 bp, Homo sapiens
gttttttcccacaggggggggggtcccactttggggggccggccctcctttttttggggggggggggcgggccccccgcggggtttcccccctcttttttttggggaacccggggttttttccggggggttaggggccccccggggtttttcccccggggggcccccacccaggggggggggggaaaagtggtttaaaaaaaaaaggggggggggggggcgggggggttttccccccccctggggggggggtccaaagggttttggggggggccccccttttttccccccccccccgggtttttttttataccaaggaacctccccaaggtaggggggggggggggtctccccggggggggatttgttccccccccccccctttttgaaaaggggggtttttttttttttccccccccccccccccggggggggggggttccccccttttttccaaaaaaaggggggggctttta

SEQ ID NO: 565038 - DNA, 764 bp, Homo sapiens
ccgattccaccaaatgtgctttgagcaaggataggccttcattaacaaaatgtatgtctggtcccccagtagagctctactgcctcaacccaaggggcatttttctgtctggggctagataacatctcaagttgattagaaagaccgaggccattgtcagggtacctggggccatgatctcagcctgctattgtcgcaattgaacatgtactttaatttatgtcttctgtggtaggtggaaaagcaacattcatagtcttcggagacatgcttagaaattcagcatttgacccttgcggtgaagtatgcccaattagtttcctgtatgtctatcctgtatgatccgtgtctgtgtgcaccaatgttcaatcagaggaaattctttcccaggctgtcgattgatgcctcagccacttgccggtgctacaattcattgtgtcctcctgtagattcaggtaatacaaactatatgtaatcatcaagtaatacaacatctagctttgagtcagtagcctgggttgagtattatgcagggcctgtgtctgctgtctgaaagaacccaattcggctgatgcgcttcagttttcagatcacattgctttcggatgttccatcttgcttgagctccaatttggtgtggttacccagagataactgtaatgtgccttggtttggccttctaacaggtccgtcgacgggggaggaatcccacccagggccaatcagggacctatccctatcttcccgaatttcccttttccggc

SEQ ID NO: 565039 - DNA, 550 bp, Homo sapiens
ggacgatagtgttatcatgttacttatactaacattcgtccttctatagggtgatagatctggtccaattggatgtgaggagttcagttatctgtcagtgcatatgtaggtcgtgggtgttgagcttgaacgctttcttaattgctggctgcttttaggcctactatgggtgttaaattttttactctctctacaaggttattacctagtgtccaaagagctgttcctctttggactaacagttaaatttacaaggggatatagagggttctgtgggcaaatttaaagttgcactaagattctatcttggccaaccagctatcaccaggctcggtaggtttgtcgcctctacctataaatcttcccactattttgctccatcgccgggtgtgctcttttagctgtacttaggtcgctcgtctggttgcgggggtcttagctttggctctccttgcaaagttatatctagttcattcattatgcagaaggtataggggttagtccttgaaatataatgctaggttaacatttccatctttcccttgcggaa

SEQ ID NO: 565040 - DNA, 137 bp, Homo sapiens
ctgaagtaattatttgaggtctggcagtacacattcttccccagcctttttttacaaattcccttcccttacccctgagcttgggaacagcctttcatccttctttttccagccctcgagaggagagagggtgttta

SEQ ID NO: 565041 - DNA, 881 bp, Homo sapiens
tcaatggggccccatgaccgactcgagactcaaatgaggatactgattgttaccggtgtttagatgggactatgagctggcatgcccatgtggcgggtatcatgcatcttactcacctgaaaaaaagcgtttgaatcctggttagttgtctggtcacatggagcgaattcatgagctcgctgcccggtagggtgtggccaaatccatcaccagaatctcctggagatgctgtagattacttgccagtgatagaacagtggcggtgtcttgagacatccacctcacctgcactacgtattgaggcatggccatacgcgtgtctgtcgtagatggagtagaccggagatgcgctgcctcgacatgtgaaggcgacgaatccgaggtaacacagatgcactttgcagttgtgacgcggggtccttccaatgaattaataactacgacgccgagtgactacacagttggacctactgtaggctggacgaccaagagtcttggatgtcgcatggagtcgtcactcgaggttcccgcagttctgttgatcaccgagctaacatgttggacttactgccaatcctcacacaatagttgatgacgctgggttgtgtcacgctgctgatgaactgaacgcaagtgtggtgtccaatgctgcaaatgaggtcgaatgttcatgcatcatatagtgtgtgtctagaaagtatatgtcctgttgggccatcctgggcctgtactggaggagttatacgcgagagacgaggattgtaactagtccccagattccgggctagggagggttgtgaacttatctccggggatcagatgggcaagttcaaattattggtcctttgaacatgcgcatagaggggttccccagaactgtg

SEQ ID NO: 565042 - DNA, 1179 bp, Homo sapiens
  misc_feature (69)..(69): n is a, c, g, or t
tctctttatgatgtgatgttctgtaccctgtcgatctcgctcttggagtacccctgcgtggtagtgacnttcctccttgtgggggattcatatttagttgtgttctgtgaatgtgtgtctttttggtgagactttgggtgattggcaccaccccgtggggggtcctctctgctttttggatgattttgtatcacgagtgcgacactcgtcccgtttgggcgagctccctcttataggccctcgctcgttggtcgagtcgtcgtgttctccctgtctccggttaaatagtaggttcccacgtggggacctgtgagggagcccctgtttctttgtgggacgctttggggtgtgtgtgctccagcgcactgtagttttttgtggggccccccgtgccgccccacatgtgtggatgtgccctctcagcagagggctcggtgttgtgtctactgcatgtcgctggtcacatgcgctccaccgaccacggcgttaccacggcgttgtttgttgtgctgccccgttcagggcctctccatcgcccgcccgtgtccccactgttgtcaccgcccctgtatccgtgcactgtcccactgtaggacccctcggtgcctcggtcttcttgtctcgtgcacacccctgtgggaccacaggagcacaattcccaagtctgggatcacctcacgagtagatccactgtcacgcagcaggggcccttcgtgtccccccattttaccacatctgtgcacaacacggggcctgtaggttcccacggagagtgcgcccaaaagtctatgacacgagtccccgtttcctgacacttctcacgcacgcctccaaccacaccagggttcccaggacctatggtcttcactggaccgagaatgtggataggcacacacgggagaatgggattatcccttatcaccccacgagccccacgtgctggacacactgctgagctgtcctctcccctccagcctttggccttggcttttttatgcctattttacctgcaggctgaggccactcttttccctttctcccagcatcactccccaaggagagagcccatgttttccacccataatcctttttgccgacccctagttccctctgccccgacccagcttgttatcagcttttcagggccctggttcacctttgaattaaaggtagtaattt

SEQ ID NO: 565043 - DNA, 129 bp, Homo sapiens
cgcggaggggaaaaacttagcggttatttgtttatatttaagcacagtttaaaaaaattcattatcgtttattcagtgtccgaattgaggccatttgcgaagaaaattctagctgtgggtggcagaatt

SEQ ID NO: 565044 - DNA, 890 bp, Homo sapiens
  misc_feature (2)..(2): n is a, c, g, or t
  misc_feature (129)..(129): n is a, c, g, or t
  misc_feature (254)..(254): n is a, c, g, or t
  misc_feature (325)..(325): n is a, c, g, or t
  misc_feature (770)..(770): n is a, c, g, or t
  misc_feature (850)..(850): n is a, c, g, or t
tntgctggaaagaagattgtctcccttcctctactacctactactagggtttgtcaacagctttccacacttaggttggagtaaggttctctaagacaagtttggagggagacttgggggtctggaganaccaagagctcagaaaataaacatctgagaaaaaaaagcaatccctggttggtaggaggttttgtggggtgtgggatgtgcaggattcaaggactgctcagccctgtcctgtagatcttactaangtacaagggaccaaggtgaaactgtgaaaaatcttaaatcctgaaattattcccaggagacgtgttaaaanccaggttcccctaacttcctgccatggattttgactttgtttagggtaggacttacattttgagtttgtttatttatttagtgaaatacattgctaagctgcccaggttggttttgaacttcctgtcttagactccttgtattttcagttaagtccctcagatctaagcttgtgagaccgcatacgcatcttcagggctagaagtgttctttggtctagtcagactccttcctactgtggaatgtgtttggtttaatgctgcttgcctctcagcagcctgaactctcatcaggtttggtttgaatcctcccggaacccggtagcggtaaccatggtaacctagggtggaagggtctgtgagggtaaaaccaggatcctcggcttagctcttgggggtcttgatagttgagccctccgggacccatggaaagtagaccctttaaantctgaacctggcttgaactgggttaaaagccaaagtggacatgatgggcgtatccaaagggcgcaaccttcaagagcctngttccagctactctagggcgggaaaaggttgagggagggg

SEQ ID NO: 565045 - DNA, 96 bp, Homo sapiens
  misc_feature (8)..(9): n is a, c, g, or t
taactatnngcaaatttcttaattgctttgtacttcaatttctttatttgtaaaatgaaaatgctaatagaagccttaagtcatacgtgtgaatgg

SEQ ID NO: 565046 - DNA, 165 bp, Homo sapiens
caactcgttgacattctctacaaaccacaaagacattggatcgctatacctattattctggcgcttgagctgtgagtcctaggcacagctctaagcctccttattcgagccgatctgggccagccaggcgaccttctaggtaacgaccacatctacaacgttatc

SEQ ID NO: 565047 - DNA, 426 bp, Homo sapiens
  misc_feature (28)..(28): n is a, c, g, or t
  misc_feature (67)..(67): n is a, c, g, or t
  misc_feature (212)..(212): n is a, c, g, or t
aggagtttgagaccatcctgggcaacanaggaaaaccccgtctctacaaaaagaaaatttggttttnatatttatttgtattaaattttttagaaacatagctgggcatggtggcacacgcctgtagtcctagctactcagggggctgaggtgggaggattgcttgagcccaggaagttgaggctgcattaagtgttgatcacaccactgtnctgcagcctgggtgacagagtgagaccctgcgactccagacaggtgcacaccaccacactcagctaattttttgtagaaatgaggtctcactatgttgcccaggttggtcttgaactcccgggctcaagtgatccacctgtctcagcctctcaaagtgctgggattacaggcatgagtcacagtgcctgggcccaaattcatagtcctaaacat

SEQ ID NO: 565048 - DNA, 228 bp, Homo sapiens
ttttgggggcccccccccccccccccccccccggtgttttttgtagggggggcccctacccaaaaaaagggggggttggcccctttttcccccccccggggcccgggggttttggcaatataaattgtttttttttccccccccttccccggagggggggggggggtttccccttctcccccccccccttggtggggggggggggttaaaattttttttttttcccca

SEQ ID NO: 565049 - DNA, 116 bp, Homo sapiens
ttctgcccacctacggtgaaaagcaatatgaaatgatcttgctgcagtgctctgagccctaggattcatctttcttttcaccgtaggtggggcagaaggagcgtggccagacagga

SEQ ID NO: 565050 - DNA, 129 bp, Homo sapiens
ccattatcactattctcaccagacctcctaggcgatccagacaattatccctagaccaaccccttaaacacccctcaccacataagcccgaatgatatttccgtattcgcctacacaattctccgcgac

SEQ ID NO: 565051 - DNA, 1099 bp, Homo sapiens
gcacaggtgtcgtgaaaactacccctaaaagccaaagtgggaaaggaaagagactcactagcgaaccattgtcgtctatagatacgacgtagattccgtggcaagtccaccgactaactggcacatgctggatctcataatatgctgcgtggtgtcgacaaatagtaacctatttgtaacaaatttcgatgaatggcacgtgctagcatcgagcatagggacaagggctcgcattcgacagtctcatgccttggtgatgctttgcgatcacacacatgtgaaagcatgcagctgatgaactgttggactcatcgaccaaaatttgaatgatgcgtccttatgctgagaaacactctggagtacctatgcgaaagttgcgtaattggttagaatctagtgccatttcgtagtcgtcagcactatgggcagcatccaagcatgtaacttgtgtcatgcacaacaagcaattggatattaacaagtggacaccaagtcatccagtggcctagagcgtagttggcattggtccggtgagtggagtcagtcgtggacgtaggttcgatcatcgtggttggagactttgtggataggctcgtggtaatgctgcccataggcagatcgggggcagtaccccgcagcaggacagtgcccttactagggacttaacagcaactaggggtttgtgaaaaacaaagctacattagatcggatagattaaacaaacaacttgggaatttccgacgtgaagaccaagcgcttacaagggccaagaaaagacgaataatgaagggacaattttgtctacaaaggaaaggttcacgcaaacgttaccatcgaacggaagaaatgggggctaacaaagccccggacaagaagtgagacaatttagtagccaaatgatcaagagaataagggaaattcgagtcgaccaaaacaatcggctgggaaggccaaagtggctaaacaatgcccacggagagccacacggggaacggaaaaagctccaccccgcacacgagactggggcaatggccacgtaggaaaccacgactcgaatacggagagacgctcgggactcggattccctagcaaccaaaag

SEQ ID NO: 565052 - DNA, 110 bp, Homo sapiens
gtcatgttacgtctaggtcctgatgttacgtctacggtcgacctatacgtaacacagaagtggattcagtagaatctagagaagacagcagctctattattcttggctgt

SEQ ID NO: 565053 - DNA, 251 bp, Homo sapiens
ggtcgacccgagtagctgggattgcggctgctctgccaccacgcccggccttctaatttttgcattgttttggtagtgatgggggtttcgccatgttggccaggctggtcttgaactcctgacatcatgatctgcccaccttggcctcccgaggtgctgggattgcaggagtgagccactgcacctggccgggattaagcaacttttaaaagatgaatttggccaggtgctgtggctcacgcctgtagatc

SEQ ID NO: 565054 - DNA, 490 bp, Homo sapiens
  misc_feature (87)..(87): n is a, c, g, or t
  misc_feature (434)..(434): n is a, c, g, or t
atcacttgaacccagcaggtggaggttgcagtgagccaaaatcgtgccactgcctccagcctgatgaaagcataagaatccgtctcnaaaaaaaaaaagaataaattcttagatttagaattgcctaaagattatgtacatttttttaattttggtggacattgacaaatttttgcccttagagttacacaaatgcatagtctttaccaacaatatgtttgtttcccaagatattaattttcaatcattcattttattaagagataccaaatattttgtaattaattcttccaactttccttaaatatataaatagaaaactgagcttgattgtagaaattggtttattcatatatcaaacctttatatagtaccactctattcctggtatattgtgtgatacagatcaagtgatgaggaacaggatataatgntacagtattggcgtgggtacagtgactcataccctggtaatcccagcactttgggg

SEQ ID NO: 565055 - DNA, 1109 bp, Homo sapiens
cgcaggagccgcagggcctgtaggcagccatggcgcccagccggaatggcatggtcttgaagccccacttccacaatggactggcatgctgtgctgcgtgtgcactgtggttcaacctatgcctggccctggaagatcctgcagacgtaatggccctggcaatgccaatggctgcgcctgattctgctccgcggccccgctgtcgggtcccatcctgtgcccatcgtagcgctgccccacggttcgggtaccacacgaaggtgcgcgccggccgcggcttcagcctggaagtgagctcagggtggccggcattcacaagaatggtggcccggaccatcggcatttctgtggatcctgaggagtgcggaacaatgtccactggagtccctgcaggccaacgtgcagccggcttgaaggagtaccgctccaaactcatcctctttccccaggaagccctcggcccccaagaacgggagcacaggttactgctgatgaactgaaacttggccaccagctgaccggaccgggtcatgccccgtccgggaacgtctatacgacaggaccacagctcgaagtcatcacttgaggcacgagcacgactttcacaggccttccgattagtcgtccggaatggcccccgttgcacaacgcgccagggcatctacgggacataccgtggcaaaaacgcagcccaacggaacagcacgcagaacaacagggagtctgaaaccacaaacaaaaacacaacggtatcgccgtacccaacacacatacccatctgcgtggctaccaaaaggattatcggagtataccccagagttatatgtgggtacaagacgagtggtgctaccatatatcagggagatcgaggacaaagtatacagacctattgtcgcccacgtttggagccggtagtacttaaaagaaagagtaacgcatgatcagtggggagacaacccagctctaatcagagagggaacattatctggttgacagcccgacacccacgtaaagtgtcaaggaggttgcgatgcacatcctttggggtcgaacatgccatccgactacaggaagacttatctacaccacacagagtaaataactaacac

SEQ ID NO: 565056 - DNA, 170 bp, Homo sapiens
gcgttgaatggaaaaaagacctagaagaggcagagcctgtccacaggtttcaccattcatccagccaacattatgggaaatttccacacccaccactgtcaaaccgaggactttggacttaataactgctcaaaattaaacgaacttaccttccatgggtgagggcttac

SEQ ID NO: 565057 - DNA, 224 bp, Homo sapiens
  misc_feature (6)..(6): n is a, c, g, or t
  misc_feature (81)..(81): n is a, c, g, or t
tccttnttgataggtgtataacatgagggtgttttctcggtgtgaatgagggttatgttgttaatgtggtgggtgagtgangcccattgtgttgtggtaaatatgtagagggaagtatagggctggtactagtatgttaagtcctgtaagtaggagaggtgatatttgatccggagaacggtgttacctaagcacaggaagaggtctccccagtagggttaata

SEQ ID NO: 565058 - DNA, 639 bp, Homo sapiens
ttctgataccaggaagacattctggatgagttaactgggtaacatggtgttggccccactcccagatccgggatccccaagtgcctggctgtaggccctgatgccctgccctcagcccctgcggagccccagcttgggacaatcccactcccttcccaaagctggggccctctgagaacccatctgaagtcggctgttggtgcccagggtgaagagtgagagagttctgaggtgacagccttactaccgggtggccgccaagtcttccagcagaccatctcctgcccggagggcctgtcggctgaggtggggtccgaagtgggagacaggacgctgcgctggatggccagtcacactgccagaccctggcatgtccctgacagacaggggagtgatgagctacagtgaaggcatgtagcttgagctgcctgggtcgggaggactggctctctagtgctggcgccgagagcacgtgtgcatctgggggccccatgcagtgcatgtgcgggccaactgtcgcgaacaccattaactgagcgccacgttgaggccgaagtgaagcttgcgtccccacaaaatcaagacaggggagccaatttggggcccccttggaatttggggggcctggaaaaagggggg

SEQ ID NO: 565059 - DNA, 902 bp, Homo sapiens
gtttctttttggaatataaaaatgtcctagaataagacagtggtgatacttgcacaactttggaatatgccaaatgccactgaactgtgtactttaaatgggtgagttgtatggtatataaattatacatcaataaagctgttattctaaaaaaaaaattcagccaggtgcagtagctcacgcttgtgatcccagcactttgggaggctgaggcagatggattgctttttgctcaggagttggagaccagcctgggcaatatggtgagacctcacccctacagaaaaatagaaaatattagctgggactggtggtgcgtacctgtggtcccagctactcggaaggctgacgtgggagggtcgcttgaaggctctggcagcgagattgaggcttcaggtgagccatgattgcaccactgcactccaatgtgggtgcacagagttataacccccgctctcaaaacaaacaaaacaaacaacacaacaaaaccctaaactaacattaacaaaagaattcctctcttcatgcgggggctgatcacgaaacccccgaaggaggatctcttatcagtctgtctctcatcctctaaagaaactccccacagaacagtatcttgctgaatcaccacatcttttcaggcacgcaggccacgctctgccttttcacccaacgttctactcccagcgaattcgggcaacaatgagaaaacacccccagtaatcaaacttgctgtgtttaacaccattctacaaatccaccttacttgttcagttactaatcaaggccctttaacaggaacaaaagtctaacataacaaagctaacctttcaactgctaccattcaaacccttacaaccgttcttaacccaaaacctattctccctcggttcacacaaaaacgc

SEQ ID NO: 565060 - DNA, 337 bp, Homo sapiens
gctcggtaccgtctgacggagactctcggtcatagccatccgaagtaggtaagctggggaggagctatgaagacacatctctcggtagtcattcaggttggtaagctcacaggttaaagagtgtccaggcttttcagacattctaactattttcaaaggttccaagggtgctgatatctttcagttgatttccacttaagttgagatgtgtgagatatgggaagttttgcagcgtaacatgtccagacctccgaagattctattgtcactgagttcaagcgttcacaatgtaggcagcttggggagattcgaaagtgatatcaagcctacattgatt

SEQ ID NO: 565061 - DNA, 996 bp, Homo sapiens
gaacaccacccatgtgtggagcagcccagccaagcactgtcaggaatcctgtgaaggcaggctccagcttatgtgtgacagaagaagatcctgactgagcgtggctattccttcgttactacttgctgagcgtgagattgtccgggacatcaacggagaaacctggtgtatatgtagctcttggactttgaaaattgagatggccactgccgaatcctcatcctcccttgacgaagagttacggagtggcctgaatggcgccctctgactcaccatcggacacatgacactgttctcccgcttgcccaagagaccctgctcacggaggcacccctgaaaccccaaggccaaccgggaagacaacattgactcaaatcattgtctggagacctttcaattgtcccagccattgtattgtggctatccaggccgggctgactctctatgcctctggacgcaacaatggcatcgtgctggactctggaagatggtgtcaccacaaatgtccccatctatagggctatgcatggccaatgcatacaatgcgtctggacctggattggcgagatctcactgatacctcataaatcctgatgagcgtggatactttgtgggacgatgcccacgctgttccatccatggggacccacaacacgggcgagggggcaggcacacaacgccctgtggaccaaacaaaagcttcctagccacacacggtaccatcgctgaataggccaagcgggcgcgagactcggcggagctactcctttgtcctctcttcttcccctgttgtcctcagtaaaaaaagggcccagcggggagaagccgggcgcggggagacagcgacagagaacaaacaggcaaacaagagagagcagagggaagcagagaaaagagcaacaagagacaggaacaagcgaagcaggaggagaaagaaaggagaagccaagaaagagagggccagaagaagagaagcgagagccagagagagacaaa

SEQ ID NO: 565062 - DNA, 765 bp, Homo sapiens
ggaggcctctgtggcggctcgttcggggaagttgagtcagggattgctccagcttccgcgagggaggtctctgtggcgggcagggtccccccctggagctgctgctaggcggtgctggttgccgggatgctgagccctacgcgggggctgagcggggcccactacttcttagctattctactcagtgttagagaggagaccgagcttgatcggctgggaggaagtgggagaggtctagtgagtcccttagggaataaagcagaccccgtattctattataccggtctagtcactgctaagtgtctccatatctaaccatctatatgatatcacgccagcacatctaccatatttactgatatattctatatacgagctatatataaatatatatatagagtctatcctgtaacatatagtcgggtatctaggaactgggtgtgcggcgagtactccctaggagacggcgggtgggaccgaccgtcgtgatgtggaggcgggaggagccttgcgggggtggcgcgcgacgaacgcgaggagtggatgcgcgagaaattaggaggttgggcggcccacgtgccgcaggcttgagcagtgaggctctgccagggtgcacggagtggtgcacatacccagggcaagagggggtgtggcgaacgcccctatcttccggaccgcagggaactgaacctctaccggagtgccatatacctaggcagagaggaggggggtcgtcctgatgcgctctggccggaatgatcaggg

SEQ ID NO: 565063 - DNA, 531 bp, Homo sapiens
  misc_feature (13)..(13): n is a, c, g, or t
gatccacgttggnatccgattcggatccacgttgggatccggttggatccgaattcggatccaccaaaaatacaaaaatcagctgggcatggtggcgcgcacctgtaatcccagctactcagggagccgaggcaggagaatcacttgaacccagggggcagaaggtgcagtgagccaagatcacatcactgcactccagcctgggggacacagctggagtctcaaaagaaaaaagaaagaaaaggacaggcacagtggctcatgcctaaaatcacagcattttgggaggccgaggcaggaggattgcttgatcccagagaccaacgtgggcaacatagcaagacctcctttctacaaaaaattctcaaattagccaggcgtggtggtgtacacctctggtcccagctactcgggaggcttaggtgggagggtcatttgatcctgggaggtcgagcctgcagtgagccataattgcacctctgcactcccgcctgggcaacacggcaaggatctgtctcaaatttaaaactt

SEQ ID NO: 565064 - DNA, 460 bp, Homo sapiens
  misc_feature (434)..(434): n is a, c, g, or t
acattggctataccacctgataatttaagaatggagaacatatgttggaattacttcaacagtgccaatcatgaataataataaaaattaataccatgaagtccatagtactttcttgtattggtaaatcatttaatgtttggttaccaaaatttccgaaattatgtggctgcaactccccactgtagatactggataaagccgggggaatttttattttaacttaaatatatacaagatacttttttagtttgtttgaaaaaataattgggccaagatcatgtctctcaagagttagcctaaatgaaatgttttttttatcatggggcttgaaaataggaacttgtaatgggagaaataggaaacagaagtaggaatcccaatatctccgtcctaataagacattggatttgggtgactggttaatttccagnaaaaattattaatttcccgaaaagtt

SEQ ID NO: 565065 - DNA, 141 bp, Homo sapiens
cacgaggggtcgtgccaattcccttccactacggctcgcgcagctcgcgcttcagcagcttgccggcgcccgagagggggagcggcgtgtctcggaagtccatgctccccgggcacttgtcccccgcgatctggttgcggc

SEQ ID NO: 565066 - DNA, 192 bp, Homo sapiens
tatatcatgttttgaggttagtttgatattgctagggtggtgattagtcggttgttgatgatactctagggcgagtggcgatcacaagagcgtagacttagactggtcagaactgcggcgggtaggcgcttccaattaggtgcatgagtaggtggcctgcagtaatgttagcggttaggcgtacggccaggg

SEQ ID NO: 565067 - DNA, 444 bp, Homo sapiens
  misc_feature (25)..(25): n is a, c, g, or t
  misc_feature (60)..(60): n is a, c, g, or t
  misc_feature (326)..(326): n is a, c, g, or t
aagggcttcacctgtagtcctcatngtgacttgactcatgcctgatgctgcttccttccntgttctaggtgccacatagatgcagaagcagtgtgcttgatgtcaggaggtctcccctttcttctctgtctccccattcttctctcctccgaccctttctctcccccatttctccctctctttccttatgtcctctcctccacactttgggtatcaaacccgggaccttgtacctattaggcaagtgctgaatcattgtgctacattcccagctctctaactttcttctcattctttacatctcatctttggctcagtggagaacnctttctgggagcagagctggcctgggaggagacagtgaagtaaggaagttcttggctctgaattacacactgttcttccctctagtgaccatgacctggggcagtcggacccacaggc

SEQ ID NO: 565068 - DNA, 298 bp, Homo sapiens
tggggcccggtggctcatgcctgcaatcccagccctttgggaggcctaggcaggaggattgttgaagcttggagtttgtgtcctgcctgggcaacatggtgagcccccgtcccttcgttttcttttttttcattagctgggcttgttggcatgtgcctgtggtcccagctgctcgggaaggtggggctgttagatcgcttgcccccatgtggtcccggctgcaatgaatcatgatggcaacaatgcactatagatcaggcaacagaccaagaccctgtctcaaaaaacaaaaaacaat

SEQ ID NO: 565069 - DNA, 373 bp, Homo sapiens
  misc_feature (3)..(3): n is a, c, g, or t
  misc_feature (9)..(9): n is a, c, g, or t
  misc_feature (125)..(126): n is a, c, g, or t
  misc_feature (287)..(287): n is a, c, g, or t
  misc_feature (289)..(289): n is a, c, g, or t
ganttcggnacgagctacaaaccgagacgggtggatcacgaggtcaggagatggggaccatcttggccaacatggcaaaaccccatctttttcaaatacaaaaaatcagctgggtgtggtcacanntggtaagtcccagctactcaggaggctgaggcaggagaatcgctggaacccgggaggtggaggttgcagtgagctgagatagcgccactgcactccattctggggacagagcaagactccgtctcaaaccagctaagcaggaagaacattgctttgcaagnanaatacctatgtatttcatttaccaccagcttccaacaaagggcagtgggttcatcaagggttcgggcagttgttttcatcttta

SEQ ID NO: 565070 - DNA, 1128 bp, Homo sapiens
gactgtctaaagcatgccttatttatgcctctcctgtaagggtgatctagccaggtacattttaaacaatgcttcagtgtagaaggtgtaaactattattgggctatgcatgtgctgtgaatgttagcttttttttttcctttgttaaaatcatttaaatcagaagtgcaaaaggtcctctagaggatcagatcatgcatgcgccattttttacttaatgcagctgttaaatgggcaaagctctacactgcactgctgccatctagtgatacactttggtcaaagtacagcaaaacctacagatatatacagtcatatcaacatatatcatatatatatatttcatatttctagggggtgggagaaaatccaaaataaagtaaatgcttgtattcattaaaaaagctgctgatattcattccttattcgtatgttgtcaagatgcaggcaaattgtgcagatacatggatacataaagcatgagtaatataaactgcaaatctataatatataagggcttcaacctggtgcaatttaatcaagctggaaacagtccaactgactgggctctactgcaattgccagtatatacgtatgatagctcaccagctgattactcttctctctacctgtcaagtcatgatcaaatcatacatcctatagcactgatgtgtcgaacctcacatctggcaccattcactacaaacacagggcaaaacaccaataacaaacacaaggaaaccaaccgcccatgcaaagcaacaccatggcaacactacagggaaacaaacacgctcacgaggaacgacagagatacaccaacaagaagaaacgggcacacacccacaacacacaacaaacccaaagcgccagacctgccggtgcacaccccacacaaccagacctgatgatattggggtacaatatgagaagtcactgagaatgacagggcttcgagggagaacgagtgaagaagataggatgggagacaaaagattcgatgacggacatattgtcgctcggcatgccaatgaagacagatgacaatactgtacaagccacagaataggactaagaaagaaatgaaggcatatagtcggatgttgtatcatgatttagctactagga

SEQ ID NO: 565071 - DNA, 127 bp, Homo sapiens
ggtcgacggggatggtgttgaacatgagggtgttttctcgtgtgaatgagggcttttaacttagttgttaatgtggtgggtgagtgagcctcattgtgttgtggtaaatatggggtaccgagcctcg

SEQ ID NO: 565072 - DNA, 1194 bp, Homo sapiens
  misc_feature (992)..(992): n is a, c, g, or t
taagtagatatcgactcgtggtctctgctctagcccttgtgtgctgttgcatgtgcaatcgagctgagtgttcatgcggcatatctcgcacatagtgcgagttgcgtcgcgcttacacgtccttcgcatacacgtgactcgctcgcatcacgttctacagaccaagatgtagcgattggctgcatccagcgaccattggggctgtcaaggccacgcttacattagatgagtccacaggtgtgctcccaaatgagtaggactcggtaaagccagtcttagggacttgagacgatgctactatttcgatcggatggtggttgcgtagcacaaatggaacgcgctcttcgtcgatcacaggtcgtccgaagatgtgagatccccctcggtagcggtaagttcgatcgagctctggtaggccacgtgcttccctttgggacacgacgcagcggttgtgcccaatactgggcttgtcagtggcccttgaaccgttggacccatgcgtttacaagatgggggttccattccaaccagaccttggttgcattctactaccaggacagtacgcacatgacttatcggttgggaggcgcaaaattgaatagcgctacactagggcggtacttggttcaataacaaaataataagaacgcgctttgacaatcacggtgtcgcacatggtgcaatggcagcatggggaatcgcaatcgttggtttcccacgatacatattcataatttttgcaccgaagaaaatttccctccttgataactttggcggcgcaaaagtgcagagccaagtttccatttccccccctatggtgaacaacttgaagagctgtgtttccctacacttaagggcgtatagtgttcccacgttcgccattgataaccccctttactctgaattatagatttctcccctctagaggaacaatgggtgcttgggaatcctcacataatggactcgtttgtactcaaagttccgctgttggngcacccaatgggtgcatatttgcgaagttgcaaaattccctactacgaacttggggcaccgttgtggtccaagttcccaaccttcggtggtgatatgggcaaattccaaacagtgaatatatctctgtttccaaatataagcctcggcggcaacaacactattcaccatgtaatttattcggtgtgggctcgcaaggggctg

SEQ ID NO: 565073 - DNA, 113 bp, Homo sapiens
tacttttcacagggcttgtccatgtgccagcgaaacattgccctcaacatgccacctggctgccagtgtacctgatgctctgaattctgtaatcattggtcatatgcttgttt

SEQ ID NO: 565074 - DNA, 984 bp, Homo sapiens
gtgtttgttgctccgcatggtgttgcgccgctttttgggttccccgcggtagtagatgccgcttgtgaccgtcacgccgcgtggctcatgtccccgcctgggtggattaaggcctgtccatacatttctctgacggcctggtttggccttcacgtgctcttactctgcgttgtccgcctgtaccagacatttggacccatttcttgggtcgccacgtgggggcgtactatacaccctttgctgttggctaaggcatatgtatgctgatgctcacgcacttgagtatgttctgagcccagtgacaatttggccctccgtttgtgggcctccacctgtggcgctatcccccagctccctctcgtgtttattctttcctcgacctcaactattttcttaaaatgtatccctcccccagggcttgtacactctctgcttatattgttctcctgctcctcacaggctcataatgtgctgggtgccatcaccaggctttgatcgattaatccccctcttttgtcaatagattctctaatttctgtctacgcccgcactataaaactcttttattctagtttcttgttatcccatgccacctgtttattaaccttccccggatggctcccctcccgcttatgtattacctcactagaggagaaatccttttgcttacgagaactccgagtttcactggaccacaaaaatacactggtcttgccattgactggtggcaccgcattacgtatgtcatcctaccctaattatctccggcgtaacacaatttttttcacccgcactacccgaaggggggtcctttccgctccccccctctattagccaacacattgatatacacccgtctgctttacacacacgagtagtaccacccccttaattgcttaataacacctcacgttctctccctctttttctcctgtttcccctcccccgctttttttcccggcgttttcctcccacatggacgaa

SEQ ID NO: 565075 - DNA, 237 bp, Homo sapiens
agatcttcaaacacgcaatcttggacttatgatggcaaaagtccctggattatttttttaaattgagtaatagaagtctttatatattctagataaaagttctttgtgttgccgatatattctccccgtctgtagtgtggcttttttattctccttatgtttcttttattggtctttgagatggagtcttgccctgtacgcaggctggagtgccatatggtgtaaacttgggtcaca

SEQ ID NO: 565076 - DNA, 501 bp, Homo sapiens
tttatgcacgttctatatttggagaggatgcacttgcaaatgtcagcattgagaagcccagttcaccagggaccagatgctgccgttactggccatataagaattcgtgcaaaaagtcagggaatggccttgagccttggagataaaatcaacctgtctcaaaagaagactagtctataaggatgaacaaaaggtctttgaaagtttatgcttaaaatttaggtgtgggctgattggactccaacatcttttgtactcttttcatgctttatgttatgtagaatttgagttcatgctgaatgcattccagccagtaatttatagcctttcccctaaatcaagaatgagtttaaaattatagtctgtcttttatcttaacagttctgaatgctgtcctcaaagtatataatgtttctcatatgtaccaagaccattttcacaataaacagatctgttcatacatttttgttattttataaataaattacttaattttaaaaa

SEQ ID NO: 565077 - DNA, 248 bp, Homo sapiens
ggccccatgggtttttttattccggggcttttccagagcctttatgactacacgggtagtcagaattttaaaaaaggggcttagtaggcagcatttcccaaacaaattgggtcgcaggaaatacctaacagccaggggcagtggctcccccctgtaatcccagcattttggggggcccaggggggtggttcatgaggtcaggggtttgagaccagcctgcccaacatgataaaaccctgtttttccta

SEQ ID NO: 565078 - DNA, 303 bp, Homo sapiens
aagagtttaattggccggcccggtgcaagttggcttatgcctgtaaatccccagcactttgggagccctaggtgggtggatcacttgagatcaggagtttgagaccagcctggccatcatggcgaagccccgtctctactaaaaatacaaaaattggccgggccaggtggtgcatgcctgtggtcccagctactcgggaggctgaggcgggagaatcgctggaacccagtagggcggaggttgcagtgagccaagatcacaccactgcactccagcctgggcgatggagtgaatcttcgtctc

SEQ ID NO: 565079 - DNA, 240 bp, Homo sapiens
gcacaaagatatattgtcacctgtctaggcattttgcacagagacataaggtgtgttgtttatgcccttttttacttttgggttgggggaaaccggaaaggtaatacacatttcaatggtccatttccttcacagactttttttttctaggggaagagacacagagctctctggagggcacagagagagagagccctagcctagcccagggtgccccaggggaggcctctgcacacccaa

SEQ ID NO: 565080 - DNA, 196 bp, Homo sapiens
ccacgtgcgtggctctggcataggatggtgtctacagctctgattagacccctagcctgagaacctccatatgctgcaggaagtggccctagaaatggcaaaaagagagaaaaaaaaaatctcggctcgggttggatcgaatagtggtctcatattctctattcatacctccaatatgcaccgtaattagggtttg

SEQ ID NO: 565081 - DNA, 545 bp, Homo sapiens
tgcgttgcacgcccccatatggtaaacgtttctggcccacgcggaaagcctattggaaaaatatttgagaaaatatcctccctgtgtcacgagacttataagaaaggctggaggaaatatttataaaattatatggttaatcaccctgcggttcctaattctctaagagaccgcggggccccacgcgttccgcttgaatgtggttgtaatcctcggttggtcctatctgagcacctttcgagttgctttcactttgttgttggctcacggttaaaagtttcaccactctcgctcttaaggagaaaatgagaaattctattatagagttcactcttctgttttagagcttaggtcacctgtccctaagtatgtatttttaatgcatctacacttttttactattttggatgtttggtaatttttctaacttttccaaatgggaataccagtaattttgaagtcctttccaactgtaagatcgctctaattttagttggtaattattaattgataataaaactatcatatgattgccaaataactga

SEQ ID NO: 565082 - DNA, 785 bp, Homo sapiens
agagggagctggaggccaaggccggagagctggcccgcgcgcaggaggccctgagccacacagagcagagcaagtcgtgagctgagctcacggctggacacgctgagtgcggagaaggatgctctgagtggagctgtgcggcagcgggaggcagacctgctggcaggccagatgcctgtgtgctgctgatgacatgaggctggcgctgatgccgggagcagcagcgcagctcccaggagcatgggctgagttgcagggccggctggcagagagggagtctcaggagcaggggctgcggcagaggctgctggacgagcagttcgcagttgttgcggggcgctgctgccggaggcctgtgggcatcctgcaggatgccgttgagcaagctggaacgagcccctgcaacctgcggcttgtaccgagctccccagaactaccttggtgatgcagggcccaggaggccttgggattgccgtgaagcaccctggagggagggggccacgcccagtaccttgaacctccttggcagacgctctccggccctggtggcggctctgacccgcttcttcccagctggctgcggataccatcattcaattggccggtgccaccttcgcaacctgggatcccaccggacccttgcctaaccgggcttcatagaacaccttgcaggtgagttgctggggcccgtgggctctggaagctcattggcggaaggtgtcaagggagcatggaagggattctggggaccattgcaggaccacgcctgtggggggacagcccct

SEQ ID NO: 565083 - DNA, 282 bp, Homo sapiens
aatcagctcggtacctcatcgctatgtacaggcctaccaaattttgtgttgctttattgcactttacagatactattttttacaaactgaaggttggtggcaaccctgtgtcgaggaagtcttgcagtgccgtctttctaacagcatatgctcacttcgtgtctctgtgttacatttcggtaacagtattttagatgttttcattattatcatatctgttatagcgatcagtgatctttgatgttactcttgtaattgcttacaacctcactgatagaagag

SEQ ID NO: 565084 - DNA, 204 bp, Homo sapiens
cattccctggggaggggttcctgaacccttccccaatgggatctgtggactttcatttttttaaaagacttacccaatttcatgcctgtactccctgaaacaaagtgagaaaggccaggtgtatttttttaagtcatcaaaataaacccttaaaaattcagtttaaattagcccccaggaaggaaaaatattttaaaaccccca

SEQ ID NO: 565085 - DNA, 81 bp, Homo sapiens
gatcggtccacgtattactatggttcggggcaagatgcttttgatatctggggccaagggacaatggtcaccgtctcttca

SEQ ID NO: 565086 - DNA, 228 bp, Homo sapiens
atctggcgttacttaatcaagaccgtcactcccatagagtctgtgtgttccctgtagtactgtgacacacaatatatggtaccggagtctcaggcttgatatattaagcactacataatcataaggacagtgatgaccatgaacccagaaggctcgaacatctagctgacagtatacacgcgcgcactgtgcgcattgcacacagtgaggagctatctaggaccctct

SEQ ID NO: 565087 - DNA, 489 bp, Homo sapiens
  misc_feature (29)..(29): n is a, c, g, or t
  misc_feature (146)..(146): n is a, c, g, or t
  misc_feature (168)..(168): n is a, c, g, or t
  misc_feature (288)..(288): n is a, c, g, or t
  misc_feature (297)..(297): n is a, c, g, or t
  misc_feature (489)..(489): n is a, c, g, or t
gccttctctgaatctcttgtcctttccanttcccattctccaggctgagaactgcactctgatacacggttattcccaataataataatgtgtgtatcacacataatgcactgcacctcttcaccatgctggcacctactcctctnctccccctgccagcttcctcanccccttcttctaccctgatggttctctccttgcctcctcaggccagcacttcccatgatctgagatgtctctttccttttcacctttttctccagcagtgagttcctcctcctaactcanggcttccanggaaggatatcctctgcttctcagacctgaacctgcctcgaatactcatgaggacccaaggagctactcctcacctcccacttctcctctggtcctgtcacataaccaaaggcacggccaactggatctccaaccatctgaggaaccaatcgtgtgtgggaaccgctgagcagaaaacctccccaagcggan

SEQ ID NO: 565088 - DNA, 143 bp, Homo sapiens
cctcgctaccaggaggctgcaggtaggaggattgttgaacccaggaggttgcgtgtgctgtgcagctgtgcattgcaccattgcactctagcctgggcaacagagtgagcacctgtttacaaaaacaaacatccccagcaatc

SEQ ID NO: 565089 - DNA, 1391 bp, Homo sapiens
  misc_feature (1096)..(1096): n is a, c, g, or t
  misc_feature (1161)..(1161): n is a, c, g, or t
ccttgtgtgccctcgggggcctctttgtgtccccccgcggatggtttcccttgggggggggtttttgtaggggggattgtcccacggggggaggctaacccaacggggggcggggcttgtctccgggggggtagacaccaccagcggtggacgcaagattgggtgcgtcaaaagattggtcagaggttatgtctccttctccacaggtaagcccacgtggttttgccttggtttttgtgattggttgggtcgtgtgtgggctggttcttgtgtgtcgtgtttcgtggtgcccccggtgggcctacagaatgttgtttttataggcgtgttgtttggtttttgataaaagcgcaccccctcggggtggtgcgcccaccaaccataatgggggaaaaatagtgggccctctggtgtgggaggatgaagtagtcccgccccggcttaatataagggggagagaatataaggttgttaactagaggagtagcgccttaatgattgttttctagtaggagtaacaaaggccttataaaagatgggagaatattctgcgcccacaacaggttttagaacagccttttggggaggaaatatcccaccgctttatggtagaaaatagcgctacttaaaatggctgggatgtgccccttgataataagatgatgtgtggagcacaacagcttgtgggccaacagcacacacccgtctgttgtctcatagcgccgctgtaggaggccctcgttataggagatgttataatcacgagcgagaagaggtggtctcgtttatattatccctctgagaacagcgcttggcgtgttagagatagtcggagagggagagagaggagcgcgcagaggggcacatctgcggggcgctcgcgtgtgggggcgcgcgctataagggggggtgtatattcgggtgtataggcgcactcacacggagtcacccacgcagatatatgggtgtgatagacacacacactcgtgtgtgtgtgggggagcacgcggcgtgttctacacacgcgcgttgtgtgttgagacctcttctgttcacatctcgcgtgtggtgagactcttatgggctctctacgggntgtgtcacatgtggggggtctctcctcgtgtgagtcacgccacaagagatgttgttctcttggcnctattgtggttataatgcacattgttgttaaaagtacatttgaatgtaccacttacacgagttaaaagaagagaaaggcggcgcttggtgtaatatttaacaccccagatgcccccgcggtttcctcaatcctattgggttttaaaatatattggttcaatttcaaacttttgtaaagaagtatggatttcccagtttttttttactttctccccagtatgttttaacca

SEQ ID NO: 565090 - DNA, 404 bp, Homo sapiens
gcggttgtatcccaaaggtcagtctaaggaggcagccacctatatagacatgacgtcaggtggattaggaaggacccacagctcaccttccctaaggcttactgacttgtacatgaggtctataatattaggtatacgcacccgtaagtaacatctgattgacggcatgaccttgcttgagatccactctcagaaacaggtttagaggggaaaagcacatgaatactgggagctacatggaggacgaacagggccacagaacaaggggaagctgggcctatagcggtccagcatgattaggggccaacagttggcttctaggaggtcatgggttaacacagtcgtcctaataccacctcctgagatgctgaatttcctctcagctgcgtacacatttctatttt

SEQ ID NO: 565091 - DNA, 336 bp, Homo sapiens
aaccgggtctgcccatgtatcagggttctgcttgggttgatcgtgtcggactccgcccttctattaacaattcatgggatcattgcgactagactatctacataatttcagtgacatccttcccaaatgttgtacaaattccccatattagtccatgcagcacaagctagtagctcgcatctgtgtgatcctcatctccatgcaatgtgtgtgcgatgagatgatcagagtaaattctactctgggtggtaccagtatcagattcgggtgtacgttcgcctgatccccctttaatccctggacgattccttgtctcggcttccaggcagctttccc

SEQ ID NO: 565092 - DNA, 295 bp, Homo sapiens
  misc_feature (19)..(19): n is a, c, g, or t
  misc_feature (41)..(41): n is a, c, g, or t
gggtggtccgggggtgcgncggggcggtgggtgtgagctcntccgcgtccactacaatcttgctaggagagacatatgacgcactgtcccgtgaagtctacgcaacatattttgtcaccaagaccgacgttgtaacctccctgttcttatgaattcgagcagcataccccggattccgctaggaccaactcatacacctcctatgaaaaaacttcctaccactcaccctagcattacttatatgatatgtctccatacccattacaatctccagcattccccctcaaacctaaaa

SEQ ID NO: 565093 - DNA, 723 bp, Homo sapiens
  misc_feature (47)..(47): n is a, c, g, or t
  misc_feature (79)..(79): n is a, c, g, or t
  misc_feature (81)..(81): n is a, c, g, or t
  misc_feature (87)..(89): n is a, c, g, or t
  misc_feature (104)..(104): n is a, c, g, or t
  misc_feature (107)..(107): n is a, c, g, or t
  misc_feature (120)..(121): n is a, c, g, or t
  misc_feature (124)..(124): n is a, c, g, or t
  misc_feature (126)..(129): n is a, c, g, or t
  misc_feature (147)..(147): n is a, c, g, or t
  misc_feature (161)..(161): n is a, c, g, or t
  misc_feature (164)..(164): n is a, c, g, or t
  misc_feature (168)..(168): n is a, c, g, or t
  misc_feature (179)..(179): n is a, c, g, or t
  misc_feature (207)..(207): n is a, c, g, or t
  misc_feature (213)..(213): n is a, c, g, or t
  misc_feature (218)..(218): n is a, c, g, or t
  misc_feature (221)..(221): n is a, c, g, or t
  misc_feature (224)..(224): n is a, c, g, or t
  misc_feature (243)..(243): n is a, c, g, or t
  misc_feature (260)..(260): n is a, c, g, or t
  misc_feature (264)..(264): n is a, c, g, or t
  misc_feature (269)..(269): n is a, c, g, or t
  misc_feature (288)..(288): n is a, c, g, or t
  misc_feature (291)..(291): n is a, c, g, or t
  misc_feature (304)..(304): n is a, c, g, or t
  misc_feature (308)..(308): n is a, c, g, or t
  misc_feature (316)..(316): n is a, c, g, or t
  misc_feature (329)..(329): n is a, c, g, or t
  misc_feature (355)..(358): n is a, c, g, or t
  misc_feature (376)..(376): n is a, c, g, or t
  misc_feature (379)..(379): n is a, c, g, or t
  misc_feature (384)..(384): n is a, c, g, or t
  misc_feature (395)..(395): n is a, c, g, or t
  misc_feature (400)..(400): n is a, c, g, or t
  misc_feature (406)..(406): n is a, c, g, or t
  misc_feature (410)..(410): n is a, c, g, or t
  misc_feature (412)..(412): n is a, c, g, or t
  misc_feature (422)..(422): n is a, c, g, or t
  misc_feature (436)..(437): n is a, c, g, or t
  misc_feature (444)..(444): n is a, c, g, or t
  misc_feature (462)..(462): n is a, c, g, or t
  misc_feature (551)..(551): n is a, c, g, or t
  misc_feature (553)..(553): n is a, c, g, or t
  misc_feature (570)..(570): n is a, c, g, or t
  misc_feature (711)..(711): n is a, c, g, or t
gaagaggcccagaggactgaaattaaactcaatattgataaataggngcaaagaatactgtggaaagaaaataaaatanantaaaannnggaaggctaaaatcnggngggggtgagctgnngtncnnnngggggcccggctgcagcngctttccctggggncangggnggctcgggagntgcagccacactgtgaacctcgcggagnctgggnccacncgntcncgctgcctcggcatggcgncctttcgtgggttcccnttcntctgnctgcagacagcaaatttcnggnctcaaacaggagntccntacctgcntctgtacataggncagagtcagttacacgtggcggaagnnnncctggggctgcccagggnggnggggnggcccactttngggcngggggngttngntgcccccccngggcggggggacannggggganggtggggtccctgcggcntgggggccagggccacctagcaggaactagaatcaatgtgggccacaggggggatggggggggggaaagggagggatacccagagcttntnttccccctgctggagcntcccatttgtggagtccggtgggagtcctgggccaggcagtcataggggccacttgtaagtgctcagcaggccggagcacagaatgggctgggggcagcagggggatgacggcacaccaggacgcatgtgttgcccatganacatttccatgt

SEQ ID NO: 565094 - DNA, 404 bp, Homo sapiens
gacatggacatagctgtaccgtgtgagaagctcgcatctcgttactcaatacgtttaacacctacagactgatattttcgaaagaaactaagaggacacacatgaaaaggtcatcgtgatcacagattggaagattcactactataaaatgtcaagactggccaggcagcggtgtgtcctgcctgtaaccccagcactttgagaggccaagacggacagattacaaggtcaagagagcgagaccatcccagccaacatagagaaaccccgtctctactaaatacaaaaattagctgggtgcggcggcacgtgcctgtagccccagctacttgtgaggctgaggtgtcaggcttgcttgagcctggcaggcagaagttgcagtgagctaagactgtgccactgcc

SEQ ID NO: 565095 - DNA, 289 bp, Homo sapiens
gatacatcagctcggtaccagtgaatcactcgggtactgaggatctctagatcgaccaggctccatgtaaacgagtatatggagcggtccgtatgatagctcacgtgtcgacggaacttgtacagggaggcatgcaccgcagtggtgaatacacgtcgaccaggatgcatgtatgcatgcttgggtcatgatcacggatctcctatattcaagcagcatgtatacaaacttgtgcccggccgtggtgaatacacgtcgagctggaggcatgcatgcatagctcgggtcc

SEQ ID NO: 565096 - DNA, 352 bp, Homo sapiens
tagttttttgtttctgcagggtacaaaaccacaatctttattttcttataaaaaactgagttgtttcacttaagataatagcctccagtgccacccacgttgctgccaaagccgtactttcattctctttatatggctgagtaatatcccctggtatacatatacaacgttttctttatcccatcatctgctgatggatacttaggttgattccatatctttgctcttgtgaattgtgctgcaatagatatacaagtgcaggtatcttttggatagaatgatttattttcctttaagtagatacccagtagtgggattgctgggtagaatggtagttctatttttagttcca

SEQ ID NO: 565097 - DNA, 415 bp, Homo sapiens
catctgtcggaccaattacactaggccagatatgaattacctgcatcaacaaccagtctggtgggttttatcagcatacttaactccgatgtcagtggttgtatggaatcctattgtcattaccctagacaaaaacttgcacactaccggagagggccagcagagtttcgcgtaaggaacacgaatgaattgatatgtctagtaggcgaggggggcccaacttagatataaaatgtttttcaggctgttcactaatatactgcatcatttgaaatgtgagtgtactaagtaagctatctagtacgatgcagctgatgtcagcagcctttccacaaagctactaattacagaagagacaggccccgccccacctggtctgaacccccatgaaaaagcaatgatgcaattcatcacc

SEQ ID NO: 565098 - DNA, 405 bp, Homo sapiens
agttccagcgtgtatatcctagctagttcctttctctccacctcacacggcaggcttgaaacagcagggtaccccgcctgcctctacttccacttcctctctgctttgcattccttatccactttcaacaggctgcagtgccccttccttgccccaaccctgtccctaaaccctactaaaacagcttaggcaaaggtcaccaccaatgacctctgcttgtaatctcaattgcattttctcagtcctagtctcaaactctatgcaacaacagacacttaatactccttgttgttttgcgcttctccctctggtcactcatacccctctgacctcttttccaggttctttttttcagcttcccccttaaatggtggtgctttccagttctgtgtttagcctctgctc

SEQ ID NO: 565099 - DNA, 219 bp, Homo sapiens
tccagaatagtggaggcagcaacatcaatcatcctttcttggaagctcttgacggctggtggggggacaggagaggtagggagatgccctggtatttaaccatttatgggctggatctccagactcagaaactgtggcttcattgctacatctgtccatacatgtctctgtgggtccctcccacgcagtgtggaaactgtcactccttcacccaagcta

SEQ ID NO: 565100 - DNA, 196 bp, Homo sapiens
tggtttggtaccacaaccgccgcgcgcggcggaatcgactatcagtacttcgatgacgcgctggcgctggcgcactggtgcgacgtgctggtctgcgccatgcccggcggcgcgggacgcggcacatggtcaatgcggccgtgctgcgggagctcggcccgggcggctatctggtcaatgtcggccggggcagcat

SEQ ID NO: 565101 - DNA, 906 bp, Homo sapiens
gtgtgtgcgagccatggaggctgaggcatgcgggttgtgtgagcagtctggaggaggaggcagactgctcagggaacgggcgggccgtgaactgcatgactgcccagggccagggtttcagagtggcggcggcgccaggaggaggaggcagggcgcactggaggcaggggtaggaggcatcggcgccgggcaactcgggaggccgaggcctctgacccagacgccttggcagtaaacacgacagagtaccgttggatcggctggagcggggcctggcgtgcagttctgctaacaggagctgatactgacgccaccaatgggcctggagcagccagtcgggcaagcgttgtgagcgaccctgagcagaagaaagcaagacgcgcatgtttgacccagctttcttggcagaaggcagaagtgcagcgtagtacttcagggcagttggcattgaacgtgatgcagggtccgatggcagagggccgggaagcgttgactgctcagggcccttgtcactgagacttgggtgacttggatcgcaggaagcacgggaggcgaccgtgagcgagctggaagcagtgagagatcggaggacctaagacgtggtgatcgatgggaaagccagtggatgatgagccagaggattgacggattggacaatgagcggttggatttgaggctggaaagtgcatggcatgacgggggttagcagaaagaggcaagacacatgattctgaagaagcgaacatgggtgacgagaaacttgtgagggattggaccgttgaacaggagggcagaggagtgccagagattgggttttggaagggtgattggtgcaagggtctctcgaagaagctcaggattgagtgttgacctggcagggaacgagaatgagggttggtgaacgag

SEQ ID NO: 565102 - DNA, 501 bp, Homo sapiens
taacatcttggcaggtgctgcataatcatgcctcaaatgactttctgaagataaaaagaaagtggtacttgcttgcataactgaacatatctgcctgagttgttttcctacagatgttatcctgggaatagaaccaaaattgttcattccctagcagccttcaagaagcactgtgatctagggcagcacagagccagcaatgagagacagaatgacattcacaattctagaagaaaacactggagtggaatatacacagaatggctgtttggtctcaagactgcatgaattattatccggctatgctggatgttctaattcctttctctcagaggactgtaggtagatacatatgctgactacatatgtggataacactgtcgaatgccagttttcactaatagtgtttgtgttaagctctctaaactttctaggctggcactatttgtgcccaaaagcatattctaaagcataaatccttgagagcaacacacacacaaa

SEQ ID NO: 565103 - DNA, 416 bp, Homo sapiens
tggtcatagctgcttcttgaggataaaactacttcagggagagacgtactcatagacttagctttttcctgagcaaaaaaaaccacttgatagattccttctaccacccatgtcgaaggacaggagagaatgcagccgcctggagccagtgaagaaagtgaagtcagtgaagaaggaaacaagaagctgcgctgggtgcctccaacaggccaagtaggataagaactgggaggggctatgggacttagcaatgcaacgacctctgaaggggacactctggtgcagcatttggaatgaaagcttgatttgagggaattaaagagaaaggagaaagagaggaattggagaaagaaagaaccctttcgagagaaggttgttggaggcaaaggagaacagcgcgctagattggttcattt

SEQ ID NO: 565104 - DNA, 115 bp, Homo sapiens
cttcctttatagcttacttatcaggtctccacataacggtgttggaaactttcattcattcatagtcttcaagatacaattgtggctacccacagaggtaccgatgcgtcgaatt

SEQ ID NO: 565105 - DNA, 659 bp, Homo sapiens
  misc_feature (70)..(70): n is a, c, g, or t
  misc_feature (307)..(308): n is a, c, g, or t
  misc_feature (347)..(347): n is a, c, g, or t
  misc_feature (417)..(417): n is a, c, g, or t
  misc_feature (447)..(447): n is a, c, g, or t
cgtgcaatgtcggatgtggatgactaccaattgctgcaacggataccctcatcacattgttctctactgngttatgctccatgcttcgttgggccgtttcacatgaatttgctagctgcgttctccgtggatttcgcgcaactcttggccggaattacgcatcgagcctaagtcgagacttcagaacacttccttagtaagagagcatatttgactgccgtttagataccagagtgtcatttcaacgaaagatgacatttattttcctaatacattttggaaacaggttgcagtgagtcgactatcnnatctaaatgtactttaggacttagaacattcgagatgcnttacttgatttttccttgttatttaacaatccctcgtccacctcccaaatataataatgaaacgatctgncagctgggcacagctggcgtcagcgcctgntgaatcccgagctgagcatgttctcttattcactttcggcagcgtgcgagaggcatttctagactctcttgtgacgcattctgaacaatagaggctatactatgtatgcgtttactccttcagagaaaagtcttaagacgtcacaatacggggaagttccttgttaccaggaagatcttctggcaattcctagttaataaatcttaatggca

SEQ ID NO: 565106 - DNA, 805 bp, Homo sapiens
  misc_feature (150)..(150): n is a, c, g, or t
  misc_feature (314)..(314): n is a, c, g, or t
  misc_feature (594)..(594): n is a, c, g, or t
gctccgagaagcggtatctgaacccgtgttgctctcccgaggcagatgctgctgtctgctagtaggctcaatggttaaatagtggaagcatcgatcgtggacgctgatacctagaagatacagtcgaacaatttctctggctgcataccntacagcgaactcaggcttgctttgtctagccaagtcggacatctgcgcgagaagttgagtgtatctttgtatgtactgttcacactgagaggtctgtggcggcgccagtggcgtttcgagcactcgtgtgatgggagaagacttgcagtggcctttgctgctcnttagtctgcccaacttgcatccgtgctgtacatgcaatgggagtatactacactgtcaaggtggacgtctgcgggttcgactaccggcacgccacgaggtgatccatggtccgatccattctatggtcatgaaatcgcggccttttcctgtcttctcatgtgccacccctgcttgggagaaggtgcccaagacaatctcgtcaaagctcccgtgcaccgtcgatcccatggacaccaactattgcttcagttccacggagaagaactgctgcgtgcggantggtacattgacttccgcaagacctcggctggaagtggatccacgagcccaagggtaccatgccaacttctgcctcgggccctgcccctacatttggagcctggacacgcagtacagcaaggtcctggccctgtacaaccagcataacccgggcgcctcggcggcgccgtgctgcgtgacgcagcgctggagccgtggccatcgtgtacta

SEQ ID NO: 565107 - DNA, 582 bp, Homo sapiens
ccgtcgttctctccttgaatccactcgccagcccgacgccctctgccgcctgcaccctgaacaccctgccccatctcctgtgccaggaacttgctactaccagcaccatgccctaccaagtatccagcactgaccccaggagcagcacagacaggcagctgtctgacatctgctcaccgcatcgatggcaccatggcacaggcgcactccatggtctgcacgactgacctccactgtggacgcatatgccatagctgtgctccagatccacttgcgcaccctgacgaactaacctgatcgaatgaaaccatgtgcctgcatatcttaccctggcgccaggcaatgacttgctcttgacccacgccctaggcactgatcacatggaaggcttgcaaaccacacattgccaactctagcaaggagtgccttgattccagataccaccttccactgtcccccaattagcactagacaccaatttcacctatacccccaaggcacatggcggcctcgcggaacctcggacacttcgacgagggcccggtttacccccgatattcaccacaccaccgaaacggacta

SEQ ID NO: 565108 - DNA, 134 bp, Homo sapiens
  misc_feature (27)..(27): n is a, c, g, or t
  misc_feature (85)..(85): n is a, c, g, or t
  misc_feature (98)..(98): n is a, c, g, or t
catccatccacccacgagtcagtccanccactcatccatccacccactcatcaatccatccacccatgactaatcaaactaaccncaaaacaaatganaaccatacacaacactaaaggacgagctccccgggt

SEQ ID NO: 565109 - DNA, 491 bp, Homo sapiens
cggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggcgttgatccggctgcgggccgagacggagcagggggagcagcagcggcagctgctggacggaggagctggcccggctgcagcgtgaggcggctgcaggcacgcagaaacggcaggagctggaagccgagctggccaaggtgcggggccgagatggaggtgctgctggccagcaaggcgagggctgaggagagagtcgcggctccaaacaggtgaggaagtccaagcagaggctggaaggccgatgccgggccggttccgtcgagctggccggcggatggccgcccgccttgcgtgccttggctggaacgaggccaagacgggcagcggcagctaggccgaggaagaccgcgggcgg

SEQ ID NO: 565110 - DNA, 570 bp, Homo sapiens
caccagaggttgttgtctcatgggggtatctctgagaccgcgggttgtaggactgcccattagcgcattcggatgtgggttcacccacaggtctggcacagttgtcaagccacagcccctgtggcttccagagcttgcacaggaccaattggcccagagatatcccttgtgcctgtgttctcaacgtggatatgtcttcccatcatggtaccgcgtcgcctcatgaggctcacactggattctctcctttccggttcccaacctgttgcaggttatcatttggccattttctccctgacggttccacttctttccaatcctggagttcacaccattgtcatggcaccatctagatgaatcacatctgaaatgacccctttccaagccttagccctggccccaccgtttaaagcctgattcagacattcgtttccactcatttccaacggcataatgggaaactgtgtaggggtcaaagcacgagtcatccgtaaggtgggtccaagcctttggtgaaaaagttggccccggtaacaacctcttcccgaaccttatgcctctgctggtctt

SEQ ID NO: 565111 - DNA, 392 bp, Homo sapiens
  misc_feature (392)..(392): n is a, c, g, or t
cactgtgcatagcccttttttgattgtttagttggttctctctcccattctccacagtggctgtcatggactccatttcactcctcaaaccccagacttcatccctcatccttctctcttagcaaatgaccatgctaccccacccaaagaaaaaaacaaacaaaaacttcaaataaaaacttgcctctaggccaggcatggtggctcatgcctataatcccagcactttgggagactgagtcaggtggatcacctgaggtcaggagttcgagaccagccgggccaacatagtgccctgtctctattacacagaggtgggaggatcacttgcctgggaggcagaggttgcagtgagccgagatcgcatcactgcactccagcctgggtgacgn

SEQ ID NO: 565112 - DNA, 864 bp, Homo sapiens
tgtgagccatcacgccgggcaccatctattactttgaaatcttcaaaagactgcttactcaagtcagctgatggtggtaaaaataattggcctttaggtaaagtgagacatcataagggtatgaggtatacattatggaggattgactgtcaggtcagaatatggagttatacatctatctctctgagttgaatactcagctccccacggagaaagaaagtcagtgtttaaggtccagcgtttcttagtctacgtgaagcgaaatgttgcattaatattcctgagtataagaatatactctttatatgggctaaaaagaccccatgaataaatagcaggttcagtagttgaggagctggagttaagcaggtagtctgcaggataaattagataacatgtgggaggtcacagcatttgggagcatgagtgtccccaagtgagcttggtttataaaactgtcgcaaatgtcggaaagtggacaggtttgctaatcttgtatgcagcaccttcacttcctttgttcttttctctctggttatcgcccgggcaggcagtccttcatactagatagagtcagactaacgcaaagtaggaagaaaatgacgtgaactcctacacctcgatatgaggggtacccggttctggccaaagcagggtgtcagccgtgaactgacaccgcacacctaggagggcagaaccgaccccatccaacaatgcgagcccacggctggggccacctgccaaacgcgcgtggaacgccaacccgagaacgggaaaacaagaaaacaagcaggcagacgcaccacacaaggcaacagccaacataagcaaacaaacacaacacaccaacaaacgacaccaacc

SEQ ID NO: 565113 - DNA, 320 bp, Homo sapiens
ctgatacaatccgagcttatacctgaacattcgtgtcaggtgcgtgggtcagcgttggaggcagccgtgatggccgcgatgcaggtggcgtgggttccagcgttggaggcagccgtgatggccgcgatgcaggggcgtgggttccagcgttggaggcagccgtgatggccgcgatgcagggagtgaataatcagcgtgtgcgtccaggcagcaggttccaagcagaagctttcctcctgtgactttgaaaagtgacctccttgtcagtttcttactcactgaactataaactagaatacgagtatggacacgaatgttca

SEQ ID NO: 565114 - DNA, 303 bp, Homo sapiens
tggaacccacttgcactgtcacagagtccacaacggaaatcacctatcccaccactatgacagagacatcatctactgccacctctcttccacccacctcttccttggtcctcgactgcagaaacagccaaaactcctaccacaaccttggtaaccaccaccaccaagaccacctcacatagtaccaccagcttcacttcttcaaccatctactccacagccagcacacccaccactgccatcacctcagttcccactaccttgggtaccatggtgacttctacatccatgatcccatctact

SEQ ID NO: 565115 - DNA, 403 bp, Homo sapiens
  misc_feature (6)..(6): n is a, c, g, or t
  misc_feature (39)..(39): n is a, c, g, or t
  misc_feature (42)..(42): n is a, c, g, or t
  misc_feature (52)..(52): n is a, c, g, or t
  misc_feature (193)..(193): n is a, c, g, or t
  misc_feature (276)..(276): n is a, c, g, or t
cctggntttaccaaaaatacaaaaaaccagccgggcatngtngcgggcgccnaaagcccagccactcagctcggctagggcaggagaatcacccaaacccaggaggcagaggccgcagcgagccaagaccatgccaccgcactccagcccaggcaacagagcgagactccatctcgaaaaaaaaaaaaaagantggctactccatagacaaagcagccccgaggactgctggttctccgtttttgtggaagtccagggaagaaggagggccccagnctttaaatttagtaatctgccttagccttgggaggtctgggaagggctggaaatcactggggacagggaaaccacttccttttgccaaatcagtttcccgttccaaagtggcctcccttgcctacca

SEQ ID NO: 565116 - DNA, 933 bp, Homo sapiens
aaggtctgacagtagctcttagagctcgactatcttaggtagtgcatgcggtgcatattgtttttcatggtgtactgtgttggattggtctcatatattggagatatcctgaaaaatggagcagtaatgcagaatcaagcctattaaaatacattttaagccttagagaaaatagagaaagaaaagatagaaagaagaaatgaaagataagagacccaataaactataaataacaacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565117 - DNA, 1627 bp, Homo sapiens
  misc_feature (908)..(908): n is a, c, g, or t
aaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaagcttctggaatcaacatgtttcttatgtttcttgcaggttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttgnctggtctgaaagtagtgggttatcttgatgaattgttaagtcagttacagatcaaactccatgttcttttctctgttctcacgactactcttgactagtctaaaaatatattaggtgttgaaaagtaatcgtggttattgccattacttttcttaacaagatggcaaaaaacacaattataagtagcacacatttctgtcggtttccctttagtttggagacagaagtctcggtaacccaggctgggaagtgcagtggaggcaaacacagagaaactcaggagaaagacagcacacacatggatccaaggacaatgcgccggacgaaggcacactaagagtagccgggcacttacgagccctttgcacaccaggtactcagataaaactaagaagccagaacacaagataagaagataagagacaacacccaaggtgggcgccacagagagagggatactagagcgaaagcggacacacacgaggccacaaccagacaggacgcaacaagcgacagcacaacgcgcagcagtcgatgaaaccgatgtaacgacacacgcaggaagcacgacgggacgacgcaaaagcggtacgaagaaatacgcaacggagtagaaggagaagagggagcaggacaagcatgatacccgggggaaagccaggaaggcgaacaggcccagcaccaacggagcagcgcggcagacggcagccgagaccgac

SEQ ID NO: 565118 - DNA, 622 bp, Homo sapiens
gtcgtgctgaggcaggagtggacattctgccccaagagggcaacccactcctgcctcaggaggtcccctgtggggatgctgctatttctaagatgcatgatgcacatttcctagattatgtatctgtggagtatggataagggaggggaacacgggacaagtggcttgtagaagtttgagagtgggcgcgtcaagtggatacgttcaagacgctttggatatattccgtagatataattaacataaatatatttgcaagaagagatagaaaggagaaaagaatcataatagaaatatataggaaatgaaaagagaacaaaagagtgagcaccactaaaacatacattgaaacaacttgaacataaaatgacgtggactataattcagcgccaggtccttcatctatcctgttgcatcaggacgtacttctcctttatggtactcgggactgtaccacttcagtgcccttcactctcgcgctataactgtacagcgttacacattagaagcctccatggcgtatggccttagtgctggttagctctctagtgtaattctgatcatgattccattctatgataagctgctcctactgcatctgcgcagtagcttccttacacaa

SEQ ID NO: 565119 - DNA, 403 bp, Homo sapiens
  misc_feature (403)..(403): n is a, c, g, or t
cttcattaactaatccttaaaatgaggactgcaattaccatcctgcctctaacacaggctgctatgaagataaaaagcagaactgcagtgtcacttagttgatctttgtagagcaagagaagtgagcaacagccttacatacatgaaattcatggaaggctcgctatccaactgctgtcactcctgttaagagggtgagcatccctactgctttttgcccggatgacaggacaggcaggctgtcatgttgactcccttgttggctacatttgtaaggaacacactgcttaatatttatatcttttttaattgacacataatagtacatatttatggggcacaattaatgttctgatacacatatacattgtgcagtgatcaaatcgtggtaactagtgtatcn

SEQ ID NO: 565120 - DNA, 627 bp, Homo sapiens
acagtattttggggagtaatgttttcccgaagtttctgtcattctctgtttggcgtattgtacttctctttcccgtgcccttctcaccacacacacacacacacacacacacacacacacagcctgtcagtctcataggtgtcctataaaggtaaataaggcaggcaggcatttgaaattacagcagggatagaaagccaagctcaggctttggaggaggaacctcttgtgctggatgctttgcttttaccttcagtgccttttggattgtttctccctctgctctagaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgataggtaagttgctgtgctgtgagaagaaatcatgtgggcttggggcattctttcacgcccagggac

SEQ ID NO: 565121 - DNA, 601 bp, Homo sapiens
aactgcaggaatggcgtttgttggaacagtatgttcaaggagccacgcaggtgggatcaatgtgtttgggcaaatcactgtggagacatttgcatccattgttgctcatgaattggggcatatccttggaatgaatcatgatgatgggagagagtgtttctgtggagcaaagagctgtatcatgaattcaggagcatccgggtccagaaactttagcagttgcagtgcggaggactttgagaagttaacgttgaataagggaggaagctgcctgcttaacatcccgaagcctgacgaagcctacagcgcgccctcctgtggtaataagctggtggaccctggagaggagtgtgactgcggcacagcgaaggagtgtgaggtggacccatgctgtgaaggaagcacttgtaagctcaagtcatttgctgagtgtgcatatggcgactgttgtaaagattgccagttccttccaggaggctccatgtgcagagggaagaccagtgagtgtgatgttcctgagtactgcaacggttcctctcagttctgcccgccagatgtcttcattcagaatggatatccttgccagaacagcaaagcctac

SEQ ID NO: 565122 - DNA, 2811 bp, Homo sapiens
aaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565123 - DNA, 316 bp, Homo sapiens
gtagcgtccaggtcagatctttatgtcatgatatgttgggaccttttattaatatatacatttatagttttaaattttgtgtaggcattatattagctgcatctcacaaattatgtagtatttttgttattcagttcaaaacattttctaatttctcttttgattcctgctttgacacaggggttctatagaagtatgttctttaatttctaaatgtatgctacaaagaagggcattattagtagctgacagttaagagaaacatatgggggttctggaatcattcagtgaatggctgtggggaggttattggcat

SEQ ID NO: 565124 - DNA, 2491 bp, Homo sapiens
tttttttttcaagtggaaccatggaggagagtggctgcccaaggtggggtttgtcttttgccgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565125 - DNA, 2494 bp, Homo sapiens
gagcagacagctttttctgtgcagttaacgagtcgctatgtttcggatctgcgttacttccccggtatttgaaggcaggagcactgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565126 - DNA, 1452 bp, Homo sapiens
aaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactaagcattggcatgtgggacacaaggggtaattcacttgcaggtggtctcagccgattttcgttagcagcttgcggtc

SEQ ID NO: 565127 - DNA, 937 bp, Homo sapiens
tgtctggtgtgctttcctctgatcgatccccacccttcacctattttacatatacctacccttttctaattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565128 - DNA, 195 bp, Homo sapiens
aaatcccgcgcactccctaacatcttgtagccaccaaagggtgactgggctccaaacacatcatagacagttgacccacacagtgcccgcctgaagggcctgggacaggtaattaggcctatataccaaatccttatgtgacagacagctgcgagccagacccgatacgtaggaattagtatggctctccacaac

SEQ ID NO: 565129 - DNA, 1020 bp, Homo sapiens
actcgggagcctgagccaggagatttgcttgaaccccggaggcacaccttccggtaacctgagattatacccctgcactccagcctgggtgataagagcgggactctgtctcagaggaaaaaaaaaaaagttgagcagtgcctgtctcatgttcctcttcctctgcccttctttgctcagtgtgaatccttttcctgcttttcagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565130 - DNA, 95 bp, Homo sapiens
ggtcgaccttaaaactgatggatggtatggctggggcagcatggctcacgcctgtaatcccagcactttgggaggcgtcgacgcggccgtcgacg

SEQ ID NO: 565131 - DNA, 1395 bp, Homo sapiens
aaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccgtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagaagcacatccgtactgccctcaaggatcgagaaaaacaagaggaccgggtatagaaacaccacggggcatacaaaac

SEQ ID NO: 565132 - DNA, 476 bp, Homo sapiens
ggcagtcgggccgttccttcgccgaacgcaggggtagcggtgtagtctgcgcagggtctctgcgcgctaccgcagccaggttcggccgtaggcgtctggcagcccgtgcgccatcttagtatgaagcgcatggccgcagcctaggggccggggagcggcgggtactgctttgctcctcggctttgcatttgtcgctcgcgtgagcagcggggcctgctctgtgcgcctggcaagacgcctgatccgaaatgtttgttgcgggcctgttttaaaaggctcttaacccttccaatatgacacggtttataccagcttccccggccggcctggagttttaatctccacacgctgaagttgttcgttttgaccgtgcgctgcaggcatggtttgtagattcttataccccaaatagtcgtacatgtgtcaggaacaaagaggtggagattgggtatgatgtacaggtgggaactgtaaga

SEQ ID NO: 565133 - DNA, 234 bp, Homo sapiens
  misc_feature (8)..(8): n is a, c, g, or t
  misc_feature (78)..(81): n is a, c, g, or t
  misc_feature (86)..(86): n is a, c, g, or t
  misc_feature (106)..(106): n is a, c, g, or t
  misc_feature (114)..(114): n is a, c, g, or t
  misc_feature (152)..(152): n is a, c, g, or t
  misc_feature (158)..(158): n is a, c, g, or t
  misc_feature (162)..(162): n is a, c, g, or t
  misc_feature (168)..(168): n is a, c, g, or t
  misc_feature (181)..(181): n is a, c, g, or t
  misc_feature (190)..(190): n is a, c, g, or t
  misc_feature (198)..(198): n is a, c, g, or t
  misc_feature (201)..(201): n is a, c, g, or t
  misc_feature (218)..(218): n is a, c, g, or t
agagagtngctggaagagactccaggccctggggagactttacttttcctgaacactggccttggcacactgggtttnnnngaggnaggaggagagcccatgtttnctgtctgnctcctccaccatccctgacctcagttgagctgcctctngccttnttgntgctgncacatcctaggtntaagagttnaacgcctntcntaggccactacaaactnacccctcagcagggct

SEQ ID NO: 565134 - DNA, 137 bp, Homo sapiens
gaactggtaggtatggaagatgaatagatggatgcatggatgagatggatggttgggtgaatagatggtagctgatgggtacataggtagatggatggatggatagatggacgcattgatgagcagggagcaggtgg

SEQ ID NO: 565135 - DNA, 189 bp, Homo sapiens
tcgaagtctgggaaagcggtgaagcagtactatgaaacttgagtcatcccgaggttgatctcttacaacggtgtatgttaacctttgtagcacatgtgttgtactgggtacacgagaaaacccagctttcatctttggtctgtatgaggtcaatatggatgtcactgaattaattacagtgtcctatag

SEQ ID NO: 565136 - DNA, 167 bp, Homo sapiens
ggtactgctctctatctgctgcttatcttggccactgggtaggagggtgaagtcaggttcacgctctgagtcagaggtgaagagcaagtgcccgggaaccagagctccagtagtgggatataaaaacaggagcctggtggcctgggagctggtggagcaatctatgt

SEQ ID NO: 565137 - DNA, 310 bp, Homo sapiens
  misc_feature (242)..(242): n is a, c, g, or t
ggctggttcatgccctgccagggacaccgaagggctggtggcagccacgatgccacctggcgtgctacgctgacactgccgtcataatgggcagcatgggcgtcccacaacaccgaggacgtcctttcgtactatgagaagctttccatgagccgatggaccacttaatgagtctgacttggggatgaacggcggagtaggtacttagtgagacaatggaaggatgtgtcgccgtgctacgntgccagggccgtggctatgagacgcagccaagtgtagcaaccataggtgttggcatgcaaggagcttg

SEQ ID NO: 565138 - DNA, 1622 bp, Homo sapiens
atatttatattatttatattatcagttgaaatggtttataaggactttaagcgccccattgacaaaaaacaaattggaaaaccacagatatattaatttccaaggttgggggtgaacattgtgaatggcccgtggaaaaatatattcaggtgaggctatccataccacttctcgtgagtgacgtgcgaagaacacatagtgaaaaacttcttcataaagtggttatacacactcacacacaaacaatatcacacagagcctaacagtgcactatacaagacgctttagtggcgccagtagaacaacatatcacacttttgtaaaatttacagccgaaataaaaatatatataccttgtagggtcggctagtcgcaacacacacctaaaacgcaacacacaaaaaacatcacacaacaccccctctcgtggaaaatacaacttattgtggagagacaaacagacaactgtggggacaagccccacagagacacacaggtgtgagaagatcccagagtgaaagagggccgagcggactgaaactatattgctacaatgtgtgcggatctctattctatatttcccagagtttattccacaagatatatatataccatctcttctgtctcaaaaaatattgggggcaatctccctgtgggaaagcgtgtgggatcttaccaatatccctataaattccccctcctaacataacatgggcagcacgagacaaaggaaaccgcgtagggcgcccccgcacaaatctacctatagagagatagcagtggtatcccccacagggggccccgcgcttgggacaacacaataggggggaacatacaataaccaccccacacgcgtggggcagaaacaacacagagactgggggacaaacacggccgaaaaggagcaaccaaaacccatatgaggcacccccctaagaaaggtggtgaagaaccctatgtagggaaaaccacccacaatggtgaggagcgatcatcaaacaactaggggagcccaccgacgtggagctagatacacacacttcacgggcggccaagcaaaaccaagaccggctgtacaacgaacgaacaccaacaaactcataaagagagaaacggacgagaacacaccccacactattctacacgaacgccgcagagaaaagaggacaagagcaaacaaatccagccgccccaccaaaagcaaactggaggaccagtatcgcgcaacacagcacgaagacactaattaccacaacacaagcagcggggaggagagcaacacacccagaggtgcgagagcccaccccaaccgtactggaaccatcaacaacagcacccagagggaggagaacacaacgagctggcggacacgagtcaagctgcgcagcggcaacataaataaaacgcgctgagcaagcacgccgttagagaaaagcatccccagaatacacattccaaaaaaacaagagacacaccccagattcattaaacacagcacagtgaacaacatcactatggaggccccgagagggcgtaaaaaccagacatcaatgcacaccaagagcatcaacagaagacaatcagaggccgctggaaatacataggagagagcaagagaacaa

SEQ ID NO: 565139 - DNA, 330 bp, Homo sapiens
tggcacgaggtggcacgaggggagctcagactcttagagccagctgtggcttcggacccaaggcctgacctaggctgctatcctaatattgcaggaggggcctctcttccaagccccaccctaagggttagcccttggccaaatcttttgacgactaggcccactcaggctcctctgactgaacaagcaataagaggctccaagctgactgagttgcaaggaccctacacggcctcccttggatctccatgttagtccagatgcctgtagaccctgtgccatctcgttctacaccagccttgtccaagtgctggctcgtatagccatgac

SEQ ID NO: 565140 - DNA, 715 bp, Homo sapiens
gggattcccaaaaaaaaaaaaaaattttaaaaaaaaaaaaaaaataaaaaaaaaaaaaaaaaaaaaaaaaaaaaaaaaaaaaaaaaaaaaaaaaaaaaaaaaaaaaaaaaaaaaaaaacctggcggcccgtctggcccaagggccttttaaactgggcaagctttatcattggggccaaattccgggttaattgggcaatttgccctaaagggggttggtttacaattaaatggcccgagtttaaaaaattttgaaaggggaaaacccggggggtccccaatttaaacggcttgggggaaaacccccttttgccaggttggggaattgccaaaaggccccgaacaaatggcctttccaaaaatttgccaaccttgaaggccaatgggaaatgggaacgttaaaattttggtaaaattccgggtaaaattttggaaaaatcggctaatttttaacccattggcccaaatccggaaaatccctttataactaaaaagattaccccggaaaaggtttaagggtttttccatttggaaacaggggcccattttaaagaaccgtggctttcaacgaaaagggcataaaaccccttttaaagggcgaagggcccactaggggaaaccttcccctaaaacagtttttttggggccggggggcccaaaaagccctaaaaggggaacccttgggcgcccccgtatttggttttccggtgggcct

SEQ ID NO: 565141 - DNA, 962 bp, Homo sapiens
ggttcaccgacttgatggaactattccagtgatcccctatctcctggaagccgtcacgagaaggactccagctctatggaaggcgcgccatctgggaggatccatggcaagtgggtgatggacacatatccatgtggcatgcagaccaatcaacagcactgagtgtgcctcccctgactgcagttacggactgaggatgtctggcttcgacggcatactccatgcctcgggagggatcgacatagcagagcagatgcgcccccagtgatgctgacaggtgacccgactgatgaacagtgactgatgaggcgtgcaggaggcagcacaaggtactccaggcccccaagagctagtgacagcagacgtccaagcagcaaacaagccagtcacggatgacatcttggagctcctcttgtggagtccaatgcgtgtgacagggtgcccggaagcgccagcgcccttcactcattactcgctcacgcggattcgcacctggcatccgccgcacgatcgagccctgaaagaatgacgttccatgagaccaggagccaccacgagcaccagcacctgtacgagacgtgcgcggaaaccacccgaggaaacccacacgaaccaatacgagcctcgaaccatggggtgccagggacatccacgcggaccacgaggcagtgcacgaggccgggaacgcgccttatcccgtttcccaacgaacgcggagacacgctgggcaacagtaaccttctccgaggtctggttaccattcgaacgacgtcacagtcaggggagtatggggcgcctatggattcgggcgctgtgtggagccccgtccccgcgtaaaggtaaaaagcctggaaccgggaaatgaccgccatgccgtcgggaggacacacgggaatgccaatcgggccccggctgggaaaaagtggacaacaaagcacgaagaaccaggaacgcaagaatga

SEQ ID NO: 565142 - DNA, 401 bp, Homo sapiens
attcatcattaaaataatgagatctatccaaagatcagctgatatgccaagcagagcatatatactgacaagtctttagctatcagtctgtccacttaggtggtaaaaaaaaagccacctttctcagatgagcagctaatcagaaataaatgcaagttgaccaggcacgatggctcacgcctgtaatcccagcactttgggaagctgaggacgggtacgattatttgaggtcaggagtttgagaccagcctggccaacatggtgaaaccccattactgctaaaaatacaaaaattagctggatgtggtggcaggcacctgtaatcccagactacttgggaggctgaggcaggagaatcgcttgacccggaaggcggaggttgcagtgagctgagatcgcac

SEQ ID NO: 565143 - DNA, 1179 bp, Homo sapiens
  misc_feature (692)..(692): n is a, c, g, or t
  misc_feature (717)..(717): n is a, c, g, or t
  misc_feature (787)..(788): n is a, c, g, or t
  misc_feature (797)..(798): n is a, c, g, or t
  misc_feature (869)..(869): n is a, c, g, or t
gtcggagaggctgcgggagcacgcctatgagcactcgctgggtcgaagcttcgagccaccaagcagagggcacaggaggctctgctgcagctgtcgcaggccctaagcctgatggaaattgtcaagcaaggcgttgatcagaagctggtggaaggccaggagaagctgcacctaggatgtgtgctcgagtcgtgtgataccagtaagcatgcttccgagggccgccgcaggaaggatccgtgccaacgccagatcaggtgtcgagctcccgtggtcgctcacctatgttccggtgactattgcccagtcaatctgtcaggccacctgtatcgctccctggggtccagctagttctagggcctccgccaccaatgtgaaggaccatggtgcagcaaggcccgccgtcaggtggaggaccttccatgccacgttttctcgatgctatccagtctcttccaggacctgtcctagtcagcattctggcccagagccggtgagcgtgtcgccagcgcccgcgaggccctggaccacatggtggaatatgtggcccagaacacacctgtcacgtggcatcgtgggaccctttgcccctggaatcactgagaaagccccggaggagaagaagtagggggagaggagaggactcagcgggccccgtctctataatgcagctgtgctctggagtcctcaanccggggctcatttcaaacttatttntctagccactcctcccagctcttctgtgctgtccacttgggaagctaaggctctcaaaacgggcataccnnagttgaccnntctctcagctctctgagcttggaagaagctggtctgagcctcacctatcagtcagtagagagagatgtccngaaaaatatctttcaggaaagtttctcccctgcagaattttttttccctgttaaatatcagtgaatataggcgctgggtgcggtggctcacacctcttatcccagtaatttgggatgcatgaggagggcggtacacttgtggttaggtgttcgagaccagccaaggcctaccatagtgaaaccctgtctctacatcaaaataccacaaatttgagcctgggcactggtagacggtgtctgttatcaacagttaggaggcttatgcaagagaatctcttgaacctgatagagccagcgtgccgtgagtcac

SEQ ID NO: 565144 - DNA, 123 bp, Homo sapiens
  misc_feature (1)..(1): n is a, c, g, or t
nagtgatctcagatcttctgatacaccaacacacaacgtctcttctcaactgcccagcatacgggcccctccctcagccactgttagggtctcccttctgcaccctccttagatggtggtata

SEQ ID NO: 565145 - DNA, 196 bp, Homo sapiens
caacaaaggtaatgtcttcgtcgatgctctgatttttgtgtcatcataattctgtatagcgctatacttcttgtaatccatattcattccctctttgacctttatttatattatttccaaatgccaaaaccaactccagcaactgcttgagggcaccactcctaaacacctcttctgagccagaacgaattgcttc

SEQ ID NO: 565146 - DNA, 386 bp, Homo sapiens
atcggtcaacctagaaacgttttcattcgtcattccaagagagagagaggaaagaaaaatacaactttcattctttctttgcacgttcataaacattctacatacgtattctcttttggctcttcatttataactgctgagaattgtacatttctgtgttttttggaggtgcagtgaaacttgaaagcttaagtgtgaccggactgatcaatataagatcaagagtagatccgactgtagaagtctactctgtgaccacggagctcaatttttgtgttgaagctgtactaatctcccacagcattgggaatgtgttatgtatacatctattgtttaaactatatgaatgttgcggggccacatagctttcttttatgttggagaca

SEQ ID NO: 565147 - DNA, 388 bp, Homo sapiens
acaggtgactgggagaacaccccatggttggccgagagggtcatgcaggctgtgaataccacctgctacaccagtagaccgtggagggcgcagtcatctagagctccacgctgtaggcagtgtagacggtgattgtaatctacctcgttgggcttcctctgcctgaaagtccaatctgatagccctaaaattggttcgatgtacagattggggtgacgttcgcgggaataaccctccgaagggtttcatgttgggtccagggttagggtgatttgagatttgagatattcaccgggggcccgagtccgctccagaggccttggggggacttgggttgaaaggctcgtgggcctgtgccccgcgtggttcatttggtacttttcccggg

SEQ ID NO: 565148 - DNA, 1158 bp, Homo sapiens
  misc_feature (404)..(404): n is a, c, g, or t
  misc_feature (434)..(434): n is a, c, g, or t
agcgggggatgcgtgtcggggggcggggagacgtgaacgctctcgagcgctcctcccggtgggggtcgggctcggcctgcggtctcatcgcccctcggacccgggctcgcgcgccggacgcagggaccacgcaggcagggcaagtaacgtagagaggggagcacagtaaggccacggggggccgcagaaaggcagaatcgcagaagactgggaaattggccaggtcgtactgcaaggggcttggtggaccggacgaccgagggcaatgggcaggttgatagcagagcgtggagccgcatatacgtcgggcctcgagtcgaggggatagcaaagggagaccgctcgtgtcagcgggttgacctcgaattcgcgatccaagtgcctgagactggagctcggtctantcctatgggaatcgcacgacacgaaaaaantcgagataagcccatcgctgcccatggaagcgttggtgcatgagggtaaccagagggaagtaccaggcgatagggcccggaccccctgggaaggaaccgaatgcagtcccattggtagcacggcatcgcgctggctcgggaccaatgtagacccgcgtgtcatatggaacccgtatactcaaagagctacacgtgactagacgtcaaactactcacggaggaaggtaatagggagcggctcctaactacttgggaaaagcaacggaacgggggagtacttgagctcgcccgaaggcacctcttcagtggggaaaacggtcaagcggatgctcggtggttgactgggagtggcagtaggaccaccccaaattgggcagttgacgtagtcatgtgtaccggcacaaagagaggcgggcgtttaggaccactttgaacgcgccaattttctaggaagttgtgcaaaggaccccgagagaagaggtgggagtttggacattggggcgacgccaaaaacttccatagatccgagggaattgggggtgaataggttggtttcaaaaccctaatgggaaggggtgcccttttgacacttgagtagattgaaaattgggttatacacttatgggcggttgtggatcgccaatgtagagctgtttggaattcggaggcgacttaaaaaagcgcgggttctttggtgacaaagaggggggacaggagggggaag

SEQ ID NO: 565149 - DNA, 671 bp, Homo sapiens
taacgcttcttttattagttttaattaagtttttcaaaagttatcggagaataacagaaggtggggagaagataaatctgcctttggaaaccaaattatttaattatttacattaaattggtttcaatacaacttcaggcaaagtgccaacgggaagaccaagcccagaaattcagaggaaataatcttccaaacagaggaacaccaagggtgatcttcttccattccagccacaatacgggtgatcataagtgggtgcatagtcagtatactccagatatatcgaggtgtttaccacattcactctattttctcagaagtgccttccgaaacagctttacagtgtgacaagagttacagaagcaccgtgacgtgattaccaacagaggcgtggaacaaccagtttcctccaaaagtgtttggaaataccaccctttcggacattaagtgccgtgcagtattattcttcccgtggagcatgccggttacataagatacgtgatatacgtggtagaaaaggggattcaggccggaatttccagctagtgtagatggaatgacctccatagctctctgcaaaagcccgaacgcagtaggattccataccactcaaggtccgtgaatatccagtaaacgaagggccactctatttctggagccacactcctgca

SEQ ID NO: 565150 - DNA, 410 bp, Homo sapiens
cccaatctgttagagtagtgactggatggacgtttatgggttagaataaaagagagaactaaaaaaacctccactcttctgacagaatggatagtgacaccttttaccagtgacacattgtgtagtagagaaataactggtttggtttggggtgaggaagtggaggggagtgaagagttagtttgtctttgaacaagtgtatttaagaacccactggaaatgcacagagggtttttggaagttcttttcctcctcagatacatagagaaaaatgtatagtaattctttattattttttcacatatttatattgctgtttttttctgtttcctttttgtggttttcctttatatttttcttctgtctctttgttgatgattttcatttatccatgtaaagtttagagacag

SEQ ID NO: 565151 - DNA, 120 bp, Homo sapiens
ttgactctagagtgatcccataccccgattatagtgcctatatgccatactatgtcttatgccggcctgcgaagcaggtggtgggcctagccctactagtctcaatctaccaacactggt

SEQ ID NO: 565152 - DNA, 1616 bp, Homo sapiens
  misc_feature (522)..(522): n is a, c, g, or t
  misc_feature (1616)..(1616): n is a, c, g, or t
tgggtaatttagtttaaatttacataatcataaattaaattctgaaatccagttaggcttgggagggaaacaaggaaaaacagtggaaccccaagaggaaacgtgcagcgaagaagcacaaagaattcaaggaatcacgtgcgaagccaaagtgggggtggagggggtgcctctccgtgaagctacagaagaggaagtgaatcggggtggtaaagaataaaacaacaaggtctcaaaactatatattccagagtgtggctccaccagtctcagcaatgtgggtgactctttcgtgtggcgggctcgtgtgccattctcctgtggaccacaaaggggcctccatgtggccctccaacaatatattctcatgtgccttctcttcacatcttgtggcccaaaaaacaccatactatgggcttgagcacatccacaaaccatctcacatgtctctgggggacatgtggcgcatatatgagacaaaatggctgggagacctcatttgtgtgtgtgtgtggtgtgtcncccagctatttgtggcctatggggaaacaagagaatgggccagagaccccgtgtatatgcgctataaagggagaatgagaatgtttctaactattcttcacaaaaattattctccccccctaatataagtatggtgatctttggcccacccaaatgtgggcctatttatatgggggcgtgtgtgtcgacaggtcccacccaaacctctggggagcaatatacaaacacgccggggggaaaattataatttctggtagaaaaacgacagagagaaaccccttttaaataagcgcaaaaactcctgtgttctctccagggtggctccagaggccgcaaaaacatttttgccgggcttgatctttaggggcgaccctttggtcttcgcaaacaacagggctccaaaaggaggaagaccggcggaccccaagggggccccgcgccgattaagaacggggcaagtgttctggaaaacaaccacgggggggtgggtttcagaaccaagtgggctacaaatcgtaaccacggggtatatccctcgggacactagaaagggcagatccaagatgtgtatctaacagaaggaaatgtggaaacttctctcttctcccaagccagtgtggtttggtccgacaaacccctctggatagtgggtacaagtaatcaacgcgacactctctatgatttcttttaggagagacgcgttgtcgccgacaaagttgtgtgttgatcagcccctgtggtgagaaaagagcaagagacgatatgtggcgctcccaccaattggtgcgtgggaacccaaaaacaaggggttcgtccgccatgagagttgtgatatcaccgaagtggtcacgtcaatgaaaacggaagtatccttataaccagcgaggagagaaaaacagactgtgagcggatggaggcacactctatcgatgaacaaggcagtaagcagtctagatcggcacgcgacacatctcttcgacgtcttcattcttcgttcactcttcgttccttcttctctatctcgtccagcgtccgctacaaagaagtacagcacaaggacagaagacaggagcaggagacgacagacgaacggn

SEQ ID NO: 565153 - DNA, 425 bp, Homo sapiens
  misc_feature (364)..(364): n is a, c, g, or t
acccgtgtacatcccccttcgtacactaatttatcctgggtaattctactttcactagatggaaatttcataactgaaaacaagataaaatacccttgggggtgggttctcggaacttttggctttgaacacctatatcctcattgggtggcgggataacctggccaaacaagaacaggattccacatatgacatgttgctactaggtatgagaggacttatcaaagacctaattttcacagcacaataactatggctcccatttgatgcttccaacaaaagctctgttttacagaagactgtgataattaccaaaagtttgcacaagtcaaagagggtctttaactactaaagagtaatgcanttcgtctcatctattaaataacaatgctttcatagtaaagacttactttggttcttatttt

SEQ ID NO: 565154 - DNA, 491 bp, Homo sapiens
ggatggccagtcccgaacagtgaggcagttccagttcactgactggccagaacaaggagtgccaaagtctggagaaggatttattgacttcattggccaagtccataaaacaaaggagcagtttggccaagatgggcccatttccgtgcattgcagtgccggcgttggaagaactggagttttcataacattgagtattgtgttggaaagaatgagatatgaaggggtggtagatatcttccagactgtcaaaatgttaagaacacaacgaccagccatggtacaaacagaggatcaataccagttctgctatcgagccgcactagaatacctgggcagctttgatcactatgcaacgtagaaacccctgaccccttctggatttttactacaggcccttcgctatccatggagtctcttctgagccatacagggcacttgagaagtccttcttaacttctagctaacaaccacttagtgggactattaca

SEQ ID NO: 565155 - DNA, 154 bp, Homo sapiens
tggagttggcgtggtcttccaggctggcccttgccttcgactcaccgccaacttccctgccccaagccgcaagcaagccaatgggtacaatgggtccccaagctgcacgtaatggatttcccgccgaatctgcccaagctgcaagtactcaacg

SEQ ID NO: 565156 - DNA, 142 bp, Homo sapiens
ccttgtttgtgttagcacagtggaatctcatcagcattgttgaaatgcttaagcactgctgctgatcatttcgtaatataagtcttgaaatctaaatgtcaatttcctacaaattataaaaataaactccactacactatca

SEQ ID NO: 565157 - DNA, 736 bp, Homo sapiens
cacaaatctctcatgacactggtaggaccaagctgataacacaattacgtgcagtgtgtcagagcttctcgtagacaccatggagctcgcagaccaccaagtttcattatgtgggaaccaggacactcaacactctagtctcagatagaggcacgcaagcgtgattgcgattagagtttgacgaaggcacaggtggaccggaaagcatgccgtcgctgctcacggtgagtctcaattggagaagcgttgctgcaaggacgatgttaactatgcagcacgaatgtatacacatgtctagattctgatgcctgctatgagatatttacagaaagccttctgtgctctagtcgccttgaaaacgatccacctggctggaccagatgatgcactgcagtgtttgttcacgaaaatcctccagctggtatagcccataaagggaaatccccactacaggatcaggctacgaaaagagtattgacttggtattaggctgccagagagagtacttcaattcttctaccaaacctcactgatagctgcatggatctagccaggtgctggttacaacgtgataacagacagagcccctgccattcaagaggagctagatcttatccaagccgtgggatgtcttggagaattgtggggtaagagatcctgcctttgcagtgcgatggtgcctgatcggatcagtctcatcaaggcggtgtattgccagtcccgaaatggtataaag

SEQ ID NO: 565158 - DNA, 274 bp, Homo sapiens
aagggtaggttgaaaccacacccgggcatcttggcaccctccagagcagatatcgtttttccatatgtagcacgctctgctgtcgctgaaggtttgtgtcccctaagcaattctatgttgaaatgctaatccccaaagtttatgacatgagggggagtctttggggatgtacgacgccttgaagaatggggctagtacccttccagaaaacttgagaactgggaagaaaacaatggaaatatatatcttttttttttggaagacagcatattca

SEQ ID NO: 565159 - DNA, 177 bp, Homo sapiens
gtgttacagcacacatagcttcactacccatcggtgtccatattatagaataatgtagggaagaaacaaacccgtatttatgatttactacattatcgcctatttgacagctgtcttgcaaccacaaagtagatagcctgaatcttgacataaatcccacacattcagtaaatgtat

SEQ ID NO: 565160 - DNA, 624 bp, Homo sapiens
tgtacggtccggagtttttggatccggccggcctcgttagccagcggatctgcggcgcactggcagcgccccgaaccaagatgccagaatgccgggcctgcagggcttcccggagctggtcctggtgtacactgggacacagtgctccaaggtgggtggcagacgatgtgtgtgcccccctgtgtccctggaccttgctcctggaagccccatgcccatggaggggccctggcatgctggctatgccccttgattatcacctagcaccgtattactgatagcatgctgggcagtacgctccgcactagttggcataccttggaaaacaattcggtagaaggatgatttgtaaaatgcatgttggagatagccgacgaggtcggaaggcccgatcgggggtaagttatgtacccccacagagaaaagtcctcccttatacgtccaaagtggaaacggtaggcccccgagagtcgcgccgcggaaagaggcgaacgcgcgagaggaagccgaaaagaaggatagcaagaaggagccacgggaaggacaggaggggaacagaagacggacggcgggacacacggggagaaaggagaggagggcacctaggaggatcggaagagaagg

SEQ ID NO: 565161 - DNA, 451 bp, Homo sapiens
tgctggagacgcacctatgatgaaggctgactgcacacggacaacggccgagggggtggtggtgtgacttccacctctagtcactgtcgctgtcacaggagtactccacagaggataactctcaacctccggagccacaatagcgaatttgtgctggtcaagtggaatgagtcctacctgaaactggccgtccgttaagaagggtgaggcatattcgggtggatccagtccgaggacaggcggtctgtgcagatggacaacgaacgcagagcgcacgtgagctgcttacacgtggcagccatgatggacctcacgcacttattacctatcgagatgagtttgtcctggtagggtctgccagtggacaagacactgctcatccaaaatcaacttggaaagtcacatcacgtgtggaatatggactcctgacgcccaccaggtgctgtctggc

SEQ ID NO: 565162 - DNA, 116 bp, Homo sapiens
gtcgattggaaaatttacacctttacggccgtgtgaacaaactgcaagacccgtgaagatgcaaataggtgtgtaaactcactgataaattctgagagagagaggaaaaaaaaaaa

SEQ ID NO: 565163 - DNA, 319 bp, Homo sapiens
  misc_feature (112)..(112): n is a, c, g, or t
  misc_feature (313)..(313): n is a, c, g, or t
gtgtggtagcttgtctacagggtgcagatctacaagtgcgtcatgagactgaggcttggttcatctgatggcatgttgagaacgggcttcgcagttctggtgtttgtggcanacttcgatgagaatgacccaagacctttgagggcgttgaccccagactaacagcatgcgtgacgtctaccggaagtttgatctgcgcgaggatgtcatcgatttcactggccatgccctggcgctctacggcactgatgagtaaggggaagctgggtggtggcagccccctcgccgggccgtgccccatcctaaccacaancaactg

SEQ ID NO: 565164 - DNA, 240 bp, Homo sapiens
ttccgtctcttctcaggctgttctctgcagtgctgggcggctcggggctgggccactgggccctcctgctgctcctgcgccctgctgtcctgctggaagcgggcgatggccttgctggtccttcttgccgcttgtggctgcatcaccgtggctgcacattgtctcgcgcttggatggcgttcgatcgtcaacagatacgtcgcccagggagctggtggaggggactcctctagacgtcga

SEQ ID NO: 565165 - DNA, 281 bp, Homo sapiens
cggcccgctttcgtgagactcaacaaacaacaaaaccccgaatggactgtatcctacccacactcctcttctcctctaggagtgacatgctgggactagcacggggctcaacaggggcagagcccagatggcaagtccttgctgctcccaacagacttgctttgctggaggactatctgtcagtctgtttgtttcaggtcaaccatattgacattaaaaaaaaaaaattcctaggcaggatctgagccgcgtctgctgcctgcaccagatctcacggagag

SEQ ID NO: 565166 - DNA, 899 bp, Homo sapiens
  misc_feature (660)..(660): n is a, c, g, or t
aatcgaagaagaaagataaagttgagaggataagcgcatgttgagtaaagcgccatatcatggaagacggatcatgcgcagatcaccgcaaacatacgtatcgtcaggtgacaatgcaagaaagctatacatggaacgagagaaatactaagtcgaggcaaactgctataaggcagcaataatagcaagagcagaaccgacaggtgaaaaggctgtgcaatgaggcaggtggaacagaacaaggagatgatttgatacgagtatatcaaagaccggacagggctcgatcaagtcgatccgtccaaagcaagcctgttcagtttggcactgtccctctcctgtgcacagaaactagttagagtgcgtttagatagctacggaaccagttgacattgaataacgagaaccatgacaaacccacacttggcattggatccaatcatattacagcttcaaatatacacactctgaattataacagatgtgtttgtttttctttcccaatcatgtagaattgatttccagttcaaggataaaccaggaacaattatttagaactatcaagtgatctaattaattttctttggtatgcttcttttacatttactgttatttgatgacttatcaggtagtagcagcaaccagagctatgatattgancacaataagccattgttaagggccccatttccgagaataattaggtaacttatagcctggggagcctatatatattattgcacgggggggaaattattattggggtccggagggccctggtgagaaggttcaaaggttccccacatttttcttttggggaaaaaaccggtgttcccacctatttttgtggatgtagaaaacccttgttagaatatcggatacaacccctggggaaattt

SEQ ID NO: 565167 - DNA, 1024 bp, Homo sapiens
taaatagatgggggtctcacttggttctccaggctgatctcaaactcttgacttcaagaagaatcctccggcctccgcctcccaaagtgctggagattacaggcatgagctgctaggtccaatcgcttggagatttttgggttgggttgggttgggtatggtggtttataggttggttggaggcagtcttcctctggttgcccaggccggagtgcaagggcactatctcggttcatggcaacctctgtctcccaggttcaagtgattctcatgcctcaggcccctcagtagcggggattacaggggcccggcaccaaacccaggttaatttgggggatttatagtaaagaccgggttttcaccaggttgggccaggcgggatatcgaactcctaacctcaaggtgatctgctagcctcgcccatcccaaagggcggggattacaggcgtgagtcactggtgcgccgggctgggtaagcttacataacaaagcagttaaaacctttaacgtagtggttacttacagttttctctccttcactagacggagatctgagggtcgagcctggctccatgggagctctgccgaatgcagagcgtagttgatcgtgaacatagtatatcctcgggccctatcagggacaaggtaacagaggacgtaacacagggcacggtgggaacacacataacaaaagaacggaggtgcgggaacccttagggttacacaccatggggtgctgacgacccactggaccagaccgggaaacccaaatgtgcgtgacgcacacgtacacagagcaggggggggggagaacaacacacactatccaaacagcgcgcggaaaaacgatcgcgggacgacgcttccgagacccgcggggaatcccattcacagacgggaaggcaggcccacaaccaacagcgggcggagacaagttaccgcaacacccccccgcgtaataccacgcgtgcgcatgaagccaaacgcgtctgtgcctctcgctcactactttatctccgatggc

SEQ ID NO: 565168 - DNA, 736 bp, Homo sapiens
tgagggatgcacaagtcttaattcctgctggcagaggatggtggtcctggtggctggcggagtggggcacctcatggctggcagctctcacctcttgctggccggcagcttcagccattgtgggcaccttgcccagtgctcctcttcatggtgtgctggtgcctgtcccttgtggatggggctcatgggtgggaccatgcgccccctcctcagcaggtgggctcagacttatgtgtgcaggggctcatgtggtgctggcacatgtgggaatggtgtgaccctggctgtgcccgtggacattgtacctgggccaccatgcatcgtctgtgcctgcagatgtgtgagaagaatggcattgctccatgcatgtgccatgtgctccaggtgtaagacaccttgccggtgatcctcggtggttcccaatgttgcaccaagatgctgagcctggagaagatgtgttctgcctgaaagatggtgtcatgcgtattggtcgtccaggtgacttgttttcggtgagaggtggtcgatagaacagtgtaaacatgacagctcggggtcccccagggtggctcctcatggaaggtctcgcaagtcccccagtggtctccgctggggcaggaaaaaagcccttgtaggacgtactgttctgggtgactggccctcagagcacctttgggtacgcccaggtctccttattgggcatcctgatgctttggccaggggctatcagggtcga

SEQ ID NO: 565169 - DNA, 248 bp, Homo sapiens
atgattgaaatgggctacaacaaatttgaaatataagtgtatttttccttacactctttgactgtaaagaagagtttgttagtattttagacattgactgttttctgatattcaggttgtaaaatttttgatagataaatgcatttaatacttaggtaattctttggaaccttttaagctttgtttactctccagtggactatgttataaactgagatgtgccttaactgttctgtggctccctaaga

SEQ ID NO: 565170 - DNA, 932 bp, Homo sapiens
  misc_feature (44)..(44): n is a, c, g, or t
  misc_feature (64)..(64): n is a, c, g, or t
  misc_feature (74)..(74): n is a, c, g, or t
  misc_feature (118)..(120): n is a, c, g, or t
  misc_feature (139)..(143): n is a, c, g, or t
  misc_feature (152)..(152): n is a, c, g, or t
  misc_feature (160)..(160): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (188)..(189): n is a, c, g, or t
  misc_feature (195)..(195): n is a, c, g, or t
  misc_feature (203)..(204): n is a, c, g, or t
  misc_feature (210)..(210): n is a, c, g, or t
  misc_feature (212)..(212): n is a, c, g, or t
  misc_feature (232)..(232): n is a, c, g, or t
  misc_feature (252)..(252): n is a, c, g, or t
  misc_feature (268)..(268): n is a, c, g, or t
  misc_feature (270)..(271): n is a, c, g, or t
  misc_feature (275)..(275): n is a, c, g, or t
  misc_feature (281)..(281): n is a, c, g, or t
  misc_feature (288)..(288): n is a, c, g, or t
  misc_feature (291)..(291): n is a, c, g, or t
  misc_feature (300)..(300): n is a, c, g, or t
  misc_feature (308)..(308): n is a, c, g, or t
  misc_feature (310)..(310): n is a, c, g, or t
  misc_feature (317)..(317): n is a, c, g, or t
  misc_feature (322)..(322): n is a, c, g, or t
  misc_feature (324)..(324): n is a, c, g, or t
  misc_feature (332)..(333): n is a, c, g, or t
  misc_feature (337)..(337): n is a, c, g, or t
  misc_feature (340)..(343): n is a, c, g, or t
  misc_feature (347)..(347): n is a, c, g, or t
  misc_feature (351)..(352): n is a, c, g, or t
  misc_feature (355)..(355): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (382)..(382): n is a, c, g, or t
  misc_feature (397)..(397): n is a, c, g, or t
  misc_feature (407)..(407): n is a, c, g, or t
  misc_feature (410)..(412): n is a, c, g, or t
  misc_feature (417)..(417): n is a, c, g, or t
  misc_feature (425)..(427): n is a, c, g, or t
  misc_feature (433)..(433): n is a, c, g, or t
  misc_feature (439)..(440): n is a, c, g, or t
  misc_feature (444)..(444): n is a, c, g, or t
  misc_feature (449)..(449): n is a, c, g, or t
  misc_feature (462)..(462): n is a, c, g, or t
  misc_feature (480)..(480): n is a, c, g, or t
  misc_feature (482)..(482): n is a, c, g, or t
  misc_feature (511)..(511): n is a, c, g, or t
  misc_feature (634)..(634): n is a, c, g, or t
  misc_feature (638)..(638): n is a, c, g, or t
  misc_feature (647)..(647): n is a, c, g, or t
  misc_feature (653)..(654): n is a, c, g, or t
  misc_feature (701)..(701): n is a, c, g, or t
  misc_feature (857)..(857): n is a, c, g, or t
  misc_feature (862)..(862): n is a, c, g, or t
  misc_feature (928)..(928): n is a, c, g, or t
ttaggtgtaattaaaaataatgaattgaaagttacattgaatgnagggtttcccagggtagttnttattttgtnaattactccaaataaattaaaggtagttatgcctcatctttttnnngagctgtggcagctctaannnnnggaaaaganaaataaanaaaaggaaatctaaaanaanaatttnanngaagantggacaannaaaaangngggggaggatttagaaagtnggatggtaaagaaagttgantcaaaatatttttttngnnaatntggggntggggtntanttgtggggngttgtttntnatggggnttgananatgtgaannttgnttnnnntggngggnngtnttgtggnggnggntgggttgtggaggnggggggggtgggttntggggttggnttnnnaggtnacgaaaannnttattnaaaagnnactnttganatgttagtttgtngggaaagatatgggaaangngataaaatcacaattaaatgcatgtatanacatgaataccaaagctattatgtagaaataaaatcaaaacactttagaccaagaagaaatcagagacctcctagtctattgccccagtgtaaaaattaaaaaactctggagtaatcattgcnattnagcattagnaaaaannaaataattttaactctgaggaaaaaaatgattttttaacattttcanttttatatcaaattagatactgatcacatatatcataaaattaataaatcaagcagatttttctactccataattcatgtcacatttaatagtctcttcacggattctttgtactgagaaatggaattttcattttcctcctcatttttaagactnacaanagactttttgtactcttcaatttctttagtaccaaggagctcttctttatttatttccatattttntcag

SEQ ID NO: 565171 - DNA, 156 bp, Homo sapiens
acctgatcctaaagatatggtgcgagcttcgatttcaaacgtcaggctggcaagcagcagtataggatgtccctgcgtgtagtctgcccagaaacaatacatcctggaatgtccaaagcagggctcggatgctactagcatcagtaccgaaagaag

SEQ ID NO: 565172 - DNA, 172 bp, Homo sapiens
atactctatggtagaactaaggcctttcctttcttggccaaagtctctaccctgtttaacccttgtatattctgactgctcactgttcatattatagggccagcttggtaatatagagtgctccataacatgatgaataattctgtccagccagcatggtggctcaatatag

SEQ ID NO: 565173 - DNA, 601 bp, Homo sapiens
tctagctaggccagaaccccacagtctttgaacactgtaagacctctggtatttttgttcttcatttaacctcacattcatgctctgctgggccttgatgagtcttgtgcacatgtgcagcctagccctttaacaatgacctatttcgaactcccacattgacttctgtcctcgttctgtgcatagctcctccatcttcagtgccctaccaggtaaatcacagctgcattaacagcccccaaatttccatctctgtctcatcagtgcagttacaccgtcatgatctgcttggtttcaaactccccgccacaggagaattttccccacccatagggcctgggcaaacatgaggctctcaccctgacaataccttatgtctatgagaaactctcatacactgtttgtgggaggagaaattggagttaggactctggcaaagttttggcaggttctattaagctgaatatgaacattcagtatgacagtaattctctctgtcatataatcatcctaaaagttaacatgtccaaaaggcatatagaaacgctaattcctaatagcccaaactggacacaacctagaaattaaatcaccatctcaa

SEQ ID NO: 565174 - DNA, 463 bp, Homo sapiens
  misc_feature (9)..(9): n is a, c, g, or t
  misc_feature (37)..(37): n is a, c, g, or t
  misc_feature (108)..(108): n is a, c, g, or t
  misc_feature (128)..(128): n is a, c, g, or t
  misc_feature (228)..(228): n is a, c, g, or t
  misc_feature (230)..(230): n is a, c, g, or t
  misc_feature (276)..(276): n is a, c, g, or t
  misc_feature (279)..(279): n is a, c, g, or t
  misc_feature (365)..(365): n is a, c, g, or t
  misc_feature (405)..(405): n is a, c, g, or t
  misc_feature (410)..(410): n is a, c, g, or t
  misc_feature (414)..(414): n is a, c, g, or t
gaaaatgcnatatccgtgcttgggggccctatgaacntccaaaaacggccgtggcggctaactcaatggaacacattcaagctgtgaaactccttcccctggggggtnaaaggtcaagcatcaatccnagcctggctgcttcaaagacagagtcaagtgagaaacgtgggtcaagtgggaaaagcgcaagcaattgctgctggccaacctgcctcaagagctgctgcnanctacggcaaggactacatcgagcacttgcatgggagttcctgcacntcntacgcctggccatgtccgacctcaccccagttgtagatgccatcacagatgcgctgctggcagctgccccgccgccgctattaccncgccaggcctggggctcatgtacttcatccactactaccntgccntganacggtgcggcgccgcttcctgcaggccttcttcatcagtcactgtctgc

SEQ ID NO: 565175 - DNA, 463 bp, Homo sapiens
gagatatgatggcttagctctggcgctcataggcctgacgagacagatgatgcagaattgaaagattcatgacaaaagttggctacgttcgtgtacatgcacctattaagctttttatggtatgttgtacatttatcttcttcagggtcttcccagccctattagtaacagtgtcttccatagcaattggataagatatgaaactaagaactttattattaattggcttgctattccttggcaatacacaatgaacacaaagattaacaatggcaagaatatcaaacgtacaatttgcccattcattcatatcagatgtctcagtacttatggtgaggtaggcatcatattaaggtacaactatcttagcgcagatgtacctaacatgattaatatatgagaaattatgacatttaatacccgtccaaaactgtcagactaaatgatttatgtccataggtcc

SEQ ID NO: 565176 - DNA, 332 bp, Homo sapiens
  misc_feature (8)..(8): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (118)..(118): n is a, c, g, or t
  misc_feature (135)..(135): n is a, c, g, or t
  misc_feature (229)..(230): n is a, c, g, or t
gggctgtntcctgaagcgctgctcggagccggagcgctactgcctggcgcggctgatggctgacgcntagccgcttgcgtgcctgccttccacggcgtgtnggagcgcgacggnaaantacctgcagctgcagancctgctcgatggcttcgacggaccttgtgtgctcgactgcaaaatgggcgtcaggacttacctagaggaggagctgaccaaggcccgtgagcgnncaaagctgcggaaggacatgtacaagaaaatgctggcggtggatcctgaagctcccacggaggaggagcacgcgcagcgccgttctaccaagccgcgctaca

SEQ ID NO: 565177 - DNA, 182 bp, Homo sapiens
aagttacatatacgaatcgagtctccgtacccagtcatgcaggctggttgagaagacctcctggagcttgaatttattaatgcaagacgtacctcacaaacccactaggttcctgcactaccagacctgtcattaacaatttcggttgtgtggcgacctctgagcataacccaacctccgag

SEQ ID NO: 565178 - DNA, 515 bp, Homo sapiens
ccgagctagggagcctgcgaaggggaggtgagaatacagagaggatctcaggagcctgtctcctaccagggcttccaaggtggcattcagctccttggttattttaccatggttctcatctttgggcctctcccttgtaggtgtagaaacttgcattatcagcaagtcaagagtggccccatttctcagaagtaagaaatgcatcaccaaaccaaggggactggagtataatgagactggtgggagtatagtaagacatttgttgtcacaggtatagaacacttgctataaacagaactgcatgggagaaaaaataaaaccagaaggtcacaaggcaagtagggaatggaaacaaaataagctttatctaaagagaaggcaaagccattgtaattggagcccttggagctctcagcaacaacccctctctatctttacatcagggatgatccagttattgggcttggaacacttgaagaccactagctgaggtaccctctcttccctggatggtg

SEQ ID NO: 565179 - DNA, 93 bp, Homo sapiens
ctctctatatgtcgtgacagcatggtcccagctccctgcaaacaagtcagtttctccccaattccacttctgccctcatccgcttatccaatg

SEQ ID NO: 565180 - DNA, 1659 bp, Homo sapiens
cgccctcgacgagcgagctcgaaggctgcgactggcgccgcctcaccgcctcccaccgccactgaccgaccgttcgaccggcaaactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacgcggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaaaaaaaaa

SEQ ID NO: 565181 - DNA, 206 bp, Homo sapiens
cgtcgtaatcgacggttctctgaaggaaagcgctatccattacagttaaagcctggtcaaataaccagtggacttcaatttgtcatgcaaaagaaaacagattcttattgcacttatgcaaattactatcttgccataagttaagaatactcacaaatggtttccaaagttctggggaactctggaaggagagaacatatgctgca

SEQ ID NO: 565182 - DNA, 636 bp, Homo sapiens
cgatagtttgcgatcagggccacccgttttgaaggagtggaaaagccctactatagtgttttaaattagccagtgttaagctccagtgctagagtggataataccaccccgcatgtgtttcaaatagtggcacttttatgtatcctagttgggttattgttctagactggactgttaaataactatagtttgaggctgggttgtcatattttataaactgtcttggtgttttatggcccattatttattacttttgataacaaccaggatgagctgcatagccatttatagagccatttagaggatgtatttaatagtgccctgtttttaactggattaagaactgggagcatggatccataaaactgatttaaatggtctatttgctagccttcttgatgttacttgccgtccagataactttgattactgttgaagtttgaaaaaagtttgaaaatatttttaccaaactgtggtttttgatgacacccaaagtggaatatctaccagagatagatgtaattttataagactgcccgaattatttgtattaatttgttgctgtagcctttagggcatgacttctgtatttgtgccatcctattctaccattacattcatcctattaccactcca

SEQ ID NO: 565183 - DNA, 1633 bp, Homo sapiens
cgccctcgacgagcgagctcgaaggctgcgactggcgccgcctcaccgcctcccaccgactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacgcggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaaaaaaaaa

SEQ ID NO: 565184 - DNA, 845 bp, Homo sapiens
tgccgatcatgttcagaaatataataataagcgtttaaccgtcgaaatactagaaaatgactgggatatcagcatgacaacatctatcaatcctcgacttaactaatagccttaagaatggggatccatacatgtgctgcatgatcggttgatggggacgaaactgcgtgcaattatacacactctaacaaatctcatcatccactcatgagacgcatatcagtgtgacaatattgctcgtacatcatgcctaagccgtcctgggatgcaaccaagtgggtgcctacaccacgtaatagatctctatactcctcccatatcatgactcattgtgacctaaatgagcttaaccgtttacaagttagatcacttcatgagacacgtaatcttcacaaattgtgcctaaaaagggatgaaatcgggcgccaccattacaacactggattattctacaatatcccattaatgtatcagtcgaaccttctttcaccatttttcccatcggaaatcaaatgaggtaatggtaaaccattaaattgattgcaattaatgattcttaacttgagagtataggccaatcagtttcccttgtgtggggtgattaaattgtgaaaactcgaatattggatggaaaacaggtcgcgtaatattagactgtgatttcggcaaaatataattaaagcaattttcccgaataccttcttgggtaaaggaatggaaacattttgtttaaatatttaatttgtaaccatagaaggaatttttaaccttggaaggctttctttacattggtgaagggcctttaaaagtggggcagtaattttcaagggggaatccaagaaatt

SEQ ID NO: 565185 - DNA, 728 bp, Homo sapiens
  misc_feature (21)..(21): n is a, c, g, or t
  misc_feature (109)..(109): n is a, c, g, or t
  misc_feature (111)..(111): n is a, c, g, or t
  misc_feature (250)..(250): n is a, c, g, or t
  misc_feature (265)..(265): n is a, c, g, or t
  misc_feature (274)..(274): n is a, c, g, or t
  misc_feature (341)..(341): n is a, c, g, or t
  misc_feature (465)..(466): n is a, c, g, or t
  misc_feature (468)..(470): n is a, c, g, or t
  misc_feature (473)..(475): n is a, c, g, or t
  misc_feature (479)..(479): n is a, c, g, or t
  misc_feature (483)..(483): n is a, c, g, or t
  misc_feature (487)..(491): n is a, c, g, or t
  misc_feature (498)..(498): n is a, c, g, or t
  misc_feature (510)..(510): n is a, c, g, or t
  misc_feature (513)..(513): n is a, c, g, or t
  misc_feature (515)..(515): n is a, c, g, or t
  misc_feature (519)..(520): n is a, c, g, or t
  misc_feature (522)..(523): n is a, c, g, or t
  misc_feature (525)..(526): n is a, c, g, or t
  misc_feature (533)..(533): n is a, c, g, or t
  misc_feature (537)..(537): n is a, c, g, or t
  misc_feature (542)..(545): n is a, c, g, or t
  misc_feature (551)..(554): n is a, c, g, or t
  misc_feature (569)..(573): n is a, c, g, or t
  misc_feature (575)..(576): n is a, c, g, or t
  misc_feature (582)..(583): n is a, c, g, or t
  misc_feature (590)..(595): n is a, c, g, or t
  misc_feature (599)..(599): n is a, c, g, or t
  misc_feature (601)..(606): n is a, c, g, or t
  misc_feature (616)..(616): n is a, c, g, or t
  misc_feature (620)..(620): n is a, c, g, or t
  misc_feature (657)..(657): n is a, c, g, or t
  misc_feature (728)..(728): n is a, c, g, or t
acaaagagaaggccgagacgnggcctgggccagtgtctaagggtctctgagtgagtctgtgtcagcatgtgggccccagctgggcctgtccatgggttgggcacagcantntcctgagtaagagccagccccaccctcagggcagcattccagcccaaaaagaaatccaggccctccaggttcggcctgttttcaaggccctcaggacagtcaataaataggttagattctgagccaggcctggaaagtnagggtattcaaaggncaggatganctgctagggatcgtaatgattcccaggtactctcctgcccttctccaacaaggaagtaaataaatanacttttaactcaggaacggggtgttggagcaggggaaccctccccttggagttagtaattaagtctcatgttaaaaacaaggtagccccagcccctaccagcatctacaaaatcctacaggatnnannnaannnctanccancctnnnnntacacantacccatccccncantncctnnannanntctcatntctnttctnnnnctcccnnnncaccctccgcccctnnnnntnncgccannaaaaaannnnnnactnannnnnncggccacacntatnatttttaatcctttacccccaccaccattaatttttncccccccctaaacaaaccccacattcccctaatttttccactcacaaccatttcccataaaattattcacn

SEQ ID NO: 565186 - DNA, 248 bp, Homo sapiens
  misc_feature (131)..(131): n is a, c, g, or t
  misc_feature (144)..(144): n is a, c, g, or t
  misc_feature (146)..(146): n is a, c, g, or t
  misc_feature (169)..(169): n is a, c, g, or t
  misc_feature (172)..(172): n is a, c, g, or t
  misc_feature (232)..(232): n is a, c, g, or t
  misc_feature (245)..(245): n is a, c, g, or t
ctcctggactccagaggccagcggggagctttcctggctcctctgttttctctcactgtagaccaaatagccgcttgtgtgatattaaagccactttagaaagcaaaaaaaaaaaaaaaaaaaaaaaaacnaaaaaaaaaaaangntctttactcggtgccgaattcgncancagtcgggttcaatttgccattggtttctgaaagtattcacatcatttgggataccaganagctcaaaactcnctg

SEQ ID NO: 565187 - DNA, 113 bp, Homo sapiens
  misc_feature (29)..(29): n is a, c, g, or t
  misc_feature (42)..(42): n is a, c, g, or t
  misc_feature (70)..(70): n is a, c, g, or t
ctgaccaaaggcctgatcgcagcttttangtaaattataggnataattacaaatgctgtaatcaaccatnatttacatattagtacatgtatactaagtataaagcttcctaa

SEQ ID NO: 565188 - DNA, 535 bp, Homo sapiens
cttgaggctgaggtcaacacacatcgagcatctgatgagcatgtcatactctgagattcttgcaagcactcgaaacatgaaatttaaccccaacttatttggacatcaagttccttagcacattccaagagatgcctacagttcttcagggtagtgccaaacttcatgttaccctcttcacctccaatattatcttctgttgcaatatgtagtaagaccttggcatgtgggtgattacgtgcaattttcttcaattcaatttcattgtcacatgtcaggatattcactccaacttctgctgcatactttatctgagacacttgcttgtaaggcacttctgtaaatactgtattctggaggtacacccaactcttgcactaaagccatttccatgtttactggaacaagcaaatccggttccaagagctgccaaaatctcaagtacagccggagcagagttgcacttcaactgtgtagaatggcttactctgagatcactacattctggcattgactgtgtcacatatcacaatct

SEQ ID NO: 565189 - DNA, 842 bp, Homo sapiens
cattcgaagaacccgtatacatgaaagtctagacaaaaaaggaaggaatcgaagcccaccaaaggctggtttcaagaccaaccgccatggtgctccagtgactgtttacaaacaaaaaataaaaaaaaagaaacagagacgaaaaaccggtggaggggcgcgaagggagacccaggaggaaggtttttgaagagaccaaatcagttgggggtcgtcgtcggaccacgaagatgaggaaaagtagacaacgggtggtcgaaagtggtgagaccaccgaagaaagaatccgggaggaacagaaacaagagaggaggaggagattcacccacaacaaataagaagaaaaggcccgggaggaggaaaacaccggagaaagcgtatgtgagagacaaaacaagaatctacacaagagaagggagagactgatacgcgacgagaaacaacaaaaacacgagaggaagctcaaatacaaacaagaagggaacgagatacccaaaaggacaggaagacgaagcaaaagaatacgaacaacagtcatgaaacgaaacccacgagcgcacggggtggcagacacagaacagagacagaaaacggacaacgaaacacaaaaagaacgaagaaaaagaaaagaaaagaaaacaaaaaagaaaaaaagaaagaaaaagaaagacagagaacaaagcacaaagaaagaaggaaaaaaaaaagaaagcaaaaaagagaaaaggacaagaagaagaaagaaaaacaagacagaagaagaaaggagaaaaaaagcaacgaaaaaagaaacaaaaccaaagcacaaaaagaagaaaagaaacaagaaaaaagaaaaaaaa

SEQ ID NO: 565190 - DNA, 930 bp, Homo sapiens
tgtgcgctctcgtcgggagtcccagccatgtctgacgagagagagtggtagcctgaggcagcgagctggggaagacgcctcttctgcctgcctccgaaaaccgaggcagcgagcgacccccagcatccctgctggcctccgaaggggcctgccgcctgccgccgcctcgccgccactgctgccgctgcctagtgctcacctggctttggaggctacgacaatgttgtgaatgctgcatgatgcctgttgccttggcagctgccccctgtgcccctgggggccctgtgccatgctgacgtctgctgtcttgccgtgtgccttgtgtggtctcaagcttctgcatgacctacatgtgctatgtgcatgtggtgcttgtacgaccctgtcatccctgcctactgccctgtcacctcctggtgcatgtgattgtgcgctgccggtgtgtttgttgactctgcatgtgtggctgcagggatgtccagctgacctgcgaattgccaggtgagacccggggttgatgcgtgttgagaccctgggtccaggtgattgttggcccgtgacgaagtgttggaacttgttgcctctccgggttcccagtaccctttccctttgaagttcacccttgaagggccccatagacccgtttggacgcgcattggcattgcttagccctgattggctccggtcagaaagtcttcgacgttttaacccgtggcccttaacagtttttggttcacccttcctcttttgaactgtatccaggggcgaaacccgttaacgatgccccttggggcgcccaccgaagggctggctctcttgtgagttcaccacaccactttgtggcttgcacacgcggggcgcataggtacgggcgcccttcgaggcgatcgcccgggtagccagccgcttgttaccacgggtatcccactg

SEQ ID NO: 565191 - DNA, 271 bp, Homo sapiens
ctctaacaggatcctatggagaccaggctgagagtacctcaagattttcaaggcatcatgaagtggcgtgggcatcctggggcaggctagcaccaagatagagagtatgcaggggaatcacatttggctgccctaatggcaagcaggatttaaccctgcaaacatcctaagcttctatgctgtgcaagagtatggtgtagtgtatggtgagaattggtggcattgtcaatctgttgccatcagccacaaagctgcccacctgggtctccat

SEQ ID NO: 565192 - DNA, 319 bp, Homo sapiens
  misc_feature (126)..(126): n is a, c, g, or t
  misc_feature (150)..(150): n is a, c, g, or t
  misc_feature (227)..(227): n is a, c, g, or t
  misc_feature (303)..(303): n is a, c, g, or t
  misc_feature (312)..(312): n is a, c, g, or t
ctttgcaggagcacacgtgtgttctgcatagcatcagtgggctagggggagcaccgtgggacgctgggcgcgcgtggagggtacccccagtgaccctaaccccaacgatccccagagcccgcatgnacagtgagagcctcttcaaggacngggaagctgctgcctgctatcaccatcctgggctgccgagtcccggatccctcgccgaggtgctcatcctgaactcngattgttctgccacacaaggagctgagcctgaagcttcaccaaccagatcatcctctgacgtagggctgccagaanggcccccangctccta

SEQ ID NO: 565193 - DNA, 209 bp, Homo sapiens
gatgtatcgccaacactgtagccttctgactcactcaatacagttctgctctcgattgctgtgtggctttgcgatgtactctgtcatcttggagacttattcatggaccaggggttattggtacctagcttttgggttttcttaggatggctgcgctcattgtgcatggaaagtgctagcccagggtttgcgctacgggaaagcacttc

SEQ ID NO: 565194 - DNA, 295 bp, Homo sapiens
ttacaacccacgatcacctggagtagagagttttaagtttgttttttggtgtataataaagaatgtgactagcctttttcctggggttcctggcataatgtgtctaaaacctttggaattttccaagtgatagaagtatctttctttgttattcatgagccttttggatcataactgagtttatgttaatgagatgattcaggatgggggctggtcaccagaaagaccaaccatgtgataggagggctgatgcttgaggaagtctaatctctggggagtgatcgtggggttgtaa

SEQ ID NO: 565195 - DNA, 621 bp, Homo sapiens
ggaagactggtgattccttcatggatgcatagtcattagtggctttcagtttggttaagcacaatattaatgataagcatgagatgggaaataacattagctactatataccatattatctactatatgccacacactttgaatgtattatttatgcacatacgtatttaatgaaatgaacatgcatatatctgtgttatgcttatacaatgaaaactctgcaaggtgggtagtgatattatttccaggttctaaatgatgctttcagaaggttgagatttttgcttacatttagaagaggtagacccatgcttcaaaccagtatctacttgccttccattcttttagtttttaaatgaaaaatatattctttagagatgagaacttgctacatttcccaggcaggaatgcagtggctattcacatgcgcagtcatagctcactgcagcctcaaactcctgggttcaagaaatcctacctcctcagcttccagctactcgggaggctaaggtgggaggatagctttagcctgggagtaccaggctgcagtgagccgtggttgtgtcactgcaccactccagcctggatgacacagtgacaccccctgtttaaaaaaaaaaa

SEQ ID NO: 565196 - DNA, 513 bp, Homo sapiens
tcattctttttatggttgcatcttattccatggtgtatatgtaccacatattctttatccaatccagcatcagtgagcacacaggttgattccatgtctttgctgtggtgaattctgttgcatagttgttggtagaacaatttattttcctttgggtacatatgcagtaatgggagtgctggggtgaattgtagttctatttttaaatacttgagaaacctccaaactgcttttcacagtggctaaactaatttacattcctaccaacagtgaacaagcattcaaaaaggactttaaaaaaataaagatattttaaatgattcatggctcaatatttagaatttattgtggtagacaataactggtgaatattagggatatgttggattatagctatagctacctttatttacattttcaaatgtatgtgcattgaagaaagaaatttaaatgtgcaggttgccctatgccctcagaatattaaacgaaggcaataaaacatgataaaacaaa

SEQ ID NO: 565197 - DNA, 324 bp, Homo sapiens
ggtcgaccctaaaggtttgggccagttgtggtggcttatgcctataatcccagcaatttgagaggcttagtagggaggatcgcttgagtccaggaatttgagaccagacctggcaacatagcaagatcccgtccctacataaaattaaaaataaaaaaaattagccacgtgtggtagtgtgtgcctgtagttccagctactcgggaggctaaggtgggaggatagctttagcctgggagtaccaggctgcagtgagccgtggttgtgtcactgcaccactccagcctggatgacacagtgacaccccctgtttaaaaaaaaaaa

SEQ ID NO: 565198 - DNA, 173 bp, Homo sapiens
ctagcttaggaataaatgctacttaaggtaggcagtgtatttccgtagtaggcatactttcgttaagacggaggccatttggttcctgggagaataggcagccgcacacttggatgaatacagaccccagtatctagatcgtggatataattgatacgctgaagaccataagc

SEQ ID NO: 565199 - DNA, 619 bp, Homo sapiens
  misc_feature (614)..(614): n is a, c, g, or t
ggaagcattatgaaatgatctgctgcagtgcgtctggagcgccgtaggattcactctttctttgcaccgtaggatggcctgactggccttgtattaacaaagtcatcactagacttcgtactacacgacacgtactacgttgtcgctcacttccactatgtcctactcaagtagcgagtctgtgactttcgtcgcactcactagggagtgcttcattacactcgatttccccgtattctcaggctatagcctagaccaaacctacgaccaaaactccatattcactatcatattcatcggcgtaaatctaactttcttcccacaacactttctcggcctatccggaatgccccgacgttgactcgtgactagccccgtatgcatatcagccatcatgaaacatcctatcatctgtaggctcattcatttctctaacagcgagtaatattaataattttcatgattttgagaagcccttcgcttcgaaagcgaaaagtcctaatagtagaagaaccctccataaacctggagtgactatatggatgccccccaccttacacacattcgaagaacccgtatacattaaatctagacaaaaaaggaaggaaatcganacccc

SEQ ID NO: 565200 - DNA, 591 bp, Homo sapiens
cattgaaggtttaagcatcaaacaacaaattgaagtacagagaatttggaagtggacagacatcctacactacacaacaggtgaaaagatactcacacaactatgatggatatcaaatggaacggttagcatggacggatcgtagatatgatatatccagaatggagcagattgaaataaaaatatgtatctataagatgataacatagtaaacaataggataacaatattacaatagataaagataaataagataaaagatgacagcaaataacgcaagaaagcaaaaacaacaaagcccatcaacagcacacagagcaaacacacaaggacaatgaagaactaccacagataacgagaaatgatcaccaacaacacaaccacatacccacatacacaacacaacaccacaatcccatcctacactcacatcatgcatacaaccataaacgataaacatacaaaataaaaccaaaaaaacacgaatcacaaggagagatacacaaagagcaataaagacacaaagaaggacacaagacatgaaaacaatccacagcaccaccacaaaaggtacaaaaaaaaaacaataac

SEQ ID NO: 565201 - DNA, 850 bp, Homo sapiens
gcatagtagagggctgtgatatacggcgatggctagcctcactataagactcttagtaagattacacatacaagcatacccgttccagtaaagtacaccctactaaatacaccacgatacaaagattggacgagcatacaatgcacgcagcaatagcagctacaaaactgctatagcctagccacacccccacgggaaacagcagtgataaacctataagcaataaacgaaagtattaactaaatgctatactaaaccccagggtaaaggtacaatatatacgtagccagccaccgcggtacacacgatataacccaagtacaatagaagcctggcgtaaaagagtagtatttatgatcaccccctaccccaataaaagctaaaaactacacctaaaagtattgtaaaaaactacccagtttagaccacaaaataagactaactcaaagtttggctatataacataatactataacacacaataagctaaacaaccccaaactagagcattaacgataccaccactaatagctattaaggccctaaaagcctaccaagcgagtcaaacgatacacagcaaagagctaagctacgcccaagaaaacgactaactagagccagcaggcctataaacgagaattaccagaagggagaccccttaagtcgggtaagccttcactcaatatccccctcttaaggaaaggaagccctagtatcttagtaaccttacgaataaaagacccccagaaatccaaaacttcaggctaactatcataagacgccaggcctataataaccgggccgacttaccagcaaaacccttatattaagtgctaccgaagttatagcc

SEQ ID NO: 565202 - DNA, 725 bp, Homo sapiens
  misc_feature (181)..(181): n is a, c, g, or t
  misc_feature (219)..(219): n is a, c, g, or t
  misc_feature (239)..(239): n is a, c, g, or t
  misc_feature (243)..(244): n is a, c, g, or t
  misc_feature (253)..(253): n is a, c, g, or t
  misc_feature (287)..(288): n is a, c, g, or t
  misc_feature (319)..(319): n is a, c, g, or t
  misc_feature (332)..(332): n is a, c, g, or t
  misc_feature (339)..(339): n is a, c, g, or t
  misc_feature (511)..(511): n is a, c, g, or t
  misc_feature (513)..(514): n is a, c, g, or t
  misc_feature (517)..(517): n is a, c, g, or t
  misc_feature (523)..(523): n is a, c, g, or t
  misc_feature (534)..(534): n is a, c, g, or t
ccacgcgtccgtgaacttgtaaaccaatcttgccaagatacaagtgtttggtttttcactacaatgacctcttgttcctcctgtcttgactgctgacgttcctcaatgattctatgtctattttatgggaagcagccttcccataggtttccttttacacactgcagggctatctttatantttaaaaaaaaaaaaaaaaaaaaaaaaagggacaaaantgtctaccctctgggggggnttgnngtaaaaccnttttagcccactttgagcaaggggtagatcccgnngtggtttttttaagctcactggtattaaaanaaattctatttcngcatttntggtgctacctcaaggtaaaacttgtttaagggccttctttggccctagagtctatatacaagtgtttgaaattgtcctctcattgggaaatttatttttaaaatcctgggagtggaattttatttacactccgggtgtaaactctggtttttaaatcctcagaagaatagncnnatnggaacngtgatcaattntggctcctggcggggtggttcaccctctttttgaacagtctttcaagatttaaagtcccgctggtttggccataaccaaggtggatgtccttttcggttcgttgttaaagagaacccttgaggggccggctttaattctgcgattcagatcaggggcttgaccaattcttgttcgacaaacacaaaaaagg

SEQ ID NO: 565203 - DNA, 517 bp, Homo sapiens
  misc_feature (409)..(409): n is a, c, g, or t
  misc_feature (438)..(438): n is a, c, g, or t
  misc_feature (445)..(445): n is a, c, g, or t
  misc_feature (502)..(502): n is a, c, g, or t
tcatgctgttatgttgcccaggttggcctcatgagatcttgccttagcctcccaaagtgctgggattacagatgtgagacactgcacccaaaccccaccacttttttttttcctttttctttttttgagatagtcttactccgttgcccaggctggagtgtagtggcatgatctcagctcactgcaacctccgcctcccgggttcaagcgattctcctgcctcagcctcccgagtagctgggattacagaggcctgccaccacgcccgactaattttcgtatttttagtagagacggggtttctccatgttggccaggctgttcttgaactcctggacctcaagtgctccacctggcgttgggttcccaaagtgctgggataacaggagtgagccactgcgcctgggtnattcccagcaatttttcaaatgatgccgntcaaagncgtgaattgggctaatttgaacagcaaattgttggtgctgttgttaaactgaagggntttaaatgccagttt

SEQ ID NO: 565204 - DNA, 329 bp, Homo sapiens
agagccccagttacaacactacatttacggtcggctgggatgactaggagcaccatggttgtgattaccaacatggtaagataccgaatgccgaaggaccctcactgaagagacaccaaaggagcctgccctcctcccctgctgggaagagacacttggagactgtcccaagggagctgaagaatccagaggcaggggatccggctgctttccatctgagtgtgcgacgagaggactgttcatgatacatttggatatagcattctactctgagaaatgcaacacacggagctacctatcactatcacttagtaatccaaaagatgact

SEQ ID NO: 565205 - DNA, 438 bp, Homo sapiens
ggatacccattatgtgcatctcaccagcatctttattttttgactttttaataatagccattctgatggtgcgagatgatacttcattgtgatggtaattttgcatttctctgatgattagtgatgttgagcattttttcatatttttgttggccacttgtatgtcttcttttgagaggtgtccgttcatgtttttgcccactttttaatgggcttatttggtttttgcttgttgatttgtttaagttctagattctggatattagacctttgtcggatgcataatttgataatatttttctcccattatctttactctgttgatagtttcttttgctgtgcagaagctcttacacataatggggtatcctattcaagctctgtcctcagagagaggtgacaaccatttcaaattctacacataatggggtatcgggt

SEQ ID NO: 565206 - DNA, 181 bp, Homo sapiens
cagtatcatgcgcagcagtgtcataggctgttgtctcacattggatgctggagcttgaagtccacatggcaggctctggagaagagaaggttgatatgaagttggggagagcaagaaaatctcaaccctgatgctggaacttgtgtcactgattgttgacctctgtgtgactttgctctta

SEQ ID NO: 565207 - DNA, 215 bp, Homo sapiens
  misc_feature (70)..(70): n is a, c, g, or t
  misc_feature (83)..(83): n is a, c, g, or t
  misc_feature (100)..(100): n is a, c, g, or t
tctagaggatctcaataaattgttggtcattgatgccaaaacggggattcggggcaggaaaacgccgacnaaggcgacgcatnatagtactgttgaacanaatttccgaatttacaaagttcacgaacatcaacacataccggagattgaacaggaacttgccgaacgggatggggaacaaacaccgatttctatcaatgaccaacaatttattg

SEQ ID NO: 565208 - DNA, 873 bp, Homo sapiens
gttttcctaagacatagttttgttgtctttattttttttattggtttttttggagacagggtcttgctctgtcgcccaggttagagtgcagtgacactatcacagcttactgtagccttgaaccttctgggctcaattgattctctgaactcagtctcctgagtagttgagaccacgggcacatgccaccaaggctgactcatttttaaaaatttttggtagagacagggtcttcctatttggctcaggctgatttcaaactcctaggctcaagtgattctcctgccttggcctctcaaagtgctgggattacaggtgtgagctaccacacctggccaatttactaccatttttaatcactatgatatataaaactatacatgaactgttttatacattagttttggagcctagctccgattattccttaggataagtttaaatttggcagttgctcagaaatgaaaactttgaagatactggtcacaatttggttctatttatgtgtatatataatagggacaaggggggtttcaacatagtgagtggacaaggggaggattgcaggtccgacaaaaattggggcatcatgtgtaagctctcaaccatcagggggattacatggccaatatcatccatttaccaacaagaccctcttttgaaccacaaatttgtgggcccatgaaacaaaccctgggttatgggggtcatactcatatacacggaatagtgctgaaacaaatcagtgtggccccgtgattattacgacaacattccctactcaaacagggaacgttaaatatctctgttgaagatctccgtgataattcgggccagggttatcttagagacaaagtagcggtaaatgtcacc

SEQ ID NO: 565209 - DNA, 260 bp, Homo sapiens
  misc_feature (24)..(24): n is a, c, g, or t
  misc_feature (109)..(109): n is a, c, g, or t
  misc_feature (113)..(113): n is a, c, g, or t
  misc_feature (119)..(119): n is a, c, g, or t
  misc_feature (134)..(135): n is a, c, g, or t
  misc_feature (249)..(249): n is a, c, g, or t
agtcccagatactccgggggctgnggcaggagaattgtatgaccccaggagccgagcaccacaccactgcactccaggctggggggggcacagtgagactccctctcanaganacaagnataaaagataagtanntacctatatatatggatatattagaaggcgcacccaatgtatacagaagaggactccacaggtacttctcacagaggttcataggagtatgtacttcaacactcaggaattcanatgcttggacg

SEQ ID NO: 565210 - DNA, 249 bp, Homo sapiens
taaatttgtattttaaaagtgactcgatttggctgtgcaaggtggctcacgcttgttatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccagcaggagg

SEQ ID NO: 565211 - DNA, 154 bp, Homo sapiens
ggattctgaaacattggcctgcttgtgtaagctcgccgtaagtgctccggtcctgtcacccccatgcgagtgagttagtgcacccaggagctctgtggcctgtagtcgtccaatgacaggggtctccttgatggaccatcagtcctgtggcaca

SEQ ID NO: 565212 - DNA, 985 bp, Homo sapiens
atactgttgttacagtggacgttaaaggctaacacactcacacgtgggcgtttcaccaatatgtatgcgcgcactattataccccgcgtggtcatccagtaagatgttccatttctccgatacatgtcgtcgcgtatccccgctgggggtgtaggcggccacgtcttacaggggttacaaacacccgatgtatagttttcacacaaacattctgtgaaaggcttgtgccacaaacgaaccccttggggagtggttggcttgccccccaattttcctgcgcgtgaaactaggcatcaagtcgtctctttgtgttgaaaactctcccccctcttggtgtcttgtgaagacacccatcacggctgtcccaatttctagcccacccccagtgttgtcgttcaatttctgggccaacacatatcattctgtcgccccctatatcattttcctccgtaatggtgtgaaatctactcccaagcagacactactattaagtgactaaatcatctggccggacaatcgactaaatttcttgctcccccgttgcctacaccggtaggtaaacaagacactccttttctaatcctcccccgagcacatcccaacgatatttatctattctcagtacatcgttctaacttaattgcccgcgccgaaaactcgcgggagacacccagcacatccagcgagcaccacgctgaagaaggggggaacgaccccctgctggtcgcaccccactgcgtgcgacacagccccacttactcctgggagccaccagtacgacaatgcgcgcaccaccacaccgccaaaaacacacggggcgacatgatcattacaaggagacgacaccagaaaaccactagccatagagaggaaaccaacagagaaagaaccaaaccacaaagacggtaggcaaaaaccggccataaatgtcgcccccaccagcacgtcctcctttaataagggaaccacacaaaccaaaatgaca

SEQ ID NO: 565213 - DNA, 349 bp, Homo sapiens
  misc_feature (104)..(104): n is a, c, g, or t
taagcttctgcataggtttgcagtaaggtcttcttttttcaatataaaaggaaagtgtgttgttttctgagagaagatagatgatagctttctctgaactatcnactgggtaggggtaagtcttgatacactgttaatattttgtaataatttagcaaaacattatttttttaaaaaaatagtttttaatgctttatccaaactgtaactatgtcttttgtaattcaaaagcagtactattttccttctaactgaagattttgacaaaaacttgagtctgggaggtcatgagccatgactgtgtcactgcactccagcctaggcgacagagtgagagcctttctccaaa

SEQ ID NO: 565214 - DNA, 195 bp, Homo sapiens
tctagaggatcccgtgtgtcgagataagcagggaatgtactagggatgtaaaactgcaaacttaaaaacctgcatcttcttgaagcattcagttttactataccaaagtggtttagagtcataagatgacctatttttatataaagagttatattatacgaataaaatgttcatacgcattagactgttaaggat

SEQ ID NO: 565215 - DNA, 200 bp, Homo sapiens
acaagacgctacttcccctatcatagaagagcttatcacctttcaatgatcacggccttcataatcattttccctatcttcttcctagtccctgtattgcccttttctaacaatcacaacaatacttactaatactaacaactcaaacggtcagagaaaatgggagaccctctcgaactcatacccgcccgccacacata

SEQ ID NO: 565216 - DNA, 901 bp, Homo sapiens
gagcgggttggagtttgtcctcggatcagtgcggagctaaaaggagactgtgagcagaggcctagttgcctggatgataactagttgtctcccgtcgctcatctcttctcctgtccccgctaatctctggtcacatccttttcgtactccgactccctcgtctcagtcgatgggcacattggacgtgcatactgatctgcgagttcaacttgagttcccgattccgatcgtacactcggatctggtctcgtatcgtgcagtccgaggccgatccgtggcaccgcacgtgagagaggagagcagccctctcgtgaagatggtgacacacgtaccatgagaggtacaagcagaaatgctggcagtatcagtgcctggtgtccggtgggatcgcatactgcagttatcctcggccaagagtatcgtgaaaggcatatcgtctcggagtactgtcctttcagggtgagccaacagggcatagcatgcatgacctgactcatccccttgcgctgaattgtaacacgtggttgcactacaagtgggtggcatgtcctgtataccacgtgcacatgcctcggtcttgtttctgcggagtgactacagcatacttgcaggactatgctggcaatgcatatcagggcttgccggattagtgcacatggtcatgcttccctgcataagttacactatgagaagtgtggacacatacctggtttacaatagggcacgtaacccttggagtaaggtttactaccaattccaacctccgttgatactcatccacagaaagtctctttaccataaaagttaagcaattgaaataggctttgcaaattggacgcaatctcttgaaacgcagggcagccctgggttgttgcatttattccggggttctttgctgggg

SEQ ID NO: 565217 - DNA, 624 bp, Homo sapiens
gtatatacctcagcctgcttgcacgcaggcacatgtaggcactctgcacaccggagatgcttgcaaagacacacaggcacccccatgtgtccacaggccccagtgcaccctcaggttcacacacatatactcacataagtaagaatatgttcagtccaggaattatatagccaggtggattgcaggagcagggaggagttctttcaaatgaaaaataaaatatgggcaaaggaaattctgaaacagctttaaaagaaaaaaagtagaaggagccaagccaacatcttagtgcttctgatgctatcagattggagtgaactaacatgggggctcagtcttgttcctcagggttttgttctcctcttggggcacatccagccctctgcctggcagggcccagcagtggggaagagagaggaaccctggcctgcgctaggagcatcaggacagaggcagccctgcccacagcatgcccaggtcctcactgagcctttcacgcacagggattgctccaggctctgaactgatcccatggtcaaccatcgtttacctgtctgtccagagggatcggtattgtagctccagcacatgggctctgggaccaggctgctcgggttcaaatcc

SEQ ID NO: 565218 - DNA, 164 bp, Homo sapiens
  misc_feature (35)..(35): n is a, c, g, or t
  misc_feature (50)..(50): n is a, c, g, or t
  misc_feature (105)..(105): n is a, c, g, or t
  misc_feature (162)..(162): n is a, c, g, or t
ctgcttcaccatcctggcgtctaccagcctggtgnggctgggtactgtgnatcgtcttcctcaacaaatgcgagacctgccaacctgcactacaccacatccgcncaagaagaagaacctgctgcttcatacaacacggggaggccctgtcattaacattantt

SEQ ID NO: 565219 - DNA, 972 bp, Homo sapiens
  misc_feature (27)..(27): n is a, c, g, or t
  misc_feature (34)..(37): n is a, c, g, or t
  misc_feature (738)..(738): n is a, c, g, or t
aacaagggggggggagaaatgaaaaanaagaaannnnaaatcctgggcgcgtgactggtttattacagttgaaaggatacagattaaaatcagcaatgaagaaaggcacataaggtaaggtccaagagggcttgcaattatcctctcctggcagagtcttcaggataatgcttaattctcccagcaatgatgtgtggctacaatgatgtgtgcacagagtattaccaaccagagtagctcacccatgcctaggggtgcagggcttgtactagggattgatcacattggggggcttcactgcccacatgggtaacttaatctcctcaacttgaccttgcaagggcaagctgatactgcatgggccaagggccacaggtaaacaaaaacactcttatcaggcaagatattctaatgggcttagagggttatctcccaagagccaggcaggggcctatattttatttggaatggtcaggggtcaaacatcccaaggtattgctgtttcacaaaagaggatgaacttaaaaagggggattttttgggcaagggggggtgggttcacaacttgtaattcccaaccccttcgggaggctaagaggggaagaattgttttaaacactgattttagcccaggctgggggacctaagggaaagcccttttcttttgaggattttctgaaaaggggggctgtttaggtgaagtggctcccgcgcgttatgtacagggaggagaaaccncgcaaacaccttgtggtagggatcgccttaggaacaccgtgctccctggttcgtggtgggttgatacgggagattcgcccagttggtaacgctactaccggcagagaggttgtggtcaaagaggaagggggagaaccagtggagccctcgcggcggagagtgtcggggcatgtgcggggtctattgaaggtgtgtagtggttcttcttggaggggatagggtggcggcgcgcgt

SEQ ID NO: 565220 - DNA, 220 bp, Homo sapiens
tcactgtttggtatatcagccagatttctaaactcaagggagatcgttgggaagtctccagcactgggatccttctccttgctctccattggaaccgcccagtctgttggtaaaggaaagagtgaaagttgtgtaacagcgggaccttcttttccacactgatggtcatgtcatcttccagtgtgtccagagctcggagaaccagataaaatatgcacac

SEQ ID NO: 565221 - DNA, 703 bp, Homo sapiens
gcagagtgggactgtctgggtagtcggaaagcaagcctagcgtggctcactatgacgtataatccttttcttttcaagatgcctgaggtaaggtgcaccaaggagaggaggacggtggagactttgcctttcagggcgagaaaagttgtgcccaagctcatgtccctcattcatcaataccttctattccaccaaggagattgtccttccgggagtggatctctaatgcttctggatgccttggacaatgattcgctatgagagcctgacaagacccttcgaagttggacagtggtaaagagctagaaagttgacatcatccccaacccgtcaggaacgtaagcccgtgagcttttggtagacacaaggctactcggcatgacacagaagctgatcttcagtacaattagatttgggaacccagttgccaatgtctggtagctaaaggcgattcatggtaggctcttacagggcgtggtgccagacattcttcgcattgatttgggcagttagcgtgtgggctctctattctagcctacttggagggcctgagaaagtggtctgtgatcacaaagcacaaggattgatgaacagtatgccttgggagtccttctgctggaaggtccttcactgtgcgtgctgaccatggttgacgcccatggcacggggtaccacaggaatctcatgctcaagaagatcagac

SEQ ID NO: 565222 - DNA, 121 bp, Homo sapiens
  misc_feature (69)..(70): n is a, c, g, or t
  misc_feature (116)..(116): n is a, c, g, or t
agtgctgttgcccaggaggaggaccttgagcccactagaaggccaccattggtgcatgtgtggtgtggnntatggattcctgaggtcagtattggttgggcagagaagatggagtngatca

SEQ ID NO: 565223 - DNA, 774 bp, Homo sapiens
  misc_feature (8)..(8): n is a, c, g, or t
  misc_feature (76)..(76): n is a, c, g, or t
  misc_feature (83)..(84): n is a, c, g, or t
  misc_feature (126)..(126): n is a, c, g, or t
  misc_feature (132)..(132): n is a, c, g, or t
  misc_feature (143)..(143): n is a, c, g, or t
  misc_feature (146)..(147): n is a, c, g, or t
  misc_feature (162)..(162): n is a, c, g, or t
  misc_feature (186)..(186): n is a, c, g, or t
  misc_feature (195)..(195): n is a, c, g, or t
  misc_feature (199)..(199): n is a, c, g, or t
  misc_feature (268)..(268): n is a, c, g, or t
  misc_feature (279)..(280): n is a, c, g, or t
  misc_feature (319)..(319): n is a, c, g, or t
  misc_feature (329)..(329): n is a, c, g, or t
  misc_feature (357)..(357): n is a, c, g, or t
  misc_feature (376)..(376): n is a, c, g, or t
  misc_feature (397)..(397): n is a, c, g, or t
  misc_feature (422)..(422): n is a, c, g, or t
  misc_feature (424)..(424): n is a, c, g, or t
  misc_feature (439)..(439): n is a, c, g, or t
  misc_feature (507)..(507): n is a, c, g, or t
  misc_feature (556)..(556): n is a, c, g, or t
  misc_feature (563)..(563): n is a, c, g, or t
  misc_feature (584)..(584): n is a, c, g, or t
  misc_feature (652)..(652): n is a, c, g, or t
  misc_feature (665)..(665): n is a, c, g, or t
  misc_feature (675)..(675): n is a, c, g, or t
  misc_feature (679)..(679): n is a, c, g, or t
  misc_feature (683)..(683): n is a, c, g, or t
  misc_feature (761)..(761): n is a, c, g, or t
acatctanggcacaagtggagaaactttaaaaaatgttgggagattctttttattaagaatttaatcacacgtagngatttgnnggggcacttatggagttctcagcaagtcaatagttaatatcnaaagancgcgtaggatntgnnatcattttctctaantctttctcatgagaattggaaacnacttcatgntacngggacaaaaagaaaaaaccacttactcctcagagagattattttcaaggagttgaaaaaagacagtggnatacacatgtnnaaccagggaaaacaagcattccttagagagatacctgcngggcttacgngatttcaaaggaaacatgccattgactnatttatgagaacctatggnttttcccttttctcgggttanacatttatttgagacaatgcagggngngggctttgtgaaggnaaaagggagaatgttcaattccctttgatctgtccttaaaaaatgacctctttggcagggagtgtgcntgtcctcagcggggagagagtttttaagttagtattttgagttttaganttagtgnaaagggcagagggaggcgcangggccgggttaagctctacttctctctctagagaagaagctaagaagaatcaaaggtttaaatcaggnagtgacttccaangacatgcttngaantctngcccaagccaagaaggaatgctgggatcggttcctccaggagaagttagcttcagagttctttgtggatggacttganttctgatgagagg

SEQ ID NO: 565224 - DNA, 293 bp, Homo sapiens
  misc_feature (162)..(162): n is a, c, g, or t
aggcaggcggattacaaggttaggagttcgagaccagcctggccaacatagtgaaaccccatctctgctaattttttgtatttttagtagagacggggtttcaccgtgttagccaggatggtctcgatttcctgacttcctgatccgcacgcctaagcctcncgacagtgctgggattacaggcgtgaagccaccgcgcccggcccctgttttgttggttttttttttgacactcgctctgtcgccgagaccacgccactgcactccagcttgggtgacagtgagactctctg

SEQ ID NO: 565225 - DNA, 130 bp, Homo sapiens
atctacaggatctgtgctgtgtctcgaagtgcacgtcacggcagtctactcggcttcggcttcacagcgcccaggacagtgccctgctctactaccgggcgtcccggatgggctatgccaggtgtccctg

SEQ ID NO: 565226 - DNA, 1049 bp, Homo sapiens
ggcgtttgctctgcatgttcttcggtcgcccggttcactgcgccttcctggacacattgttcactaatgcccctttgagacaccacagggcttttccttagtaagctttctcccggcttatcccttagtttccacttccctgggttagccttggccgaacttcaaatgtgttttgtgattcccttaatgcccatttcccccgggccagaatgtgcccagcaagtgaagagggcctcaaactttggtatcctgccgtgcattgttttgtgacagcagcccagtgttgcctttacctgcttgtcaaaactggcaaagcatgtcatattgtctttacgcactgtcatgtgggactgaggttcttcagagaaagagtgtgacctgacgacacagtggttgtgacacccactccctgggcagggagttttgcactgtagcttgtcgagactgtcgattggttagtgcatatcgcttggtcactcgactgaaggctagttgcttgatccgcgtcacttgactgatacgtgcatatcaagagatatctagacttgtgttgcgcgggaagggcactgactgtactcatggctaacttacagatatttgacatatacggctgtccctctacaaccttcttagtcacacaggatccctgtagcctaaacagtatatgatccagctgccagagagcagactgctctcagcttgcacagcaccttaggcgagggaagaatatacggatagggaatggggtggacgcaaacggatgggaatgttgtcactaccaaggtggctttagggtcctcaggagtggagaatggactggcaactgcggaggtctggatggatcatgtgtaggagtatccctgtagataaattactgatcccccatctactatccccagtatgtaatggctgaattaatatgtaatcaactgcattgtatctaaagccttagaactagtcacggtgctccctccacccaataccatttcttaccctctaatcctacctgatcttaacaaagcattaatcattctagaggataatctctt

SEQ ID NO: 565227 - DNA, 280 bp, Homo sapiens
tctagaggatcccgttcattttctacacctcattatgggtaactatgcaacacactgattaccaaactcattgataactttaaaacactgctcagtgtttgctttcttcccagtgttattatcatcctgggtgacttcagtgtctagctggagcacttaatcaagctcagaagttccaatgactttcttctctacttatcagggctcaggaattatcagggctcccatgctaattcaaagaatttcttcactttgaaatcaattatttagacatctcatt

SEQ ID NO: 565228 - DNA, 116 bp, Homo sapiens
cgcatcttagatgatcaagctaggtctaggtattgatgaagatgaagcggcagcagatgaacccaatgctgcaattcctgatgagatcccccctctcgagggcgatgaggatgcgt

SEQ ID NO: 565229 - DNA, 338 bp, Homo sapiens
cacgaggtttttttttgagacggagtcttgctctgtcacccaggctggagtacagtggtgagatcacgggtcactgcaagctctgcctcccgggttcacgccattctcctgcctaagcctcctgagtagctgggactacaggcgcccgccaccacacccggggaattttttgtatttttagtagagatggggtttcaccgtgttagtccaggtggtctcaatctcctgaaccttgtgatccacccaccttggcctcccaaagtgctgggattacaggcgtgagccacagtgcccggcctgtatttggtgatattttaaaaaattctactttgacctta

SEQ ID NO: 565230 - DNA, 134 bp, Homo sapiens
agatatctgtctggatctctggttctggaacgttcacagcagatgatgactgcagcttcttttagaaaggtgtccccttgacagttcagaagtagtattagactgcactttgggtgccttagaattagattttc

SEQ ID NO: 565231 - DNA, 293 bp, Homo sapiens
gtaacatattgtaccaataagctctgtagaatccagacaagaataaattaatttaagtagctgatgcagacttttcttccttacccccaactaccatctgcatctgacaaaccgctaaagcagtttctactccttttcactcggatatccttcctatttcccagaatagtacccataacaaaggccagtatgaactaactctaaggtagagcacagagaactggctaaacatgtgtgttcaaattaagcactgtccttggcctgaacgatacaatctggtcatagtacaggaa

SEQ ID NO: 565232 - DNA, 959 bp, Homo sapiens
ttgtagacaaaaaaaaacgttgggaaaccgtgaccccactcgaccgcggaataagtggtctccccaggtctcaccgcggtcgcttcgcacacccggaattgtccacgaccaaggggacttctccggacagggaccaaacaaagcctccaagagtctctcggaacccgctgggcacagaagcgccccccggggagcgctggctgcccggccaggggtgcctcgccccccccgctgcattgcccccgggtgcccccttattggggtcccacgcggcccacaactgaacaaagcacagctccgcggtcaggaaaaaagtgtgggccccgcgttccgggataaaacctggaacggccccactttttcaagtgcatccgcaccaccccccatgcgaaatggggtccccggcgacaaacaccagctgggggaacagttcctgcggcctaaccacccccctggggggggcctccatgcactgttcgcataagcaggccaaccccagcccgcggggggtgatatcacaacagcccagggccacaacaaacagctccgggagccgccaacaggaccaccccacatgtcgcgccacaatgctgcagcaagggcgccagcacaatgtactcccccgaaagaggctgcacccccccgcgtttaaacaccgcggggggagacacgggttctcagacccgtggtgtgatctccaacggggcagcataagtgaatcagcataacacaggcctgggtgaagcagccaccagggcagctcgggacaccctgcaacaagtgaacagagtaaaaatcttttgggccccacactgggggatattctttgtcgcgatggccctgtcaaatgaacgaggattgtttaaaaccaccacaattttgaacggacaacacgcggcgccccacaactggcccccccatcttgggggccccctaacaaggtaaaagaccacaaaaca

SEQ ID NO: 565233 - DNA, 477 bp, Homo sapiens
  misc_feature (20)..(20): n is a, c, g, or t
  misc_feature (67)..(67): n is a, c, g, or t
  misc_feature (91)..(91): n is a, c, g, or t
  misc_feature (188)..(188): n is a, c, g, or t
  misc_feature (327)..(327): n is a, c, g, or t
  misc_feature (423)..(423): n is a, c, g, or t
  misc_feature (472)..(472): n is a, c, g, or t
ctcacacagtactggtgggnctccagcgcaacaatggcgatgatgacttcgattacttgcgccaatnggactccatctacctcgacaactncatccagtacagcgacttcaactcgccgaaggagaagtcatggcaagtgcgctacgacctggatatggagtctttcggtgtgcctgggttgagcttnatgactcgatatgcccagggctgggatgccgactacagcaaggccaacgaagtctatatgcgccgtgatgacaacggcgatccgttgaccaaccagaagcgctgggagcgggacatcgaggccaagtacgtttgtgcangactggatcactgaaggatatgtctttccgtggtcgccaaatgaccacttcgcgcgaacgattacgaagtcggatctggatgaagtccgctgatgncgaagtaccccgctggaaagtctctaacccttggcaaaccgggccgggntgaat

SEQ ID NO: 565234 - DNA, 104 bp, Homo sapiens
tgtgcgatatactggagctcatagtatgtcttttgttctgctgctattagtatcctttctttatccttgacctttgcagtattattattaaaactgtcttgcag

SEQ ID NO: 565235 - DNA, 162 bp, Homo sapiens
ctgtacggcgtcgttttgctcagtcgggagtcgtcactaacctgacggatttcagtatagccaagttcatcagaaagactcaaatggaatgatttacaaaatagaacactttaaaccaggtcagtcctatctttttgtagctgaaggctatcagtcataaca

SEQ ID NO: 565236 - DNA, 445 bp, Homo sapiens
  misc_feature (233)..(233): n is a, c, g, or t
acaaagcgtagtaccatccattcatgcttcgggatgattagtaagcaagacaatggcataccatgtgcttccacttatgaccacttcccaataatgccggccactatcaataaacacatttccagctactccatagctcccctgagctggtgaagacgttcagtgtgtgtgactacttcttggaatgatgactcatacactgttctacatgtcaagattatcatgtggacacncttcagattttcgcatgcagcagattatgggatcccagtttaagatggtatgggctgtttggtcttcaagcttcccagagctcactgactgcggctgcccgcctggcttgaaatggccttgaccatgacagatgtacttcggtgccgctctggcagaccggtgcaccgtgtcagtggttctagcttgatcgttgggtactacgcttgtggca

SEQ ID NO: 565237 - DNA, 356 bp, Homo sapiens
taccgggtactgcactgaccagagtggagaggacagaaagacaagcttgtaggccatcacccaactgccttaggaggcttaggatagtccatagaaagactaatgtcaccagaagcagaaacagaagagagaagatgtaccaggtagcagcttgtccacagggatctgacgtaaaggtgctttctcatggaagcaaattaataataaatgctgtttgtgtgaaacctccactgtgccaagcattaggtcaggtgactgtgaataatttaacatttattcacagatagcatgaaaagccacagtccatttgccatttagcttatttgattgagagaaaactgaggcacaggaaggca

SEQ ID NO: 565238 - DNA, 338 bp, Homo sapiens
tccactgcaagcaataaaggtgctgtagggcttagtgtttaaaagttcctaagcagagcctgggcatagtgcctcatgcctgtaatcccagcacttgtgggaggctcaggtgtgtggatcacctgaggtcaggagttcaagaccagcctggacaacatggtgaaaccccatctctactaaaaatacaaaaattagccgggtgtggtggcgggcagctgtagtcccagctactcaggaggctgaggcaggagaatggcgtgaacccgggaggcagagcttgcaatgagctgagatagcaccactgcagtccagcctgggccaaagacccagactctgtc

SEQ ID NO: 565239 - DNA, 489 bp, Homo sapiens
accctttccgccgctcccgctcgattccactgtggtgactagtaaccacctgccccgcgacttctaatataaaacgtcacctgctgttcacgaggggagaagaacccacggaaaatgaccgtacctataaaacgatgcttcgctagaagagaaaaagccgatgccaactaaccgcctgagacgactaacatacgcacctgaaaccccaaaacaccgacaaaacaaacgcccgcctcttaataaacagtgcgaaaaaacgcgatacgttgtaccacccactatcgaaaacggcccacccacaacaaaacccgagaatccgtctaccaaacccaatctaaaccccgttcggcaaccacttggcaaccgtccgaaacacggctctagttttccccccgcaccaattatacaatgaacgacgccactgttacaaaacacggccacttttgctaccccccccgataaaaactagggcccacgtcgaccccccca

SEQ ID NO: 565240 - DNA, 727 bp, Homo sapiens
ggtgcacactctaatcccaactacgggaggctgaggcatgagaatcattgaacgggaggcagaggatgcaggagccgagaggtgcacttcactccagccggacaacagagcagatcgtctaaaacaaaacacaaaaaaacaaaaaaaaaacaaaaacaaatttgggcggccggcctcggaaaagttaaacccctcgtggggccggggccaagtaaggaacggggcaggggtcccagggaccccgggcgacaggggggtccccaaaaaaaaggccgggggacccgggggttgtagaaaacaccccagagggggagtcaggagggaccacagcgggacctatcacaagggagggccaaaagaggagcaccagattaacaaatttacggccggctcggggagtactacatcgacagacaaccacagagcgccaacagacgtagcagcgcgagcgacaacgagcgcgcaaacgtagacggcaggaaacaggacagcgagccggcagagcgaagacgcgccagaagacgagagcaacgacaggcgcagacacagacagaacgacaaaaggccgaacgccagaacagcaacacgaaagcagaaagacaccacaaagaggcgagaacagaagaaaagacaacaaagcaaaagagcaaacacagcacggacacacgcaaggcagaacggagacagagacgcaggaaggagggacaacagagagcgggcgcaccaa

SEQ ID NO: 565241 - DNA, 523 bp, Homo sapiens
gtcgacggtatcaataagcttgattctggtacgggagtggggcttggggcctcagggtgcagctatatgtgggcgtcagaagtggcattagtgctatccacagacaacaaaaacaaccctattggccacttgtgggcttctataggggtggatgatgccttgatgatttccttggatgtcatggctaagccattgttttttggcagctgcagcttctgaagatgttactgagagccacagagaaagtgaagacggctaagacaaccaggtcatgcgagacatgcccaagacgcccagattgcttaaaagacatttgggaaaagggagcatttaacagttctttccacgaggatggataggggacaaaaactaaccttggagagcctaattttttcatttcccaggccgaatatgacttgaaaacaaaaaaaatcacaggtgttcaggaagaaaactaaaattggctgaaaaaatgtctctgcttttactggtgatgcaatacaaggcatcatccatttagaag

SEQ ID NO: 565242 - DNA, 237 bp, Homo sapiens
tcgtcgttttgtatagctttatgatagctaatgaaaattagaacgtttcctgggatctactgtacaaggatttttaagaaaatcttaaaatgccttttcttcaatgaagccactcttcggagttagtcattactctctccttatcagttatcttgacttcaacccgactattcctcttcttttggtccagaaccctcaacatttacagagtagcttgaacgttaacggaaaggatca

SEQ ID NO: 565243 - DNA, 262 bp, Homo sapiens
tccaagccatttcaggatggtggcctctgcttcctaggagctgtattcattggccgtataagcagatccactttggagttgttaggcttgtatgggttacccggtgggcggtagatgagctttggcccgtatggtgtcgtgggaggcaaattcaatatcattggtgcgcgggggcgcatgtcagccacgcggagctctagtctagggggtctgtcagtgacttgctctccctcctccctctgtttggccttattgtcctctt

SEQ ID NO: 565244 - DNA, 1118 bp, Homo sapiens
  misc_feature (1087)..(1087): n is a, c, g, or t
ggcggaggcgcgcgcaggtgctggcggactggccgctggtagcagtacgcagcgccgcgggcccttcaggagtggccgcagtccggagctttgccctcgcatcctgttccaggcgcgaggctggtgtgatgtggctgggagccatctgtgggcgccatggcaaagagggaggacagccctgtgcccagcaggtccagccaataggacatagcagttcctggtatgcagcatctgcctggatcgtgtacctagtgctcccaaggcttcttccttgaccttgcacactcttctgtgcagagatgtctccaaagagctatatcccatgacccagcagccgtgacgcgtattcctgtccagtatgcgcggcagactgtccatccatccgcgagagtcagggacgtctcgagcgacgtgcaagaacgaacgttcttcatcagacagcctcatggaaggcaaattgcagcgatgtgcaccgtgattggtggcccagcggacgcctgcgaggaacgcttccgcgatcactccatcgagatgtaggtacggcttgtgccgccatcatcgtctcttgtcgccaaacatgcaaggcaattgagcgcatggagtttaaactgttgcagcgcctgtgcatgacggacactggatgtagtcaggtgaccgaagcccggtggacgacatacgttccacgtcacttggccaacagatagccttggctgcaggggcactcgtgggatgcggagacacgtcaccaaacgagtcggcggcccctttccaggcattcaagccgttcgggacgcgcttgtttggcagttgagccccgcaatttggcccactaggcatcgatcccggcagactcagtttggcccttctcacgattcggggcggatgctcattccaaggccctaagaccaaggcatatgtgcccgggaaacttgtccaattcgtgcaagacaggtggcgccccttggggctcgcaagggaaattccatgcttaggcatagcctagtttagccagaagcgagaccccccttgtgggcacgcccaacacacacgctttgggacatcgccaaggcgtgaccacaggcacccngcgcctcattggggttctaggaggaaccccg

SEQ ID NO: 565245 - DNA, 325 bp, Homo sapiens
cctgaaggagacggtgcgccaagccctgcaggagacgctgctccgggaggtggtgcggaaaatcctgctgctgcagagctggttccggatggtgctggagcgtcggcacttctaactccatcttctttctgtcactgcgcacccccgaatacgggggccagcgatttgcataaccaaatgatcaagagcatcaaaggattgcctggcagggcgaggacccccgtagccttctccagtccctcagtcggctccagaaaccccgcgccttcatcctgaaaagtaaagttatcaaacaaaagcagatcattccaaaggtaaaaaaaaa

SEQ ID NO: 565246 - DNA, 434 bp, Homo sapiens
ctgagcctcctgagtatctggcgggagggttgcgtgacgccaagactggctagttgtgtcgcatgtcgactaagacattttatgcgaggcctcttcagaaaaaaccttaagggaaatctgatggtgctcagtgaatctaagtctgcctaaacgcgatcctctttagacgtgcttctagatagtatctctgttggccttgcttagcctttttctgtttccacttcaggtggctccaatgcgcgtttgttgtttcataacgttgagtgcttggggtttgacaggtagtgacgtgtagtttgacactgttaacttgttaaaatacagtgaacagagttggctgacgctgaaggaactgctgagaaggatggtaactgactttgtacgaataaaagctcttgcttagaaaaagaacacgataactaggacaaagattg

SEQ ID NO: 565247 - DNA, 480 bp, Homo sapiens
  misc_feature (461)..(461): n is a, c, g, or t
actctagagatccatgtagaaggtgttagtgatctgattcgaactgtgatgttctttgaaccttctctcttgagtccagagaaagaacttcgtgatattgtcttagtgactctagggtgacacggtactgcaatcagcttcataaatcgtgtcttctttagactttaatttcacatcaaaacacactgtagcatttatgcatactgtttcctttccctccatatggcagtttttctttggaatattcactttatttggctcaaaattcatggtcactttaactacggtcacatctcgggaccagaagagggcagcaccaccaaggcccccaatagtcacacctgtcagaccgtcaccatttaaatccatttctccgtggatagactgggcaaaaaatttcagtgtcttaccatccccacctgatggaatacgttgtgcatactctttccttatagtcttgncacttccatgatacatgtc

SEQ ID NO: 565248 - DNA, 595 bp, Homo sapiens
  misc_feature (43)..(43): n is a, c, g, or t
  misc_feature (76)..(76): n is a, c, g, or t
  misc_feature (82)..(82): n is a, c, g, or t
  misc_feature (112)..(112): n is a, c, g, or t
  misc_feature (115)..(115): n is a, c, g, or t
  misc_feature (147)..(147): n is a, c, g, or t
  misc_feature (175)..(175): n is a, c, g, or t
  misc_feature (206)..(206): n is a, c, g, or t
  misc_feature (234)..(234): n is a, c, g, or t
  misc_feature (241)..(241): n is a, c, g, or t
  misc_feature (244)..(244): n is a, c, g, or t
  misc_feature (259)..(259): n is a, c, g, or t
  misc_feature (263)..(263): n is a, c, g, or t
  misc_feature (268)..(268): n is a, c, g, or t
  misc_feature (272)..(272): n is a, c, g, or t
  misc_feature (281)..(281): n is a, c, g, or t
  misc_feature (283)..(283): n is a, c, g, or t
  misc_feature (288)..(289): n is a, c, g, or t
  misc_feature (297)..(297): n is a, c, g, or t
  misc_feature (320)..(321): n is a, c, g, or t
  misc_feature (336)..(338): n is a, c, g, or t
  misc_feature (380)..(380): n is a, c, g, or t
  misc_feature (396)..(396): n is a, c, g, or t
  misc_feature (421)..(421): n is a, c, g, or t
  misc_feature (424)..(425): n is a, c, g, or t
  misc_feature (479)..(479): n is a, c, g, or t
  misc_feature (487)..(487): n is a, c, g, or t
ctagaggaccctgtgtacaccaaccgcattgaatttgataccnactattccacagatgatgacattgtgtttgagnactttncccggcttcggctgaaggggatgaaggatnacnactatgatgatcaactctgctaggaaccgggntgggaagaagggaggggatggggttggnagaggtgagggcaggattaagatccccactntcaatgggggattgtcccagcccatctnaccttcncanaacctggaagcttcntcanccaancccntcacactcncnccaanncccccccnagatacacactggaccctctctnnctgaatgtgggcatnnnttttttgactgcagctctgcctctccagcccccccgtgggtngcaagctgtgttcatncctaaattttctggaaggggacacnccnnagaggagtgacaggagggaaagggggacccaaaactcctactctcaacctcacnccaacacntcccattatcactctctctgcccccattccttcaagaggagaccctttggggacaaggccgtttctttgtttctgagcataaagaagaaaagtaaatcttttagtaag

SEQ ID NO: 565249 - DNA, 338 bp, Homo sapiens
  misc_feature (222)..(222): n is a, c, g, or t
  misc_feature (230)..(230): n is a, c, g, or t
agcggctggaccaggtccgactctatggtgcagtgcatcatagaggagtagtgagagctcatcatcgcgaggtgggcagagatgcacttggagatgtgcttgaaggacagggaggaggagggtgcctgcatgtgcttaaacatatatgatccggtagtgtcggtcgaagaggagtcagtgaagagtaaggggtggtcagaatctcctactctcaacctcacnccaacacntcccattatcactctctctgcccccattccttcaagaggagaccctttggggacaaggccgtttctttgtttctgagcataaagaagaaaagtaaatcttttagtaag

SEQ ID NO: 565250 - DNA, 603 bp, Homo sapiens
ctagttctagttcaagccaaccccatggcctccatgactttttcaaaaaaaaaaaaaaaaaaaaaaaaaaaaaaaaaaaaaaaaaaaaaaaaaaaaaagggggggggggggggaaaaaaaaaggaaaatagaggagacaaaagaaaatagacgcgaaacaaccaagcacatgtcagcacaccaatttggaccgcacatcagaaggagaacaaaacaagagaagaacaagcaaaaaagggcgcgcataggtaaaaaaaacaatggtaatgagcggcaaaacacgcaacacaacacgctgaaggagaactctcagaagaagaagaaaccataacaccactatagaatgagacagagaacacacataagcgagagagaccaaacaaaaatcacaacaaactgagaataaatcaaaataaaaccccaccaagagcaaccatatactaatataataaagaacaggaataaaaggagggagaaacacacagaacaacacagcggaaacagtcagccacgttcgaccagacaactactaccaataataaaagaaaaaaacgaaatacgacaaaacaaataataacagacaagcacaaaataaagagaaag

SEQ ID NO: 565251 - DNA, 347 bp, Homo sapiens
  misc_feature (9)..(9): n is a, c, g, or t
  misc_feature (68)..(73): n is a, c, g, or t
  misc_feature (91)..(91): n is a, c, g, or t
  misc_feature (107)..(107): n is a, c, g, or t
  misc_feature (127)..(127): n is a, c, g, or t
  misc_feature (152)..(152): n is a, c, g, or t
  misc_feature (161)..(161): n is a, c, g, or t
  misc_feature (163)..(163): n is a, c, g, or t
  misc_feature (171)..(171): n is a, c, g, or t
  misc_feature (204)..(204): n is a, c, g, or t
  misc_feature (240)..(240): n is a, c, g, or t
  misc_feature (247)..(249): n is a, c, g, or t
  misc_feature (254)..(254): n is a, c, g, or t
  misc_feature (258)..(258): n is a, c, g, or t
  misc_feature (269)..(269): n is a, c, g, or t
  misc_feature (294)..(294): n is a, c, g, or t
  misc_feature (296)..(296): n is a, c, g, or t
  misc_feature (304)..(304): n is a, c, g, or t
  misc_feature (326)..(326): n is a, c, g, or t
  misc_feature (328)..(328): n is a, c, g, or t
  misc_feature (337)..(337): n is a, c, g, or t
  misc_feature (339)..(339): n is a, c, g, or t
  misc_feature (344)..(344): n is a, c, g, or t
ccatttgcntccttaacattttccatgttaagttcatacatgtagatatgatcagatttaccattttnnnnnntttgagggaaaaaaaggngtatttatcatcagcnagatgtgctcactgtatgcnccgttatttatatgcaaggcccggntgactggcngntcagtggncaggcattttaataaactggacagccatttgtntctgcacgacaaggcatctttacacaggggccatcnggtgccnnntggcnaccnccaagccctcngcactgcaacacgccaccttaacancnaaccagcnttactcaactgccacaccactncncctagtgcncnccccnccc

SEQ ID NO: 565252 - DNA, 1385 bp, Homo sapiens
gccgcctagagtgctggccgagcgcggggctgggcaggcgagctgcggaggaggctggcgacgctgtggacagaagtggcggttgctgacgcctggaaattcccctgaaggttggagcagcaaccaaacccccttggggatcccaccccctgagaagtgccgatcaagcgtggacgaggcctaacgactttcttccggtactatcgagacgtctcataagagacgggcagcaagctgtagcctgcttagcagagatgcttggctgggctgtggtggcttggcacctgcacagggtgatctgttgagccacggcccatggatgatgctgacagatccagcctggcaggattgcatggggcgcatttgcacgcaccagaggaacggatcctgtggctgacaccagggccaagctactacggcgccatgggagtgtgtagcccaggcacctcgagttggatggcttccagacattgccaccattcggggcacaaagggggcaacaccaaggatagaacccagcaggacacttaggattgcagagagacccgtgggcaatttgaccagggtactcattatcaaaaggggcgacatacgagggtgccaaaggctgtgtcatccagaggggacttgtcagccacataatcttcatagtagcgatagatacctatacacccaggactactttatggcccacaacgcattggatagcccaagacttgggtggcccagaccccgggactggtcccagaagggaagaaaaagtcaggccctattcattaactggttagatacccgttcaccttgggaccgcgggggtttggtgttggggccttgaggcggcaagatttagaccagacacgacgttagtgggacaccggatctagaacaccgcccgtgtaggaattgatggcgtatgaaaaagacacgggcgaggggattccgcaaggtgtcaaccgtttacacaggcagaagaggccggtacgaaacggtggcacggagacacaacgcattacagatcgttggggagaaacattccgttgggaacacttggtgtgcaccagtcgggaacaggaacttccctgtacgagtgaacgaatgggagcaccccctcaaggagacgtttcccattcaaagtggggcggccagtttagcattgggacaggacgccgactagggttacaagtccggacgccgcccacttctataggaggcggacaattccggacaaacaaggggatcgggacataacaattaccattgaggacagattcgcgggaacaagttcaccatgcatatgagcagcgattgcatagaaagaagaatacacaccagaggggcagtacaaagacccaagagcagccccacggatatacacaacacccaag

SEQ ID NO: 565253 - DNA, 451 bp, Homo sapiens
  misc_feature (445)..(445): n is a, c, g, or t
ggcattaaatatttcaaactgttgtgcaacctccgctaccatccatctccagaactttttcatcctcccaaactgaaactctacccaataagcaataactccccactgccccttccacccagctcgtggtaactccaacttcctgtctctatgttttgggctactctagacaccgcctataaatagaattacgtgatatttgtctttttgtgcctggcttctttcacttagcataatgtcttccaggttcatccatgtcgtgccatgtgtaattcctttctatggcggaatagtattctaatatgtggatatcccatattttgttcatccattcatttgttgatagacacttgggttgttcctacctcttgactattgtggaataatcttgctagggtacatggggtgggacaaatatctgtctggacttccccgctttcaactntagaaa

SEQ ID NO: 565254 - DNA, 188 bp, Homo sapiens
gctctggagtaccccatgagtccagcttgttcaaagtaaaagtggcaatggctttgggatcacaaaacagcccttgaacatcaaagtcaattagtagaaacccctaaatatcatggggcaaaaaatatttcaaatttacttaaatattcggtttatcagatgggattgcaggcgtgagccacggtgtc

SEQ ID NO: 565255 - DNA, 265 bp, Homo sapiens
tatctcatgaggagagggaaccatgcagagacactgcatgaagctagagaacaacgagatgaccgaatctattccttcaggatctcaagaaaccagaaatgtgatgactgggagagcgggctgaatgcaatgaagtgtgcattacatttggccaaacatgtgcatcagacactacatggacctgcacacactggccactgaccaaactgaaccccattagtgtgatttcatcgcgacacattacctgcatgagcggtaaaagctt

SEQ ID NO: 565256 - DNA, 146 bp, Homo sapiens
gggggggcggtggggcgggggataggagtgattgctaatggggtcaggcttctttttggggtgatatgttctaaaattgattgtgatataattcacatgctacaatgcactcattgaaagggtacaacaatttttagaatttttag

SEQ ID NO: 565257 - DNA, 427 bp, Homo sapiens
atcatttgtggctctggttttatggtttatatccgatattgtcactgtccagtctcactgttcctaatgccccctagtccttcaggcatcacagatttgaagtgtctttggtatctgatgcctttcttttttttgtttgtctaatgatatcattgaattaacctagtccaatcatctgtttccaaaaaggatgccgcaaagtacactggaataagattctagcttcaggcctctgaattatcttaaagcctactctagtgtttaatcacctgaatcatcagggagtttcttcttccatttcatgttattattatattttcaaaccatttgctctatatgggccttcaggagagggccatatatcagcctcctgcagcctgcaaagttggtgccaggctgctccattgctcattgggttccgatgggg

SEQ ID NO: 565258 - DNA, 172 bp, Homo sapiens
acttctattttattggttctgagagggaggattcacccaggggatccttttccctacactctccccaccaggctggtctcaaactcctggacttaagtgatcctccctcctcagctcccaaagtgttaggattgcaggcatgagccactgtgcctggcctcagctttgagtg

SEQ ID NO: 565259 - DNA, 823 bp, Homo sapiens
  misc_feature (662)..(662): n is a, c, g, or t
tggatactggcctaacttgcttgtgctgtaaaattaggttaacggggaaataactggaggagtgagggctaggcttgggtttaagggttcttagtgaaattttcagtgaacaatccaaggcttatttgggttaagaacagggtgttttaaatctcagtgtagggtggaataaaaagttttatgagtggggactttctcaaactattttctctacaggcttttcagtgtaaatttagtcttgggtctcgtgaaacttctctaagggaattgggtactttttcttggaaatttattccttattccctcgtgggcagctaaggggctcttaccagcgtttaaaccacaaatttttttcttaaccaaaattactactattataacctacggttccatgtccatgatcccttcttttcctccccaccctgaaaaaaaatgagtccctatttttccggggagaggggggggttgctccgcaacaaactgttgtgtgtcccattcacacttggggctgtggcatttctaactgaggaggcccagttgtgtgtgggcttcatgcttgtgggtcccattacactgtaggtgtgtggttcccaatcacttgtgggtgtaaggagttcgttggagcccttatacgcggttaaatgggccctaatcttctattntggggggccaaatacctctggttcgcttgttgtgccccctcttcttggggcgtttggaaagggggttttggcccccgttaggcggctttttgtgccccagcctctttggagcctgaggggggtgttccccgggtgggggcgcccctatgggagggcttaag

SEQ ID NO: 565260 - DNA, 232 bp, Homo sapiens
gaggatcccgtgggcgacggggtctcaggaggggaaggtcacaatggtattggtcatcagtaaagggtaggaactgggctatattcacgttcttttgggtggctcttcgagtggcctcaggccatctggatgtataagtgcaggcttgggctcagaagcctgagataggtctcatacctccctaaaatgtataaaaccaggctgtgcccccagttcacttcaggggcaatgg

SEQ ID NO: 565261 - DNA, 338 bp, Homo sapiens
tcgactctagcaggatcgcgtcgacggtaccaacacaagagtatgagatatggtgaaaccatagagatagagaccagttctatggcttaaacatgctacatagtccaggcacaacgtagtgattaggcatccaacagtacgtacaataaatatcgttaaattggctggccgcaggagcgagaaaaatggtatggttggagtaggacccgagacgatgtgatggacatgagtaactccagctggcgcctctacattgatgtcgggaaactgagaagagaatgaggtcaacattgcagtgatgaaaatgtagccgtgacccttaggcagggtctcgaatc

SEQ ID NO: 565262 - DNA, 658 bp, Homo sapiens
  misc_feature (521)..(521): n is a, c, g, or t
  misc_feature (548)..(548): n is a, c, g, or t
  misc_feature (622)..(622): n is a, c, g, or t
ttgagtaccccaaaatgacacaaaaagtgttcatcttaaggagtgagcaggtgaaattcaattcaacaagcattgattatcttgttagtaccaagcacgctgctaaacactgaggtaggccagacattgttgtttttgtgactttcacaggcaaatggaacaatgacctatacatgataaattaaaacaaaaactcagactgatgctatgattaattctccaaatgcaaaatgctgtgaggtcagggcctgtgcctgcctagttcatttccaagtcccctgtatctagcatagacatggcctagcacagggtaggtattcctttgaatgattgtctaagtgctttacatgctttatcttatttcctaccaggtggattatatggtgtcttcattttacaactgagggaactaagtttagaaagagtaattcatttccccgtcacacagctactagcagcttagaccagggcttttcagcatcggcatcattgatatttgagctggatcattctttgctgcnggcaaggggccaccttgtgcattgtangaatgttggcagcatcccctggcctttagtcaccggatgccaagaacacactcttactcacttggaacagtcanaatgtcttcagatgttgctgtgtccctgagggggct

SEQ ID NO: 565263 - DNA, 339 bp, Homo sapiens
  misc_feature (47)..(47): n is a, c, g, or t
gggggttaaaattttttgggggggggccccccgaagcccccccccgngggggggaaggggggggccccccggggccccccgttttttttgggggttttttttccccccccccccccgggggtttttttgggggccccaaagggaaggggggggggataactttttttccccccattggggggggcccccgggggggggggggggggtcccccgggttccccccccttggggggggggaagggggggggaaaaggttttttgggttttttttcccccccccccttgggttttgggccccttttttaaaaagaaaaaaaaaatttttgggttttttcccca

SEQ ID NO: 565264 - DNA, 89 bp, Homo sapiens
aagtcccatcagcaacccgttttttaccagatgtcactcaagaatgcgcccgtggccctccagttcctgcgcactaagagcgtcccgct

SEQ ID NO: 565265 - DNA, 187 bp, Homo sapiens
cctaaaacctttttattttgttttattttgaaagatgagcctttgggcccccccctcccccttttttgtcccccaactttaaaagtaaaaaggcttttggtttccctgggagtgggtggaggcaaccaggggtttcctgtacccttactttagaccagttgaataaaagggcccccctttaaaatta

SEQ ID NO: 565266 - DNA, 558 bp, Homo sapiens
tgtatatgagggggtttgcttctgtcaaaatttaaaacattttctttatgtttctgattttccaaaaagaacgtatttcaatttgctcttttcatgtaaagcattaggaagaagtcttctgagctagccaaaatactgcgtttgaaattgcaaggtcagttcaggcactctgggtagtaaccatcaggtggcgccgctctacagcttttctaaacccaacatgaaacccttcagactttgaaataagcaaggaggttagagcaatcacaggaaactgatacagtcaccaaatacttaagctcaatgctatggctttcctaggtgatattaccaaaatgcttggatttctatgttcatactacctgttgtcattcctcagaacttagagaatttaagcagaaacgtgttttaactattctactaagaaccaaaaattttaatgtttgaactttcaagaaaaaaattttttttattaagtggtcctgagaaccttacaaaaactttctatttttcctttttaaaaaccaatgcaaaccccacttgggcttggcccagggt

SEQ ID NO: 565267 - DNA, 410 bp, Homo sapiens
aaaaacagaaaagacaagtgtgacctaataaactaaacagcttctacacagcaaaagacactagcaacagaataaacagacaacctaaagaatggaagaaaatgcccacacactatgcatctgatgaatgtccaatatccagaatctacaagaaacttaaacaaaataacaagcaaaaagaacaacaactccattaaaaagtggggaaaatacgtgaagagatgctttttaaaagaagacatacttgtggcaaacatatgaaaaatgctcaacatcactgatcattagaggaatgtaaatcaaaaccacaatgagataccatctcataccagtcagaatgcctattattatactatgcatctgatgagttccaatatccagaatctacaagaaacctaaacaaaataagc

SEQ ID NO: 565268 - DNA, 930 bp, Homo sapiens
cgtccctcctccgctccggggatgtttagacccccctgtgcaggtcctcacaagggacaccggcgccttttgtgtgaggcttcctatcctccaggggtgggccgacagattgggtatcttctgtgcacccggcgctctttctatgaagtgtgtccgctgcgaagaccccgtgatgttgggggcgaattatgtccccccgccggtgcttgctgtctcttcgggggtcctacaaccaccccgaagggcgtccctccctgatatgtgtccaggcaccgcccctggagtgtatcacccaggagagagttgtcgggacttcataagaaccatttctctgcgcgggctccctgcggcgtctttcatattgcgcaaaacgttgcgaaaggatgttactactattaccttctaacaaagaatcgccttactaaaatttgtattgtcctttcaacattgttcctaaggccatcctcgtcgtatttgtatatgagacccacattaataatcgtggacaacattgtacgctacgaaatagttctgcttcttaattcttccccgaccacgccccaatgtattctctcgtggaaggtgaagaaccttctgagaaaacaactttcctcgaaaggaacttgcgggtatctcacttacaaatttttcgacccaacattgcagaccacacacccagtgttctaggagaaacccgcttcctcctgtgtgctcaccaaaatactttgaaggagtaataataatttgtgtgctaactcttctcttctcgtgaatgacctgtggataccctgctcttactcctatggctatttctccaagtttgcaatacttataccacctctagaagttccaggacaattgactattttgataggttccttttcttcatttgtattactcctcaagaaaaatttggacaacccacaaaac

SEQ ID NO: 565269 - DNA, 835 bp, Homo sapiens
ggggtgttcggccctcgtggcgggtattttttagaacaccgcgtggtaaaggggttttttagcgcccacgcaaaccggggtttttttccccccccggggaaacaatcgtttccgccgccgctctttgtaggcgaaagaacttgtctttccgcgcgcgggagacgattacgcgccgggtcgtcccttgagcttgtgttccctctctgggaggaattacacactgtggggggcgccaccactctccccagtgatggggagaaagtgcgccctctcccgcgcttgggtccgtgtagtcaactctcgagcctactcctgcgctctccctccccccccatacgtgggtaaaaacttgtgaaagaattatgggaaaactctccccctgtgtgaataacaaggagtaaattctttggtactcaccaacaggatgttctttccgcaagattgtttcccccctccctatccacctctgtgtcgcgcgcaccaaaacacaccggttacccactatcttctccccgtgctttattaacaaggggtgaaaaagttgttgtctgaggcggcgcgaacaaaacgttccgccctctgtaaacgtgtaactagtcttctaaatggttaaccccccccccctcacataatctctcgcggccctacgttgtccactattgggtgaaagtgatgaattatccggggtgctctctaggggctatagaaaacaaggggtgaaaaaacctgggtttttaggaaaaatagccccgacccctgtattgtgactctttgagagactattcgccccctttttccctccaattaaatataaggaaaaaccccaacaaaaaca

SEQ ID NO: 565270 - DNA, 344 bp, Homo sapiens
tcatcatactatactgcaatcccattgaccctcaagattcaacagaccgtcccctccgcaaccgctcttcccccccaccccccaatctcatcccaaaaccgtctcatccgagcagtccgtccccctctcacccctcctcctcttctcagccctggggtacctcatcatcaaatctactcccccaaagtgtatccaggggctccacgcccgcctaccccaaccgattccaccgccattccggtgtcggggagggtcactcaccttcccggggaggcgctcaccacccactcactacctgcccttgtcaatcgatctccggcatctacaccctccgacccggcacc

SEQ ID NO: 565271 - DNA, 474 bp, Homo sapiens
ctcaacgctttatacttcatgcctactaattcatcttctttttttttttggagacagagtctggctctgtcccccaggcggggagtgcagtggtgcgatctcagctcacggcaacctccgcctccggcgttcaagcaattctccggcctcagcctcctgagtaactatgattacaggcttgtgccaccacgccgggctaatttttctatttttagtagagataggtttcactatgtgggccaggctggatctggaactcctgacctggtgatctggcccaactcggcctcccaaatgtgctggggattacaggcatgagccacggcgcccaactcaacttcttttttaattaataaaaggatcactcactcacgggcttcatatataatggctcttggaatatatatagtagacggcagtaaagtatactcactacatattattacttccttttttaaaaaaaaagggaagtat

SEQ ID NO: 565272 - DNA, 481 bp, Homo sapiens
  misc_feature (3)..(3): n is a, c, g, or t
  misc_feature (29)..(29): n is a, c, g, or t
  misc_feature (47)..(47): n is a, c, g, or t
  misc_feature (135)..(135): n is a, c, g, or t
  misc_feature (151)..(151): n is a, c, g, or t
  misc_feature (164)..(164): n is a, c, g, or t
  misc_feature (186)..(186): n is a, c, g, or t
  misc_feature (217)..(217): n is a, c, g, or t
  misc_feature (277)..(277): n is a, c, g, or t
  misc_feature (302)..(302): n is a, c, g, or t
  misc_feature (435)..(435): n is a, c, g, or t
  misc_feature (452)..(452): n is a, c, g, or t
  misc_feature (467)..(467): n is a, c, g, or t
ggnttgccggaagaacaccacaaggaagncatccacatcaggctggntggacagctccttgaaggttgccccagtcacagagcctccataaatgatacgggtgctctggcaccccaaataagggaggtgggactncagccatcctcggagnttctcgtgtactncctgggcctgttggggtgttgnagtcttgccagtaccaatggcccacacaggntcataggccaggacgaccttgttccagtccttcacgttatctgcgatgaccttggtctgntcgaaaacaacttctcagtgatgcnagtttccctttcatctagcttctccccaatgaaggggattactccgagtccctctgccagagaatgggcacttctgcccaatcaggtcatctgactccccaaagacatgccttctctctgagtgcccagggancacccacgtgggtccgnaggctttggatcatnccaggggttgatct

SEQ ID NO: 565273 - DNA, 307 bp, Homo sapiens
cggacgcccgtgaccatgtggaggctgctggctcgcgctagtcgccgctcctgcggtgcccttgtcagattctggcactcctcccgcagtgctgcgtaaagaactgctccagtacaagtttgagatgtttcattcctgaaaacccagcttagattattgaaggcacactgtgcaaagtagagaactaaattaagtacaaacggactccatgagtaggattacagaggatttgcattgcttggtggtcaccttggcattgaattgcttaataactttagccagactttcctaggtacacctaagctat

SEQ ID NO: 565274 - DNA, 231 bp, Homo sapiens
gttttgggtcccatcaagcgcggcagcagaggtccggagtacacgatgcggagactgctgcaggaaacggagctcgtgagcgctgcacctagcggacgctgcccaaccaggcgcaagtgcgattcctaaagagcggagctatgaaggtaaggtgctgatctgcgctttgcacgtctaaaggcatctgatcctatgggagatgtaaataccgtgccacaatgtgtgtggaaa

SEQ ID NO: 565275 - DNA, 660 bp, Homo sapiens
agctcggtaccggttcgcatgtcccaggctgagtgtagtggtatccctgctcctgcttctctgcctcccaggttcaagcgattctcctgcctggggctcctcagtatctgggattatatgacgtgcataccatgctcagctaatttttgtatttttagcagagatggggttcaccatattggccaggctggtcttgaactcctgacctcaggtgatccacctgccttgccatcccaaagtggggggattacagtcatgagccaccgcagctgtccggagcctgcgtttcttctaatatacagtggaggagagtaatttttgcattacctactttgcaggctctggagttagattgagcgcacctgaagctaaggttaaagatgatggctatgggcatgatgacagtcattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagaccaaaattgagcaatctgcttaatagttgagatcgtataattcgataaaatagggtttaattggcttatgcctttttatattc

SEQ ID NO: 565276 - DNA, 914 bp, Homo sapiens
ggtgacatgagagacaacctgtgtgctcagcctgactagatggctccatgcctctggtgggcgacgctacttcagatggcagtggcgggctagtaaccacgctgtggatccactagcggagcagactggctaccactgttagctgtcaagcttggtgcactctatcaccgcacttgatgggagctgacgtgtacttcatatgatgaggatgacgtggtcctggacccccgattccttggctgtcatcaccctgtcccactttcgtgcttcgacggtgctgaagatgcgaaacgacaagatgagaggatgactgagtttggagatatgacatgaaccatgcgtgattgtgtgaatggcgatgcatgatccatgacgtcagtgtgtggcacttaggccaccttgtttggagcgttgactagacaggtgttcgggagacttagggtaagcatactgctatcatcagacgtactgtggtccgagtgtgcttcttcattcatcgcctgatgttccagaggaagtatgtggcataagcgtggagaatgaatctatcgcgatagtgagcctgagggatcgttaagccagtcttattggcttccaggctggacgaagttgagttccatgtgccgttttcgtcctctggatgtatgtgccgggccactacagtactactgaggatagaggaggcgggtgccgagaacagaaagggaagttccacgatggggattggccctcggatgttcagagtgcctccatcggcagggggcagcctgaattctccaagcaaaccggggagcagtggctgccccaggagttctatcctttcacctttatcaaccatgggtggcagagggaattgccgggagccttgaggttcctaatgaagtgttccgggaattgggggacgaaaaggagta

SEQ ID NO: 565277 - DNA, 102 bp, Homo sapiens
ctactctgaggatccttaggcatggggtctgtacgtggatgatgtttatgaggcggaagaggaaggacatctgcgtgggcacctgggatatgtaggcgagca

SEQ ID NO: 565278 - DNA, 104 bp, Homo sapiens
tacaggcgacgtcgggtagcaatgatgaaccttttatctgctgtggccagtgctttgcacacaagctctgcgcaatcacagggcaagtctccgctgctgtggaa

SEQ ID NO: 565279 - DNA, 591 bp, Homo sapiens
tgctgcttctctctgcttccccggaaggttgagtgtctgtgtctgctgggcacccagtggacgatcccagcacagacccaggaaggattctgccaaggggcctggccaggctcccggctcaccagctccagggcacgcctttctgtccactcccagaaccccctggttcctgcttccttcctcaggcttagcagaagaattccgtttcccggggccttgggtcctcatgtgtggcggaaggctttggctaaacacatgtgccatgccctcctgtcagtgtgactttgggtgcaggggtgtccaccacgagccttgcaatgggtaaggagaaggaaactgtctccgggatggactggccccacacccctccctcctgccctcacccacccttggtctctacaggagcgagtttcatcccaggctgagcccagtccccggggccagcacctgtctgcagagtacctccagtcctcagtcctggtaagtaactggatcccggagcagctgcagccagtggctgtgcaagtctgcccttctgcctggcagctcttttcctagagcagtgatcatactttacaggcgcccagggag

SEQ ID NO: 565280 - DNA, 443 bp, Homo sapiens
gatcacaaggtcaggagttcgagaccagcctggccaaaaaggtgaaaccccgtctctactaaaaaaacaaaaattagccgggacgtggtggcgtgtgcctataatcccagcaacatgggaggctgaggcaggagaatcgcttgaaacctggaaacggaggttgcagtgagccgagatcacggcactgcacttcagcctgggcaacagtgcaagaatcagtctccaaaaaaaaaaagaacgaattggcagccctgtctacactggccctctctcaggtgcatcataacctattacattcaggcttttgactctcagcacttaggggcagtatgcttggcatagtttccaaaaacttccatttgccaaatctaaaagtcagtcttctgtctatcttgaaaatgattataaatatgatattgggcggtgaaccggaccaggtataa

SEQ ID NO: 565281 - DNA, 192 bp, Homo sapiens
acgcggaatctgggggtatgcatgtacgaatacactaacgaactggaaggttataatgtcacggtcttggtgaccaagtatgtcgtgtcgagtacaggtgatcagtgcgtcttaccttttcccgttgtaaaaatgtagtggtgagggtgtatattataataatgtttgtgtattcggctatgaagaataggg

SEQ ID NO: 565282 - DNA, 118 bp, Homo sapiens
gatcatcgatataggcccgctcatcccagtcttccggtaatagaagcatcaggatccttaatcttcttgggtggcaggaagtcccaatcgtacttccaaaggagccaggactaccacc

SEQ ID NO: 565283 - DNA, 437 bp, Homo sapiens
  misc_feature (149)..(149): n is a, c, g, or t
  misc_feature (310)..(310): n is a, c, g, or t
  misc_feature (334)..(334): n is a, c, g, or t
  misc_feature (339)..(339): n is a, c, g, or t
  misc_feature (354)..(354): n is a, c, g, or t
  misc_feature (373)..(373): n is a, c, g, or t
  misc_feature (413)..(413): n is a, c, g, or t
ttgccgatgacgaaagcgaccgcatggtttcgccgagtgccggcccaggccgagaaactgccccaatgactgctgatcgagtgtagggaagcacatgttccactcacctcccacttggtcgaacccagtgcgtatgctgactccttcanttgtgtcggtacagtcaggaacacctcgcgcattattgaggagatgaagggaatcaccatgattgccaacacaaagccagcgctcagcgttgccgattccgagcggtggtccttgaaacagcgtgccgatcagcggcagaattgccgatgttgatcattangggaacggggttgaatgttattcnggtcntcaccgggttacaancacaaacagtccccacatngccggtaaaataattgaatgggatcccacccaccaactcnaattgcattgccaacggggcttgc

SEQ ID NO: 565284 - DNA, 122 bp, Homo sapiens
  misc_feature (78)..(78): n is a, c, g, or t
  misc_feature (86)..(86): n is a, c, g, or t
  misc_feature (113)..(113): n is a, c, g, or t
tgagacagagtcttgcccgtcacctaggctggagtgcaatggtgcaatctcggctcactgcaacctccgcctcccagncagctggnaccacagacacgcaacaccacgcgcantaatttttg

SEQ ID NO: 565285 - DNA, 284 bp, Homo sapiens
  misc_feature (204)..(204): n is a, c, g, or t
agtgacaggtcttgttctgtagcccatggctggagtgcccaggcaaaactcaatgcagcctcaaactcctgggcttaaacaatcctccagtttcagcttcctgagtagctgggactacaggtgtgtgccagcatgctcaactactttttaaattgtttgtagagatgggagtctcgttatgtttcccaggctggtcttgaactnctggcctcaagtaatcccttctgtcacagcctcccaaagtgttgggattctgggtatgagccactgtgccaggcctgttt

SEQ ID NO: 565286 - DNA, 282 bp, Homo sapiens
tgaactcacagttgctggtggctgtggaggcctcataatcatggcagaatgcaaaaggcacatcttacatggcggcaggcaagagagaatgagaaccaagtgaaagtggaaaccccttataaaaccatcagatctcatgattcaattatctcccaccagttccctcctacaacacgtgggaatgatgggagctacaattcaagatgagatttgggtggggacacagccaaaccatattagacagtgaacttcatcgataaatgtcatgggtgttctaacaaa

SEQ ID NO: 565287 - DNA, 492 bp, Homo sapiens
ctcgtatgcgccaacaagtacaagatgtagctccattagtctcttacagcatacgttaaagacttcgatactaccagggtcgtctcaggcgatggcgggaagacctgaaagagagtactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtctggaattatgttggtgtgaatttgccagaggaccaatgcttgcatggagaatgggacgaggacatttgtggcccaacagtcgtcgca

SEQ ID NO: 565288 - DNA, 1384 bp, Homo sapiens
  misc_feature (771)..(771): n is a, c, g, or t
  misc_feature (817)..(817): n is a, c, g, or t
  misc_feature (974)..(974): n is a, c, g, or t
  misc_feature (1040)..(1040): n is a, c, g, or t
  misc_feature (1270)..(1270): n is a, c, g, or t
  misc_feature (1277)..(1277): n is a, c, g, or t
cctgtgctttttttgagttggggacgccagtccgccgcactccgcttttgggggcccgggactggccgcggctactggtgtttatattccgccccccccttttcgggagttgtttggtgcgccgcgctcccagggatttttttggggaaacgcctcgtgttcgcagggctgccacacagggtgttctctggactctccccttggggtgtagtggtgtcgtttacttacgacaaagcttggcaaaggagctgccccgcgccacaagtgttgggtgacccctctgcgcccaacgcctcattttgaaaaaggaatttcttgcgggataaaacgaaaggtttgaagaaaagggggcccacatgctgccccagatagagaccttgggggtgcggctccacccctgccggccaatatgggggacaccacgcgacacccttacagggcttgggaccacgcccccattattggggaccccggatcaatggagagccccacgcgccacttttctggggaccacgcgccccccccacatggggcctaatattttaaatcgccccacaaaacgccccctcggaggatctcaccccctgggcccaccccccccttggtgggagagaccgcttgccgcgccaagagaaggctgagaggcgctcgacgccacgagatgtaatatagcgcccgcttttaagagacccctcggttgggtggtctctgcctcgtgtgtggagagaccccgccccctcggctatttcttttctcgggctcttgtgtccnctcttgagaggagtttccccatcgagaccgcacgtctctccacacnccgccactttctcatgttcgccacatgagtccacacgccatataggtttctatagggtatattgagatgagaagaattgaaaagtgggccacgcacacgagaggagacacccacacatgtgctcgccacgctttccctcgagatgagagagttcccnccctctcttctcgagagggccgcaatgagagagaatgcgcttcttcgccactcggagaagaaagtncgagattataggttataggagagtttcaataagttggaaaaacttgtggccctctgtaataagggtggccccactcgggctccccacctcgcacagcctctcgagagtggcccccctgtcccccctggcgtcccccctgctggttgtctatgtgtttttttccctctccctgtcccttgtgttgaaagcgcccgtaaactataagggtgtccaagcccccattcccttcntttaacnctcttgaccccaccggagttggatgttgtgtattgtggtttattttattttcttccttttgttctgaaattaaagtatgcccaaataaaggatatgccctttttata

SEQ ID NO: 565289 - DNA, 750 bp, Homo sapiens
catttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaaataggcagaatattttaactctttaaaatcctgcctttctgaccaaaaaaaaaaaaaaaattctcatattggattctccaatcttccattagttaacaagccacagtttaaaactcctcaaataatctcccattttattttgaagcttgacacattaaattaagcagataattattttacccaattgaaaaagactttctacctttcttataatttaaaatttacacattgttctaagaggaattggtttaactctttggagtagctttaaccgagttgtgtatttaaatttctaggggccattgtgctaagcagcattttagcattctactcagggcagttattatagattaacccggctggggacagcaaaatttggtcacaattttagcagtcttggatttttctggttaagcctatgaaaaggtcatggtccctattaaaaattaacttttaaacctggattaactatttccttattttacccttattttgaaattcatttactttattaaaaggaaatccctaattgcagaaacaaagatgcacctttcaaaaatttctaataatccctatttgtaattatacccgagaga

SEQ ID NO: 565290 - DNA, 377 bp, Homo sapiens
  misc_feature (235)..(235): n is a, c, g, or t
tcaccacttctctcccctgttaatctacacacctcactgctcccggtcattgaccctagctgtgtgtgtggtatttggaggggcaggcaaagaacaatgaaaggaatgtgatgtcggcttcctttgattgatatagggccactggagctaggcttctgccctcttcggggaaaacaggtaagcaatcatctttcagaaaaggggttgaggtcagaagccttagcttctctttcanaaacaaaaacaaaagaagatagtttctgcctttaagggcgctgtgatccttggctggcttagtgaatgacgtcatgaagtgaagtgcacacctggcacttaggaggcatctttggttccgacctctggctcaccgtcgacgc

SEQ ID NO: 565291 - DNA, 310 bp, Homo sapiens
atccttgaaaatagcgacgggtagtatagttacaaagatgcaaatatatagccaaaagaatatccaggatatcctggctcttctcagttgtaagatcccttgcctgaatgatagtcctggtgttttctttcattttattcataaacctagcatgtaatatgaaccaaaccacttttcacctacttttatttaagcaacttagaagagagcatttatttactttgagaaagaaatataggttcctctcagagaaatccaaatttcattatctaatagaggcgtcggctacattttccggcgtaccgagcct

SEQ ID NO: 565292 - DNA, 162 bp, Homo sapiens
ggagaggtagggaacaggtgtccagcaggactgaggtggtctttggcagtgcatctgtgactcctccaaggagagcagatacagctcctcccagtcctggtgaagcctaccccatcacacctgctcggtatctgcaaggaacccatctgcaaggaacccacg

SEQ ID NO: 565293 - DNA, 161 bp, Homo sapiens
tatgcagtggagcagccctacagctgtcggcctggagaagctgcactgtggtgcctgaaggacagactcctgctgcctatccccagtggtatcagtgccaccatacatgctcatgcaatggaggctcacatgtgctagggtacctgagctctgaattctgt

SEQ ID NO: 565294 - DNA, 293 bp, Homo sapiens
tttcatgattaaaaatcagttgcggccaggtgtggtggctcagcactttgggaggctaaggtggtaggattgcttgaggccaggagttcaagaccagcctggccaatgtggcaaaatcccatctctgctaaaaatacaaaaaatatagctgggcacggtggcacacacctgtaatcccaactactcgggaggctgaagcacaaggattgtttgaacctgggaggtggaggttgtagtgagccaagattgtgccactgcattctagtctaggcaacaggtgagactctgtctca

SEQ ID NO: 565295 - DNA, 1451 bp, Homo sapiens
  misc_feature (545)..(545): n is a, c, g, or t
tggaaaagtgttggatttccattcacacaaaactgtggacattcattcgtggtgaggcttcgtgttcccagaagaagacggggccacccctcagtgttcgtgtaatgggcgtgtgtagaataaacacaaagtataattcaaacaaacgtgcaaataactcgtgtctcgtttctccatatctcaatacagcaacagctccctcaggtggtactggcaccatcttctgtgagaaaaatagtggcctcacaggggtctccttctccacattccccacaagggcacgcacgcaaaattccctctgagtggtccgccctcctatatgggggccaaggggcaacgcccaaacgcgattctgggagaagtgctccttgggcgcctcagataaagattggcgccaagatctccggcataggagactttttcccgtgggtgagaggcctcccaccttgtgggccagtatataacgtatagaatgtctccccaaatggtagaccgcgcggatgggagattaacatctacaggctccccatatttgtctcccctgngggcataagcccaagcgctgtgataaattctcagaatataaactcccagagagggtgctccccctcatgtgtccccttttgtcccttctaccacgggataacttcgcgcgcgccattttgggcgggcgccaattttctccacccaaagaaggcggcttccagaacactccaccgggtgttctctttagaacccccgccacagaactctttggataaccgcacaccgcggagaatttttttcttcccttctccccccgagtagaaaatgtccgcccttggggcgtggtatgctatatcacaagaccacccctcctcactggggaggattccccagaaaaatatgataacgcccgagcgcaggggtagaagcgaccagaattatcccggagaggccacagagaacggtcgtgcctgccgcggtgtagcaacgcgaacacagacctcattgagggcgccgccgcctagacaatgaggccgcgggagctgtcccaccgagaaacacattctcaaaacaaaaagcggcaagcggccagcaaaagagccggccccgcttagccccaattcttttggcccccgaaaccacacgcccccatcgtctagagaacacgctgcttggatgcgacaggggggcatttcacacagacaccgcgggggccgtcccgtacgaaaaacctcactaccgcgggggacctcccctaaaaaaaccgtccgccggtacccccagacggtgggcacacatcctctccctggggtgggccccccctctggtagtgtgggccccccttctgtgcgtaggtgcacacgcgacgaatctacccccaagtgggaggaccacccgatggagcggacgagaagtcgaagacctctcccaccatgcgtcgtggagacactcatacactcggggca

SEQ ID NO: 565296 - DNA, 528 bp, Homo sapiens
acccccctgcggatgccagagtgattctattacgttttatgatattttatgtatgagatgggtctcaatatgttgctcaggctggtctagtaactcctgggctcaaaagatccttccaccttggcctcccaaagtgctgggattacagtcgtgattgaaagagcccagccggcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaattta

SEQ ID NO: 565297 - DNA, 562 bp, Homo sapiens
atgaacgcagtcctggactgtgcaaccggacgctgcggatcatgtactttcataggagtagctgctggtagcaccggattcactgttgatccagaggagctagtaataggacgtactatcaatgggacattctttggcgggcgcacaagtgtagattctatcccaaagctggtcactgactatcagaataagaaattcaatctggatgcactggtgacccataccctgtattttgacacaatcactgaggcatttgacctaatgaaccaaggcgcatgcgaacaatcctcatcttttgaagatgccaggagcacattcggagtactatctgattgaatgtgaacactgctgtgtaatatattacctgagtagatgaaccatggaaagccatgcgtttaaacacacatttacatataatatgggaacatacacagagctttaaatagtatagactactgacctgcgatatatatgaatatccactagttagatggtaatcatctagtgtttatggatcgcatcatgtcttctataggtggttatggccatagttgatgtgttg

SEQ ID NO: 565298 - DNA, 313 bp, Homo sapiens
gtccccaaataaggctgctaactaggccccccttaagaaagctttaaaagttatagcttcctttaagtccctctccattacccaaaatcaaagcaatagttgttggagcctagaaaactgattttttaggccgggcacagtgggtcatgcacgtaatcccagcattttgggaggccgagaagggcggaccaccttaagtcggggagagaccagccttgaccattgtggagaacccccattctctactaaaattacaaaattaggcttggtgcataccttgtaaccccagctacttgggaggctgaggcaggag

SEQ ID NO: 565299 - DNA, 196 bp, Homo sapiens
ccagaggagcgataagcacagagatatttcacagggtttaacctacacaagctataaagtactgtatgagtctacaaacagatatatttcacaaattcagcataaaatgggtccaagctgaaagctctattaagaaaatatactatgctgatttataaagcttgtttaccctcactacgtcctcccaccacaaacg

SEQ ID NO: 565300 - DNA, 106 bp, Homo sapiens
tgatacattcgtgtcccaatgcttgcttttctcctcctccccttcccggttaccaagatactcgaactttccagtacagggacccagggacacgaatgttcagtga

SEQ ID NO: 565301 - DNA, 371 bp, Homo sapiens
ctatgtttaccagagtgggcaccgaggccgaggaggctaccgagagcgagtgagggctgccagcacactgtcacctctcagtttattccaagggtaggagtgtggaggtgaaccctttcctgtcatggccttaggtcctgtttataatttggtatcttagtgccacagagagtctgttttgtcagtcttatgatctctgttttgacattcatgctggccagttgtgtctaaactgaaaaagggaagggatgtaatgaggcatgtctggcctcccatcccatcctggctgggaactcagttttaagatttttatggggttgccttggccacaagggggcctattcagtcagttgtgggcacacattatggag

SEQ ID NO: 565302 - DNA, 125 bp, Homo sapiens
ttttgtgttcctggcctggcctgagctctagcggtctgattagtcttgagtttaagttcggctctgggagagagagagagagagagagagagagagagagagaaagagatagagagagagagaga

SEQ ID NO: 565303 - DNA, 2041 bp, Homo sapiens
ctcggctaatttgtatgtgttgggtgcagtcgcgttggttgcgtgtgcttgtctggttgatttctacatcgtcttctctgtgtggggtggacgttcgtatcatagagaggtgtgtccgtgctgccgtgttcgctcaccgctgggtgttgtgtgtgcgtgttgtcttcgatggttggctccttaggagttgtgttgtcgtgctcgttcgtactcttactagcgaggtggttggcctactactagaggggggagtggttttgcctctgttgtttccgtcaatgcgttgtgttgtgtgtgtttctcccctgctctggcaagacgaggggggttgttttaatggtctctccaggagtgggtggggtggtgctggtctgttgtgccctcgtttgtatgtgaggtgtttgtgttcgcctgcgtgttgggtgtgtcgacctcacacgcagagggggttgttgcgtgggcggtgggtgcttgtttttgttgagtgaccctcgttctggtggttgtgttgtgaagctagggtggtggcgataggtgtggtcgtcgtgggtatgtggttggtgtgcgatcccccacacatggggggtgtgggtcctatgcggacggtcatttcgtatttggtggtgcggcgcgggtcgggcggcggagggagcgcgtgtggtggcggcatcgactccgcctgcttccgtgcgctgcggggtgtgtggtgtgtgttgtgggtgtatgattagtagggggtgtctccttcgcgacggggtgtgtgttgcgtcgcgcctcccccccgttttttgttgcaacagaaatgtgtttggtggggagaagagtaccgacttcttcatcggtgaggaatgaggagaggggtgttatgaaaatgtaggggaggaaccacctctcgtgggaaggaaatgagcttgtgttttgttctctgtgggaaacaacacgggtggggggttcatcatcggtgcgaccacttgttcttcttggggggccctcctcgttgcctttcccctctcgttatgtgtgtgttggtggcgttggagtagtagcgtgacgcggtgtctatgagtggggcggcgctccgtctcctgtgatggggacgcgggcatcacatcgagggggaggagctgcgcgcgtcgaagatgataataagaagaggcggctccttcttagagtgagtctgcgaggaggacctacttctactagggggtggttttcttcgtcacacgacactggttgggaaggagtgttgggagacgacacggtgtggtgtaaaagatatatattagagggtgctcgagagatggtgctcacagagagagatgagagatagacggcgcgccacacaatgttcttcgtctcctcgtgtaggactattagtatagagtagtagagttcgctcctcgcctcacatgagactacacgacagtgagagagggcggcggggagtatactacacgcgaagtagagcgcgcactggtgctatgagatcacttcgttggtgtgtgtggcgtgagagagtatataagttttcgataagagccgcgcacagcacgcgcggcgctgcgcgaatgcgtgttcctcacgcatatatgtgtgtgtgtctctcacacacacgtgtgtttctcacacgcttttacacacgcgtgtgtgtgtgtgagaacacctacacgctctgtggcgcagagtagatacacacacgtgccccgacgggcgcagcactgcctcgtggagaggagcgggactgtgtgtagctcttataccaccctcactcctctctctctgttatagttgtcgctgataaccgtcttcactcggcgctcttctctcgtgttatttgtttttctctctgtaaagaccacacaaaaataggtaacaacgatcaaaagaatttgtgtaatatgataatcttttgaaagtagataccactatttcccaccctcggttacctgttatttaaataatccacaaggttaatgacacaaatttttcaattttataaaaaaaaaaacataaacaataataacaaaaatacataaatata

SEQ ID NO: 565304 - DNA, 252 bp, Homo sapiens
gctgtgtacacaccggcgtccagacgtatcaagacatgttgcttctctccattgcggccagacaaacccaggatggttcgattgaatgcgtgctgaccgtgcgagaactgttcatcgtcaagacaacatcgatttctggtgtgtcattgcccgcccccaaacgcggtagagcctccgcccaaggcgcggcgaaacgcaaaaggggccagaacccaaccctaaagcaggccgacaccgagaaaaacggttccc

SEQ ID NO: 565305 - DNA, 423 bp, Homo sapiens
gagaccctgtctctactagaagaactttaaaaatcacctaggtgtgggccgggcacggtcgtaacgcctgtaatcccagcactttgagatgctgaggcaggtggatcacgaggtcaggagatcgagaccatcctggataacacggagaagccccgtctctactaaaagtacaaaaaaattagccgggcgtgggggcgggcatctgtggtcccaattaatcgggaggctgcagcgggagaatggcatgaacccgggaggcggatcttgcattgagacaagataacgccactgcactcaagcctgggcgacagaatgagactccatctcaaaaaacaaaaagaaaccaaggatatagaataaaacaagaaaaaagatttgggcattagaggcctacaaaattggattgttatcaaagacacagaa

SEQ ID NO: 565306 - DNA, 830 bp, Homo sapiens
cccaaagtaggctaggcctacggaagctgggtcttcttgctgtgaaggtcgcgttccccagtgttacggagggtccttgtaggcaggagtgaaaattgggtctgggggttagtcctggggtggaggtctgggcatcgccgggtgccggaccccctccatcttcggttttgcatcacctccgctttccagtcgcggagtctgcggcgggtagggcggctgtcgcgtgcggtgacgtcactccagcaggtcgtcctcgcgagggctccagtggccttgacctcccgcgtgcgtgggatggctgtgcggcgatgctgcagttcgtccgggccggggcgcgggcctggcttcggcctaccggcagtcagggcctgatttccctggcggaaagaggcatgcgcgtgctgaccgatgaacccggatggcagtgtggtcggagcgagggttctcccggagcccgtgctgcgcaaagtcgagctccgcggtacccgactcatcgactgcccagtgcaggcctgggtcgagtccttgcgtgggcttcgagtcaggagctgctgtgggcctgtgcgacctgcatccccgatgttttcgccaccgcgcccaggctggacatatctgtaccaggtagctatgtggcagaagaacttcaatgagaattagctatgccaaagaccaagaggagagccagatgtgcggggcggtggccggaagccttggcgcatgaaaaggcactgaggggggccgggataggaacatccgagtcttcggtctggaaaagagaaagtgttgcccaatgccccggggggcccccaattttattacatttgggccct

SEQ ID NO: 565307 - DNA, 980 bp, Homo sapiens
ccctacgcgtacgaccacgcggtcggctagacgctacttccgcgcgtatcatagaagagcttatcagctttcatgatcacgccctcgataaatcagtttgccattatctgcttcctagttcctgtgtgcccttttcctaagcactcacaacgaaagctaagctaagtgactaacatctcagacgcgtcaggagaatagaaggccgtctgagactatcctgcccgcgcatcatcctaggtccgtcagtcgccctgccacatccactacgacattccttatagcagtagacaggacgaaggtcaaacggattccccttccgttatgcatctacaagtctacattggggcaccaacaggtggctgcatgacatacgtagcgtagatacgaccgacggagggacggaattaatacttcaatcatccttacatagttcccaccattattcctagaaccaggcgacctgcgactcctgtgacgttgacaatcgagtagtactcccggattgaagcccccattcgtataataattacatcacaagacgtctggcactcatgagctgtccccacagttaggcttaaataccagatgcaattcccggacgtctaagaccaaaccactttcaccgctacacgaccgggggtatactacggtcaatgctctgaaatctgtggagcaaacacagttgcatgcccatcgtcctagaataattcccctaaaaatctttgaaatagggccgtattaacctatagcacccatctaaccctctagagcgaaaaaaaaaagaaagaaaaaggaaagcacaacaaacataagaccaaagaaaaggaactgcaaaaaacccagggcgaacaagaacacacaaagatgaaaaaggccaccgagagcagcaacaacaaggaacaaacaacagaggaacgaagggacaaagacacccccggggagagaagccacgagacagcaaaacagaggaaaaaaagaac

SEQ ID NO: 565308 - DNA, 390 bp, Homo sapiens
  misc_feature (72)..(72): n is a, c, g, or t
  misc_feature (273)..(273): n is a, c, g, or t
ggcgtgccgggattcctttgtttttcttttttgttttctttctttaatggagttgcactcgttaccccagtnggagtgcaatggtgtgatctcagctcaccacaacctccgcctcgcaggctcaagtgattctcctgcctcagcctcctgagtagctgggattacaggccaccacacccagctaattttcgcactttcagtagagatgaggttttgccacgttggtcaggctggtcttgaactcctgacctcaggtgatccacccacctcggnctcccaaagtgctgggattacaggcgtgagccaccaggcctggccacctctttgtatctttaaacaccagccagtgacctccaggaccctggggtggacttcagacaaagggaaaca

SEQ ID NO: 565309 - DNA, 468 bp, Homo sapiens
  misc_feature (174)..(174): n is a, c, g, or t
  misc_feature (276)..(276): n is a, c, g, or t
  misc_feature (333)..(333): n is a, c, g, or t
  misc_feature (348)..(348): n is a, c, g, or t
  misc_feature (362)..(362): n is a, c, g, or t
  misc_feature (368)..(368): n is a, c, g, or t
  misc_feature (378)..(378): n is a, c, g, or t
  misc_feature (392)..(392): n is a, c, g, or t
  misc_feature (405)..(405): n is a, c, g, or t
  misc_feature (450)..(450): n is a, c, g, or t
tgagacggagtctcactctgtcgcacaggctggagtgcagtggcgcaatctcggctcactgcaacctccgcctcctgggttcaagcgattcttctgccccagcctcccaagtagctgggactacaggcacctgccaccatgtccggctaactttttttggtatttttagtaganacggggtttcaccgttatctgccaggctggtctcaaactcctgacctcatgatccccccacctcggcctcccggtccacttttgttttagcttgagggcgtncgtgtgcggctttgttacaagggtatgctgcgtggtgctaaagtttgggcttctatnaatcctgtcacccanacagtgaaccacangaagtnatatgcccanatagtatccaatanaaagcatttcagnccttcctccccttcctccctccctccctccttctggaacccccantgtctactattcccatct

SEQ ID NO: 565310 - DNA, 408 bp, Homo sapiens
agtcagtagagagaggggaaatctttagggatacacacaaattagcagagctgtaagagtatgagggcaaaggcataatatggcttgggagacatctcagttgtgtggtgctaggcatagtggtgagtcatgtgagctcatattggcaagtgagactggccactcagagcgctagagagagcgagaaggacggcacagaccacaaggggcgggattacaggagggtgaagacaggaagggtgagacgtaaagggaaatgggggtccgtgaccatgagaaagtgtctctctctctctctctctctctctctctctctctctctctctctctctctctctctctctctctctctctctctctctctctctctctctctctctctctctctctctctctactctctctctc

SEQ ID NO: 565311 - DNA, 145 bp, Homo sapiens
ttctagctgctcccaccgtttgaccctattctatcgctattagttggctcaaccactaaacaaaaacaatgaggaacggggtgaagagcggttaacccattgagccgtgggccgtggtaaaagggggatccgggagagtcgaact

SEQ ID NO: 565312 - DNA, 742 bp, Homo sapiens
gacagctttctcctctgctggagaagaggaatttctgctcctcagtctgggagcagttctgaccttgattgttgtggttggtttttaattctctgctcctcttgacctttgagtcgacactggctcctggagtttccagctagattaggctccagtagtggtaatttacttaataatacacactttgtgtgctgccttcccttccttgactcccttcctccccttcctatcagtgattcctgtggccccctttcaaataaactatttgtagttggatctttgagtcatggtcttcttctgggggaacacaaactaagtgctatcttttagtcagcacttactctgtgccaggcagcagctaagagtctgtttttatgcagtgtgtaatcacattatctccattttgtaaatgaagaaaccacagttgaagttaaataagctacttggggatgttcatcaagtaagtgacaaaaatacaatttgaaccaagacctctgactttcaaaagccatattttttgaccattagattcagaaagcaactgctttctagcatatccctcactcattttctcatgaaaaattcttctccttaatgggtcctattcagagggacagttcctcagttaaaaagatcccttggtatgattgttcagaattattttccctttcctgtatattcatatgaaccgaatgccttcttttggaaggtatacgccggcttaggtataagggggaacatc

SEQ ID NO: 565313 - DNA, 227 bp, Homo sapiens
agggaagtgaggaaatgtttgggagaggactttctaagctctattataggtgttagatctaatttacttatgggattctgtaggtctggtgaaaggggtggtgggtgacggttggattgaggagggttttggaggaaaatggggttgaaatggaaaatgggggggatattgtagggtcaaaatccaaaatttaaaaggattgatttcttttaaattggtggaataaa

SEQ ID NO: 565314 - DNA, 225 bp, Homo sapiens
gcagcaaccagcgttcaatggaatcccaatctgcctcctactgggtcaccagctccagtggccaggggattccagatggacatcaccacatgaatggatatggatcacatacttataaagctgattaatgcaaatggggaggcagtttattgcaaattccatcagaggactgaccagggcatcaaaaacttttatgttgaagatgcgacaagacttcccaaggaa

SEQ ID NO: 565315 - DNA, 677 bp, Homo sapiens
  misc_feature (623)..(623): n is a, c, g, or t
cgtgaacaccttgcccaaggcaactgtattaatgttctctcattttcacttcctttccttttgcatatctgtcaaattattataatactctctaaaaacgcttcccaaaacaaaatagcaactcagaatctcagtaagctatcagtcacacttctaaaataatagctgcaatcagtaatttcccaagatacaaattaatccaggaaattatctaatttacacgaaaagatggctttgggaatcatcacatttcaagcctgaagaaaaattaactcccatacaagtcatagcaacatttatgtttgtaactgctagtaacatgtcaatattaggctataatatattcatgagaaagaagttttctgtcttctctctggggtctcaaaggcattttggagcctcagctccctcatcagtaaaataaaggtagtagactgaataaccagccaactctagatagaccataaatctataatgagagaataaatgaaggaaaaatattcatgtttccaaattaaatattgagtattcaagataaatgataccaatgtctatattgacaaaattaaaagctaacaatcatatgttcatcatcccattttttttcttactgatccataaanaccaagcctggaaaacattcccctattacacattataagtatctcaatgatctt

SEQ ID NO: 565316 - DNA, 156 bp, Homo sapiens
ggctcatcaactatctttagtgttagtgtatttaatgtgtggcccaagacaattcttctcccactgtggcccagggaagccaaaagattggacactgctgatctaaagtagtatcagtacccagatatacacatgaactcctgtgtcataagtcag

SEQ ID NO: 565317 - DNA, 356 bp, Homo sapiens
tctctctctctctctctctctctctcgggctctctctctctatggatgaatatacccccagaggagagagagagagagagagaagggagagaggaacagatagaggcaaacagaggagcgcacggaggaacaggagcacgagagacagagagagagagagagagacagagagaaagagagagagagagagagagagcgaggcagacgaacgatgtaagagcagacaagaggaagagcaagtgtacagagcgcgggagggggaagaagagcaagagcgagcgggagaagcgagagagatgaggataagagggagagaggaaggagagggagagcagagacacagagagcacaggagc

SEQ ID NO: 565318 - DNA, 551 bp, Homo sapiens
atcttcttatgcctatcatgtttcgtcgttagggtctctcctgcttccgtgtcccggcctgcgtgggtgggcttgtgggtctttgacgacccgaaaattgagagcgtcttcgcactccaggagctgctcctggtggctctgcggccgtcagcatgccacagaatgaatatattgaattacaccgtaaacgctatggataccgttggcattaccatgagaaaaagagaaagacggcaagtcgagaggctcatgaacgttcaaagaaggcaaagaaaatgattggtctgaaggctaagctttaccaataaaacagcgtcatggtgagaaaaaatacaaatgacacagactatcatgatgcatgcaaagagaaacaccaaacaaaagactgctgaaaagacaccacagggagcagtacctgcctatctgctggacagaagagggacaatctcgagctacagtactttccaatatgatttaaccgaaaagaaaagagaaggcggcaaactgggaagtccctctgccttaagtacgtgcccaacgagaagcggcga

SEQ ID NO: 565319 - DNA, 756 bp, Homo sapiens
ctagacaaaggcgaaaaatgctaacatatgatgcattcctgtgatcatatcctgcctgagtctgttgtataatccgggatacgatcacaaattgctaattactgtgatcccgaggtaacatgtgaagtgagtccatacagatgatgtattcagtaaaagtccgaggctgatgaggtgaaataaaaaatgtcttccaaaaaattaagcattgttgatgaatctgccctgtagcaaatttataatcagagacgatgagagaggagcatactcttttggacgagcttaggcaaacaagtgagggccatggatgtgaggataagcagagagagttataactgagtatgctttcactattctaccctggcttaaaggcttgtttaaagatatatcaccaatagactttaaggtttaactcggagacatatagcagtatagatataaaaaatgacactaataatagaatcccggtggaaatttatttattgtgtataatagaaggtgttagatcccatgagagatggacaagaagtgtaagtcatagtctctgcccctcaggcaatttataatttaaagtgtgacacaaaacagagatctgaaaagctacatgaacaaatgttagaaaatacagattgatattatttaagtgtcactgttgatgtgtgacaacgggaatgcatttggagtgtctacttggattgttctccctttcttaaacattcttaaaaattccaaaaacaaaaacaacacaaacacttg

SEQ ID NO: 565320 - DNA, 430 bp, Homo sapiens
agctttgtcccacactgggaggtcacaggactgagtgtgcacaggaatgacagaagcgctggctcaaagagccgcccgtcaatgtttcctgccaaccgtaagctacggactttacagaaccacaaaagcagtaaaagccgactctcaagagaggaccggacacaaggatgcgcaattccacctcctggcactgcttttctgcggcttactttacgaccggtcaacgatgtgcaaagaattcttaggctcctttcacaaaagcatcctgattcttttcatactcctgcatacgtctttaaatatttaatacttttgggagaaatgaggacggataacacatagattactaacaactgcatttaaaacgaggataaaaagaaccagctggcacatattcttgcacaccttgtaataaaccccgtgtaaatta

SEQ ID NO: 565321 - DNA, 569 bp, Homo sapiens
ggtcgtcgccgtctgaggtgttccctggcgtttgtctcgccgtcgttgccgccccgtccctgccttcgtgccgcccgccttaggccctgcccagccgctctccctgtcctcctccccttaaccacccccacgatttctgccgtcggggcccgaggggcctgggctggatgatgcctgtcaggagagcggagcatgagcgcagggaccgggcggcatgctcaggatggggacggctgcggacacggcgtgtaggccacgagagcccggcaggctggctggcccggacccggaggccttatcggaccttccccggacggcgacctgagtgtgctgagctggcacacagggtgaagcgactggacgcgtcttctgagacgagccggatttcccacttcacgtggacgcgtgaaaacttccccaaggacatgacgcgttgcaaggcccggaaagaatcgtagcaaggtggtccagaaagaaaacctggaaggacacagggacttacatgtgcacagtgtgcggctgcatggttcacctagcagacacgtgctgcactgcaatggctgggtcaa

SEQ ID NO: 565322 - DNA, 296 bp, Homo sapiens
ctgagtgaaggagctggaaagtattctatatattgatctaggtggttgttacaccaagtgtatacacatatataaattcacagagctgtacacttaagatctgtgtacttcacagtattgtaaaaaaaaacatttttctaaactatgagctactaaaccggaaaggagcatgagggagctggaagtattctatatattgatctaggtggttgttacacaagtgtatacacatatataaattcacagagctgtacacttaagatctgtgtacttcactcgaaacgggtaccgaagct

SEQ ID NO: 565323 - DNA, 832 bp, Homo sapiens
agtatctgattcgtcagaggagcgagaatctgcatcctgggaacacctgactatcatcagaatcccaggagtatcgtgggtacatccaccgttacaggtccttctgactttgtaacccgtcgtcaaggtggtgcaaatcgtggatggccacgcagcgaccattctacgtggtagcacttgcaagatcattactcgagcatacatgccaataggcatgcacgaatgcgcgaccaccgtattacaacacgatggaaggaacaagacgccgcaagtatcatagacacccacgaaaaatcagcacaagagctcaaggcaaagcaaggtgtgcattacatcaataacagacatgaatgccacaggctaatgataaaccaaccagagcgcatgcccaaactgaaaggacaggccagcaatacctcaagcatactcagaaccaaactatcttagcacagcaagacgaacccacagcctacaactgttagaggcctgcaaggaacagcaagcaataccagtgatgccgcatgtgctcaacccaagacgaggatccaaaagtgtgagcagaaaaacaccagtgagccagaatggtcgatgacgaaacgcacagatgctggcacattttagatgcacaatatagactggtgaccaattccagccaaaaagacacgggaccaatgtgagacaggatactacaggcgcaacgccccccctgggagattcacccaagcaagcacgaccgatacagagaacagaggctcatcacagaccggacagagatcataacaaggagagacaatggccagccgtaatgccacagatcacaaagccacgaagg

SEQ ID NO: 565324 - DNA, 1122 bp, Homo sapiens
  misc_feature (528)..(528): n is a, c, g, or t
gaaaaaaggtacatgacaatctgtgggaaggacacatcgtgatggccgccatgtctccactgggtcattaaacaatgtagtagaagaaatagtgctgagctctagcatcgcagttaatgaacacgtgtacctaggtgcttgtgtcaagtgttgcttgctaccatcttccgttctctttctacacctatgatatgaatactcgctcatctgaacatggacatggtacaattaagacgtgtgataacctttcgaggatgatgagaagcctacccattggatatcaagagttcccaggctcttacgtagtgtggaccgcgtctgcgggccataggtggatctttaatgcgtacatgctgaagctgtccatttatatctctatgtgggtcaaaaaatgggtggtattaataaagtggagtacgatgggtggggactctctagaggctctagctcaatagcaagagtgatagcatagtaggggtaatatacagcagaaagagtcgagtatgaggagctgatgttggagattcntacaggtagatacataacgggctattttgagggtattgatcttgtcgcggggaaagcgtcaaccaatcacaatctaggataatattgaccaacaatttatattggcaagcataattcgtcgttcttgaacgtctcggaataggctcctgcacgaagatctggagctctggatggatgaccagaatctcttgatgttgcctaacttcgcgtaatttcgacggacgggggaaccctcagggagggcagggaagggtacagggcacaacggacggcggggaacagctgcaaggaacaaagattaccaagggaaattactcgttgtaaaggtggaaaggcaggggttaccccgacgttggggggggccccgtcaaggagattcgatttcccctatgcttggggggatcccttcgttggggaagaacttggcacgcaagagaggaaaaaccttccaggaagactgggcattcatccgttccgttggcccaagggggcgcatgaaaaagtttccgggggggtccggaaaagtccctccaacctcacctggtttgcctctcattttggcttctggaagggggttggtcccccaaaagggtg

SEQ ID NO: 565325 - DNA, 130 bp, Homo sapiens
gttagtcaaagcgacagataacacgttagggctctgggatgagatttcctggtctgtctatgagtccttttcctgctctggttgggtgaggctgtccgattgagtatctctataaggtgatgactttgcg

SEQ ID NO: 565326 - DNA, 889 bp, Homo sapiens
ggggagggatagcattaggagaaatacctaatgtagatgatgggttgatgggtgcagcaaaccaccatggcacgcgtatcactatgtaacaaacctgtgcacattctgcacatgtatctcagaacttaaagtataatgaaacaaaaaaaagaaagaaaagaaaacactactgcctgggtatggtggctcatgcctgtaatcccaagaccctgggaggccaaggtgggtagatctcctgaggttgggagtttgagaccagcctggccaagatggagaaaccccatctctactaaaaatacaaaaaattagccaggcgtggtggtgcatgcctgtaatcccagttactcaggaggctgaggcaggagaatcacttgaacctggaggcggaggtcgtcggtaggcactagattgtgccactgcactccagcctgggcaagaagagcgaaactccgtctcaaaaaaaaacaaaacaaaatgaacacacgaaaacatatacggaggatctcagacagggacagcttccacctggtgttcatcaacaactctccggagccaccctacatttacttgacaccaactacatccgggcacggtgagttgttaccacaactccagggattccaacgttcctggaggccaccaatcggggttccaaatcctagcttttaaggagacacaccggttatgatggatcaaaaccctatggtgcatacgcattcacagtgggtacctctcccaaacatcctcgcacgccttggaaacatacttggggagctaccctcagccacgaccctagaatgtcgcggggaccatccccggaccttgccttcaaaagaccagttgcaacaacatccgcggcacactggcaacagggccatcggaacacgag

SEQ ID NO: 565327 - DNA, 195 bp, Homo sapiens
  misc_feature (108)..(108): n is a, c, g, or t
cactgctcaagaactagggctgctctatgcttcaggaggacatggaaggtcgagacatcctgcgcatgtgcagtgccgctctgtagaggtagctgtgggggggggggngccccccccccccccttttttttttttttcccccctttttggggaggggggggggttggccccccgcggcggttggcatcctgtgac

SEQ ID NO: 565328 - DNA, 117 bp, Homo sapiens
tgggccccaaaaaagccccaggaacatctttcttttcccgcaacccctccccccccagggaggccctggcccccagtcccttcccccgtggaataaacggggtgtcctgaaaaccca

SEQ ID NO: 565329 - DNA, 1768 bp, Homo sapiens
  misc_feature (1496)..(1496): n is a, c, g, or t
tccccaatttctcttttttggaggaggaggggggcgcaacaaacaaaaaaaccagagggggggggggggcgcaaacctctaataaaaaagggggaggagagagagaccccacaagaggcggcgagcgcggagtgggagcaccaaggaggaaacccccgcgcgcggcggcggggggagagaaatccgccgcgcgggggataagcaaaaatagactaagagcgcggtgccccacgcgggggtgtggtgtgggaacaagaaaataatatacacagcagcaaaacacagagaagaggcggcgagagcccacacaatggggagcgaagagaagaggggcacgcgcggggcgcgccacccacacacatctcgagggagagggggggatctaccccgcgcgcgacgcccctaaaagagagagagagagagaggtgtagctacaaagagagagaagtaacacacagcagagagagagagcgggggcgcgcccaaagagagagcgaggagacgagatgcgcgcccaccagagcgggcggggcggagacacgtcacccagacgagaagagaagagaaggagcagagacgaagaccaaacacaacatatctgtaatttcacacaacacgacgaggagatagaatgagaggagaagcaccaacacatccgagacgaggaggaaaaaactaacggaggcgcgcgcgcgcacagatccaccacacgaagacagacaacaacacgacgcgacggagaggaggtagtgtcacgtcaacgcaatagtcaccaacacgcgtgcaagaggaagagaagtaagcaaaacatctcgacgcggacgcaacgcacagctccacgctggagttgaagacgtagcacaaccagagacgacgcagcagacaaccaacacaaacacaaaagggacatcaaccaagacaacagaagagaaagggacaccccactgcctactcatcccagagacagagggaagaggacgggtggggcgggcaccaaacaaaccacatacttacggggcggcagacaaaaagcctcctcctcaaacagggccccacacacaaactactgctgcgggcggggcgcgcacagacagcaggatgactaaacaataacacagatgggtggcacgtcgagaaggcacaacaacaaacgcaggagagggcggcgagacagcaaacacccaccctacgaggacgaaagtcacacgcgtcggacgcagaacaaagatagcggagagggcccaataaaaaaatactacctgcggggaggaagcataaacatcgtctgccgcgcgcccaccacccagagaaaggtggtgagccacgcacgctaccaagaagagggggcggggccaacaaaaagaacggcagcggggccgacgagaaagcgacagagacgacagagcgacgcaggcaatcaacgaacagcgacgaggatcagaagccacgaaggagacacccaacgaggggtgggtgcaaagaaacgagcacgaggnggccgatcaatacagaagccgacgcagagtggaggaaacaacacgagcgtcacccaaaccacgaggatgaagacaaccccactactgcgtgagagaagaagaaaatcgacggaccgaccgcggcgggagaagacagaagaagcacagaggtcgacacccaccaagagagggcccgatactgcaccagcatgacgcaacagcgacagcgaaagcaagacgagaacaccagggcggaacggaaggcggcacagcagacacgagacagtagaaga

SEQ ID NO: 565330 - DNA, 917 bp, Homo sapiens
aactagaaataattttgcacatggagagccaaagctaagacccccgaaaccagaggagtctacctaagaacatgctagaaagagcacacccgtctatgtagcataatagtgggaagatttataggtagaggcgataaacttaccgagacctggtgaatagtctggttgatctcgaagataagaatcttgagttcaactttcaaattgtgtccctagatgaacttttaataatcccttgtgtaaatgaaactgtaagtccaaaagaggaacagtttcttgtggataactagtaaaaaaccttgtagagagagtaaaaaatttaacaccactatagtaggtcataaaagctagatcacacaattaaagaaagcgttcaatgtcaaacccatatacctaaataaatcctcaatattataaactgaacgttcctcactacccagtgggatcattttatcaccctatagaagaactaatgtagtataagtaacatgaaaacattctcctccgataagcctgcgtccagatttaaaacactgaactgacaattacagcccatatctacaatcaccagaagtcattattacccccattgtcaagccaaaacagggcatgctaataaggcgaaggggttcacacaccacggtaaggacatccggcaaaatcttaccccggcgtgtttaccaaaagaaattaccttctagcatcacagtattagaggacgctgcgtgacccacaggtgaagggcggggaccctaccgtgaaagggtgcaaacactggccaaaaaggagcggtgaaggtcacacgggcagggcctaattacaggaaagacgcggaaaggggataacaaggaaccggggtaagagagcaacagcaaaacgaatgggggcaacccccggagaacaaaataacggacacc

SEQ ID NO: 565331 - DNA, 405 bp, Homo sapiens
gtagcctcagatgcccgtctgcctcaaatttaagcattattatcatgttaacatgattatttgtcttaaacataacatcacacttaagtttctttcgatcttgaacctgaagtatttcatatttactatattttaagagcttaatattgttaagttaaaactatgcatttgtataatcaaggaagcagttaatatttattatatatagctttcatgtctcccatttacaaaaaagtttcagttattctattaaagatttgttggtatattctgcattttacaagtggaaaaaatcagatttaaagaaagggtttaatatttccaaaacagagtttgttatctggggtcgtgtgataaactcttgtggaataaacacgtttacagtttattattttactcctccca

SEQ ID NO: 565332 - DNA, 890 bp, Homo sapiens
  misc_feature (549)..(549): n is a, c, g, or t
  misc_feature (890)..(890): n is a, c, g, or t
ctatgtagaggctgagtgttaatcggccgagggcgacggcgaccatagctctccagtgtcaatggccagcaaggagtggggggtcctgcagcctgtgcgggctggcgtgctgtgcatgtgtgtgtgcagctgggagacaaatggaaacctccacagtggcacatgactccatcaatgatgtgagaactggggcagatgcacatgcctgccaatgcttggtgtgcttgcctccccatgactgccctgatgcatgcatgtgatgtgcccattcatgaatgtgccaatgaatgtactgccatgtgatgcattgcagcatcaatgatgtgttgcttgtgtgaatgcaagacacatctgctgcacccagcatgcaagcatgctcaccacacctgcaggagtgtgctgtgctcatgctgtgcaatgctgtgtgctgcttggtggccatcagattgttgccctgctggtctagcgtttgtgtgcttctattcttacttatttgatagcttgtgtgtgtgatgtgacagccagtcctggccatgtgggccttttgcnctcccttttttggtgccccatttcaattgatgcattctgacatttgtccttgtggtgacttcctgttcaccactgaaaggccacaatggtgctttaggcctatctgtggatgtattgatgtgtcccccgaagcttgcaacatgcttggcctatgtgagcatgatgaactctgtgtgattgcttgggtggtgcatgggaacatcaatggtgttggcagacccaagcaacaataggggcaatgccccagcccaatcatacgaccatgttgggctgagtgagtgcaactgtggccttcaaacctgcatctacgtggcctctgtgcacccagtgacctctccagn

SEQ ID NO: 565333 - DNA, 300 bp, Homo sapiens
cttcattcagcagtcacctgtgtccgtgtaacattatgatcaaataaatttgtatgccttttctcctattaacctgccttttttgtcagcgattgtcagtgaaacttcagagggcaaaggggaagttttccttggaccctccagttttggtgctgtgaacaggataccaaagctgctctgttcttctggaagctgcaatgaagggaaccaaggacctgacaagccagcagaagggtaagaaattcttaccagtcaggctcccggcctctctccctctgtggaatctggtagagccgatgg

SEQ ID NO: 565334 - DNA, 143 bp, Homo sapiens
  misc_feature (109)..(109): n is a, c, g, or t
cccgggtgtgcggaacaagtcattagtcatttcttataactgtgttgtctgctatttagggagtgataatcatgaatatcttattgacattcagattaaatatagtgtntatgtgaaaactgagagattcttgtccttctcat

SEQ ID NO: 565335 - DNA, 697 bp, Homo sapiens
gcggtgatcctgctaccctgaatctgttcctgagtaacatggagcggatgctgcatgacaaggtgcatggcgtccgagtgattggaagctccacattggacactctgccacctggtcgctcagcggccgcggatgcctattaacagatttggactgcactgctgcggatctggcggtgccacagtcatcatcagagaagcaggcggcatcgtgatagacactttctgggtggaccccgtcgacctcatggcttgctagagtgcgttgcttgtccagcacccgggagattggcgatactcatagctcaggccttacagacgattaattatcgggctgggcatgatgacgaatgtgacttgggctgaagcaaagttgctcccaaggtctccctgggctgctgtgggctcctgatgaggattggtcctcgtgggccatcgctccatgtcaggttggctcatgcatctgtggtcctggtgtaagccccaggagggagttgtcaggctaaagtgcagctgggtgtgccttttataacatcgacgatcgtcatctcagcaagatttggtgataaggggtgtactctcttttaatctcacggtagcctttttcactgttacaaacgtggtcgccgtgtcacggcgcaagagctccctagtctcctttgaatacgtcctcgatagtcaaccttgatttcccccca

SEQ ID NO: 565336 - DNA, 122 bp, Homo sapiens
catcactttcatcacaacaatttatcaattaaacccccgtgccataaccacaattaccaaagcgccccatcttcgtctgatccgtcctaattacagcagtcctacttctcctatctctccag

SEQ ID NO: 565337 - DNA, 270 bp, Homo sapiens
cttatttttcatataatttggagaccttgttatcaaataaaatgatgagtttctgtgcctgtaaaaaaaaaaaaaaaactaagtgaagtcatcctttccccaaagggaccccgggagagatgttcgggccctcggcggactacttccaggaatcagcacctcagggactattggagaatgtggtgctctctatgggtcacctggaagactcggttccccggctggcaaactcttctcttctggccctggggtacgtctggctggtggccg

SEQ ID NO: 565338 - DNA, 1614 bp, Homo sapiens
gccacagcccagagcacgtggagatggctttgctcagacaccatcctagacggcctattccttgtgtctcagaaaatccttgagcgagcaagcctctgatactatggtaatctggacgtgatgcaatcgagagctggatgcatgacccttggctggcctcatggctgactacggggcatctctggccaagacagactggcaaggacggagatcccggggcaagaagttcctggcagggaacagcagacgagcagccagccgacaaagacagcgaccagacgaaggcattcgagcacagtagcacggacccacccggtagataccaggaatactcctacacgaagcctgaacagcacaaacccaggcacggcatcagcgcacgcaggaacacaccggcgacacaacacagaactgggacgaaacaccacaatcctggccggagacagagacagcactagggacaacagcgcgacccacccaagaggagggacaagggaaccagagcaagccgaacaagacaccacacacaatccaacaccagagggggaacggcaacaccgtgagaacaataggcacacaatgagagccacaaacaggccaccagtagaacaggaagtgagtcctcacaggagagaaaaaccacacaaggacagaacgcaccacgcagagacaacagacctaccggcagcacactacgcgatcaactactaaacagggaggcagcaacactcaacacgagacagcagaaggagacgcaaccaccacgccggggaggaaaaccaacccccaaacgcctggggagacatgagagcaccgccggcaccaaggcggcgacaacacagcgtgaccatcacaccggctcgactccacataggcaaacagcagagacagacacacgataggacgagggagaacacaacaaaccgacacaggcgagaaatcaacccgaggagcgacaacacactacacaaagcggagtatcagccgcgcgaccagaccacaccactactatgtggcagtcaagagagcaatctcgcacaccacacagggaacaagtgacacaagcaaccaacacgcgcgcaacgatgagaacaagctacactgagcgcacacccaccacaagtagaaatgaagacaaaacaacgaacacctaagagcagagacaagtgaacacactagagcgaccatccaacagtatagacgaacagaggggcacacccaagcgaacgtagcgcaacagcacagtgaggagaacggacacacagcagctgacaacaccaacacatagcacacagaaccaaacaaccggacagaagcgagagcaacaaaccacacaacgaccagcctgatagacaacacaggatgccacgatcatcggaagacaacagcggagataccgcaagagtggacaacacaccacggccgcgaccacgaccacaaaccaactagggaagcgaaaggagcgaagaagtacgggtacagcaacacaccacgggcgcacaccgcgagaggaacaagacagccaatgagcaacaaatcacaagacgcgagaaacaaccacaggaccgactccaaccaacagtagacaaacactaacacgaaggtcgagacagc

SEQ ID NO: 565339 - DNA, 343 bp, Homo sapiens
  misc_feature (180)..(180): n is a, c, g, or t
cctggaaggcttttcccctttctatgtgtgggtaggctgaaaaatgcctcccccctccaggctgggttcaagtgctcacgcctgtaatcccagcactttgggaggccaagccgggtggatcacctgagatcaggagttcgagaccagcccgaccaacatggagaaaccctgtctctactnaaaatacaaaaaatcagccgggcatggtagtgcatggctgtaatcccagctactcgggaggctgaggcaggagaatcgcttgaacccaggaggcggaggttgcagtgagtcgagattgtgccattgcactccagcctgggcaacaagagcaaaactccatctc

SEQ ID NO: 565340 - DNA, 572 bp, Homo sapiens
ctaaatcagctcggcaccggttaacgcacgtggttggacgtataccctgtggatagagtcggaagccctgaggcatagggcacgcgcctccgaggaagataaacaggtcagctggagaagctagctgaaggagggcagcagtaaatcagagggtgtacgactgggatacaggccgacctagagtgagcatgtgatagtatccaacacgatgagttcagagccctcatgaacaggattggtctggctattcgtgccatataattgtatggaaactcccctccgagcggtaggttgcatggctgaatagcgcgagcgcagagctggtgaagaagatactgtgtgacgagcagagagggagctacaggcgctctacgccctccaggcccttgtagtgaccttagaacagcctcccaacctgctgcggatgttctttgacgcactgtatgacgaggacgtggtgaaggaggatgccttctacagttgggagagtagcatggaccccgctgagcagcagggcaagggtgtggcccttaaatctgtcacagccttcttcaagtggctccgtgaagcag

SEQ ID NO: 565341 - DNA, 791 bp, Homo sapiens
gtgtgtgagagccaggcgtacctctgcctgcccactcagtggcaacacccgggagctagtttcagtccttatgtggagcctcagcagttccctactttcagcaactcactggccaacgagccctgacacagcgagccaccactgcacgtggcttcagccttcacttaccgcaccatgactgcatccctccttcaactcttgcctccctctcttctagtgctgcgctgcacgcccctgctccgcgccgctcgcggcactcctgcgcgctgctcccatcccgactcgccgcgccataccgtctctcctcgcaacgactccttccgcgcgcccacgtggtcccgtcccacgtcgcccactgccacgcctacggtccaaaccgctgcgcgcctcacctctcacctaccatcgacaccgcccggcccgctcccgcagcgctcctctatggcctcctctgcgcttcttcgcctcggcgccctcgcctcaatgcgcctgccctacacgcgaccctggacgcagccccacgcctgcttgcccgccttccgcctgcaccgcctcacctctccctctacacatccgctccacttcacgttcacatccttatttcacacactccggcccctcggaaccgcccgccttctggtccaccgcaccgttggcccccttcgccatctgcagccatccccgcccccccctccatgccccccctctgggttaaaccccataactgccaaaaccgtagaacccttggcgccccttcgccaacatctcacaacacctattatacacacccc

SEQ ID NO: 565342 - DNA, 460 bp, Homo sapiens
aagctcggtaccctttatatatctaaactctccaatacagagagacagagtgctgaatggggaaaaaaaaaaaaaaaaaaaaaaaagcaagacccaggtgatctggtggccttaaaaaaacacccctcacttttaaagatacagactgaaattgagggattgaaaaatagattttctatgctattggaacccaataaaaagagcaggattatctatacgtggccattcaaacacaaaagatatccactaaaaacctgaaaatagagacaaaaaggggctttatataattgataccaaagtaaatccagaaaaaaaatgatgattgtaaattttattttcccccccccaacactaaagcttccagatatataacgcaattttttttaccactaaagaagaaaagatagactctcattacaataagagagggggaattcagttcccccattttcaggattta

SEQ ID NO: 565343 - DNA, 294 bp, Homo sapiens
ccgccgcccccgcccccgccgctacctcagaactgaacagtgttggctgcgggcgaaagacagaaggtcatgggaacatacagagacctacagggaagacggccatgggacaagggaggcagagtctggagttacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtctta

SEQ ID NO: 565344 - DNA, 955 bp, Homo sapiens
gcgcggtggcgtgatggagcggagcagagagaaacagaaatgggaaacctgcgtgacttcctgtgctctacaatcggatgacagaactctgttccagcgctgtgtgcccagttgcaccaccgagctctggaacgctgaggaggaggcctgtctgcacagttgtgttggaaggctgatccattccaaccaccgctcatggccgttacgtgcagctcatgcctgcctgtacaggcgccgatcggaagactacgaggctgcctcggttgtgccaggcgttgtgtggaaacagccttggggtctctccaatcaggcagtatgcataccacaaacccaggaaggaggggccttgggatggacccctcagattgaaagggacccggtgtggcaccttttggggtttgtgtgaaatcctaaaacaggaagagaattcgaagggttgcctggaaagcttgggatgtcctttgcttcctttatcccttaggagccaataataccccagtttttcacctccagtattgattttatattccggggcaaaggaacgctttgcctactttattgggcacaagccggtggtctagtccgtaagggcatatctggtgggattaagcaccatggaagttgagaaaaatttgtttcttatattgttaaagtgaacacccctggaggcatttgcggcgccttggtacaacggccgggtctgtggttgtccatttcagacggggtaatattgtcatgcccatagcttatatttcacaacaaactattagttaggggattaagcctacttaacgatgggcgcagatccagaaagtcccgagggccttttaacacggagatgttctgcccaattagagaagggggctcgtatgctaacgacagcacagggcaacgagccactggggtcaccggttggacgtcatttatggtgacgagaagacaacaaactagggca

SEQ ID NO: 565345 - DNA, 268 bp, Homo sapiens
ctcttcccctgttgacagctgtcattacaggatctccaaactttactattatatgccttctttcctgggatggatttcttgtatcctgggtcccatatttactctttcttggattatccactcatttacatagcgtacatactcttattacatcttcataaagtgcatgataagtaaaattttgggaaccacagatttctgaaaacgtctttattctatattccaactagatgtacattttggaaataacttcccgtcgactaatttt

SEQ ID NO: 565346 - DNA, 252 bp, Homo sapiens
caattctcctggttcggcctcttgagtagctgggattataggcatatccgccaccatgcctgactaattttgtatttttagtagagacgggatgtcaccatgttgatcaggctggtctcgagctcctgacctcgggtgattcacctgctttagcctcccaaagtgctgggattacaggcgtgaaccactgcgcccggcccaaaatctttttcatttgtttttttggtgtgtggatatctagttgtccttgaa

SEQ ID NO: 565347 - DNA, 520 bp, Homo sapiens
gaggacccccccgaacccaagagcaagtactaactagcataattttgaatttagtatataacacactttcatctgcactgggatacttatactatcacactaccttttcgtatttatccacctcaatttttaacttcattaatcttcagaagaaagaggtataaagtataggaaagtaataacagaatcattacgaggaaattactagcactgcctaaacattcagaagtctgtgacacagtttatgtctaggattgcctcaaaaacctaacaaaaggaggatcccgaattgaataatctgagcaccttgtcaactgaggttgatattaaattatttttcctgcattctttgtttcctttcacactaattaaatattgtgtacaagcttataaaattcaataatttgtattaaaatacaaaatccaataacaaccaggagttcttcggaagaaaaaaaaaatcacaaaacaaccccaacagtggtgaagaactatattaaagatggcttttcctaagaca

SEQ ID NO: 565348 - DNA, 768 bp, Homo sapiens
catcgaattccattgtctcgggactgcgcgcactgtgttggtacctgggattcgccatatgtctgttttgagacaccagtctccactctttcaactgaaagccctttgccagactgtccggatgctacacagttggtggattcgctactgtacctagtgcccaacctgaacaggtaaatcaacaaatctgcacgccataacactacgagccacagcttaaaactcaaaggacctagcggagcttcatatcccactacaggaacctgtcctgtaatccataaaccactatcaacctcaccacattaaactcaatctttacaatttgatactaatacatgttaaccgattagcccaatcccactttacacttgagacagtctactcatgcggcctcaaatctagctccatcgatcattcaccctttactcataccttttaaatttaaatgcccgacgatttatacaatctcgactgggaaaccccttgggtacccatcttaatactcctactatacatacatatttctccagctggcgtaatgccacaaagccctctccgttcacctttataacagttctcagcctaatgctcaaacgaaatcttttccgtcaatctttccaaaaaatctcttaaattatgattactcatctatttttaacccatacggcctatatcggctagtcccttttataatgaatatacctatatatgattgaactttttcctagtttgatcaatgtcacttttcacttggatattcatcttccg

SEQ ID NO: 565349 - DNA, 218 bp, Homo sapiens
ggtcatcaggatgaaactatcgtaccacccatatgtagcacaggaaaaaggacgtccttaggaaaggataatcactgctattcagtggagtggccactccctgcaggccattgcactagcttgtttctcagactggctcttactgagattgttttgtaaaacagcattgtaccatgtgtctttcatcatctgtattgtacctgagactagcaaagtcg

SEQ ID NO: 565350 - DNA, 187 bp, Homo sapiens
  misc_feature (29)..(29): n is a, c, g, or t
cctcccgtgtgaaccatgtgactttgtcnccccccctgatagttaagtgtgatcgagacatgtaagcagcatcatggaggtttgaagatgccgcatttggattccatgaattccaaattctgcttgcttgctttttaatattggtatgcttatacacttacactttttgcactacatgtagggaact

SEQ ID NO: 565351 - DNA, 171 bp, Homo sapiens
ccgctttttttttccattgaattaaagggtttctctttctctctcctctctccacttttaggttaaaatcctactatcagattgtcaggtgtctgggtcactttttctatcctttccaagtaattcaatccaaatcaagggacacattattaatgcttaaatcatgtaaaa

SEQ ID NO: 565352 - DNA, 159 bp, Homo sapiens
gtctctacataattcagcccaacaatgcttggtttatttcaatcagctctgacacttgtatagacgacttggccattctaacagttggtgacgtttgttcaacgcaacctatcgaccttgatcagcttcagaccacagcaactagacaaactcaacaaa

SEQ ID NO: 565353 - DNA, 284 bp, Homo sapiens
tgaacattcgtgtccacttgcgtttgcatggacacccacctgtaattgtctgtactcatatcaggaacagcaaagcgaaccaaaggtggctcgtctgagaagctctcctgacacatggcgtcttgcctaggaactcgatatcatacaatgccagcatcaccacgacttcaagaattccagggccatctatccagctgtttataccaagaatcggcgtactacaactacattttccctgtcatcctctagactccatctctgacatagccaattgtgacgtcccg

SEQ ID NO: 565354 - DNA, 307 bp, Homo sapiens
ctttcccccaattttgggggcccccaccttagaacccgggtgttcggccctggctgtgggggccggggccccctgggcctgggggtttttaggggtcccccctggtcccaaccctgggggaagggtgggccgggggttttttcctttgccggggagagggggccctaccccgggaaaacccttttgtttttttttggccccgtttcccttaaaagggaggttttttgggggggggcctttttttttttcgtttttttcccccccccccctttttgggggcggccattaatttttttttgggggtgga

SEQ ID NO: 565355 - DNA, 172 bp, Homo sapiens
gagatgagatttcacatgttggccaagctggtcttgaggtcctgacctcaggagatgggcctgccttgacccctcagagtgctgggattacaggcgtgatcacggcgccctgtctgttggtaaattgttaatatgaatactgcagtgcagcagggaagaggctttgccatct

SEQ ID NO: 565356 - DNA, 377 bp, Homo sapiens
  misc_feature (112)..(112): n is a, c, g, or t
gtgctttccaaccacagagtattacttgtacacggagaactacaaagggctcaaccgtgtgcaggggtgtctgtcactcccaaaaaccttttctgctaactgtgcagtttgnactcgccatgcacgcaaacaacacggactgtgccccttgctgcgtcgggcctgcctgtgccagctgctgggctcagttgatgacatggcagtcaggcgcggtgtaacaagaggcgtgcggggccggcgatccaaggggccgggcatatgaccagtgcggcaccgaactgagaagagggcctatccccccccaagcccctaaggctttggtgggtggtcaacgggggacattgacacaaaaggcaccctatttacataaataacgg

SEQ ID NO: 565357 - DNA, 443 bp, Homo sapiens
cgagctgtggccactgaagccgctcttcagttacggcagtggtcagctaatgactggtcagagagttccttaggtgcctggaagcgaagtctttgccgagtgggtctctctctgtgtgccgggcgtggcttcagtgctcggctaggcagtgctcaactttcccttagccgtcacctgctgtctgcacagcacctcaggtcagtcacgggtgagggctcagggccttgccggccttcctgaatatgggcacagctgcagacagccttacccacgtgcagggcacctagattcccaagaaggggcaagagctgttcaaaaccactacaagctggacatggtggctcacacctgtagtgtcagtgactcagaaggctgtaatgggaggatgacttgaggccaggagtttgagacctagcaagaccccatcccccacccaaaaaaac

SEQ ID NO: 565358 - DNA, 1379 bp, Homo sapiens
  misc_feature (257)..(257): n is a, c, g, or t
ggaacatggcggtagcaagagggaatacaggcgcgacagtggataaccaacgtaaactaatatgaggatgatctttacccgacgagcaacgatgtcctcaacgaggaaggtcagcatctcggccgtacaggagcgtccgtgcaaggtcacagagccctaatgaggcaggatcgagcgctgcgctctagtcgatgcctagagacctcactggcgatgatagatggcaacgcggagagccggaacaaagtgctgtagtngactgataaatcttatttaagaacttaaaaaatagtagcacaattataatatgtggcacaaaatgtgtgagatgcaatacgtgtgacacgctagggctcagtccagtagggttttgataccgtaacgtacatatcttagaagcaagatattaatctcatagctgggaagagagcggaggtatacccagtaagggcattttgcacgagtaggtaagctccccattggctcttctctcgatctgaaggtcgcgtgaagtcagagacaagggacatcgctcgaaagattctttggagattaccattagaactctaatattattagcacctaggttgttcgctttatttcaatggctgtgtatcccacaattggtctttcactctttttctttttgttgacctaaggtactgataaagagaacttattgtgttgattacaacccaataaattgttgggtaaaaatataggcacatggcttaataattaaatgataagtcgatcttaggacatatcaagtttatttaaacacgcaatagggtgaaggggtcatatttcacatttacattacatgccccaatttcaagtttttaaatgcgtgggtcacacatatggactgtggaatgtgtatttcacatataaggggttgaaatactttcaagtatattgaccccggtggtttgggttttttaagtaatttatttgggtgttgaccaatttccaaggaagaaaaacgttgagggttagttggagcggaacatactttggtggaaacattctaagtggggtgaaaagcgagctccataggaacacttgtgtctgcgggtagtttgtttcaaaagcatttttagaaccaagttttccccaacgaagaaatgttgggaggggggcgaaacaggttttataacaaaattatttacggtaattatttagttaacaataaacgagtatttattttcaaacaaatgggggcaatgggcgtatttgtggagaagggacacagatggttctcgctagaggataattttgaacacaattgggctcgtttgtggaacaccacatttgtttgtatagaaatgttacagcttcttattattaagaacccacttaggtgttggtctggtggg

SEQ ID NO: 565359 - DNA, 407 bp, Homo sapiens
taagggcctgcagggcgctgcactcgctggttccaaagtggagtttccagacagatcccattcttgcccatctgagaactcctagaggtggcccttgtccacatcccgatactcagcctgccgtgcagtcatggacaggagtcggtgttgatgccgaaagctttgttccgatgcctgggttgggtgcttcctgtcggtcagcggtcttggaccatgtccagttggcgtgagtcaaaagtcttgaacatcagccatgtcatgctgcccatgcctaactacgttgcgcattctgggtgacctgacttccagtgcggctgtcgcgcttctccgggcacgcttctgtttggagcccacgccaagtcccccaggggtcaggctctcgtagggtgtgcgcgcgagggccgaga

SEQ ID NO: 565360 - DNA, 219 bp, Homo sapiens
cactgccgtgatgagcagttgtactcgtgagactgcctatcactgtgggtcgctgaaacagacctatatctagataagggggtgtctttccagacttaatttactaagagtctgaataagggatggataccaaatcttacgaaataccttttcagcatctatagagctatcataaattcttccctattaattgaagctgcaaatgaaggctcctgcaca

SEQ ID NO: 565361 - DNA, 430 bp, Homo sapiens
agtgagcactggaatacaaatatgagactatgctgccctcctagatctcaggcattttcatcatcatgaaaatgatgatcagatgtatactttgacatacattggaggtggtgatggagtaatataaggtgctaatgggaacaatttgagacatcggatcagattgggattgggagggtagtagactgacttctatttaaaaattattctctgcataggtatttatatagttcaaaactcaaaatatataaaagagtaaaatcgaaagcctctctgctacctctgtcctccagccaccctgtttgtccttagaagtaacccattattacttgtacattcttttgaggctaactcttgaactaaatcttaaaatggtcattcagattaagtcactaagaagagaaggggatagttttccaagcagttgccg

SEQ ID NO: 565362 - DNA, 633 bp, Homo sapiens
  misc_feature (412)..(412): n is a, c, g, or t
  misc_feature (498)..(498): n is a, c, g, or t
  misc_feature (633)..(633): n is a, c, g, or t
ggcgggcgcccctcccccagcctcgctgccgacttgcagtttgatctcagactgctgtgctagcaatcagcgagattccgtgggcgtaggaccctccgagccaggtgtgggatatagtctcgtggtgcgccggtttttaagccggtctgaaaagcgcaatattcgggtggtagtgacccgattttccagttacagcagatgaatggaacagcaaccatacgatagaaatagagatgaatcagactctggaaataccatgctttcaaaatagctcctcagaaatttcatctgagttcacctatgcatggtcggtggaggataatggaactcaggaaacacttatctccctcacctcatcagcaattgcacattacttaaagatagagtcaagcttgggacagactacagactncacctgtctccagtccaaatcttcgatgatgggcggcagttctctagccacattagagtcgggcctaacacagactcactggcatnctcctgtcttctgccctgctgtttcttgaagaggaagcaccctattatgctgcagagcacgccacattgtggcagtgcttgaggcctgtttccctggtacttgcattctttgttggccagggggatgagggtggn

SEQ ID NO: 565363 - DNA, 151 bp, Homo sapiens
aataggtgcatagtaggtgctgcagatgtagcggtaggcgtacggcaggctattggttgaatgagtaggctgatggttcgataaaactagtatgggcataggggtgtaggtgtgccttgtggtaagacagtgggctagggcattttaatct

SEQ ID NO: 565364 - DNA, 126 bp, Homo sapiens
ttttctcgtttacatcgccatctgtggaacaaaatgctaactatacctcacatagggctgtttgaaaaatcttaatctgcaatcaaaattaggagctcgtgtttaagatttcaaaacccctcgaca

SEQ ID NO: 565365 - DNA, 137 bp, Homo sapiens
  misc_feature (122)..(122): n is a, c, g, or t
aaaaagaaaaaccagcactgacctcaggacacagacttcccccttctctagttggccttgccaacccttgcaggttatgcttcccgaggcccggccttgcgaaagtgagcctgtcgtccccnttttccaagagcctt

SEQ ID NO: 565366 - DNA, 343 bp, Homo sapiens
cgtcgacatttctcataacttccaaaatctattttcttcctcatacctgatgcatatactttcttctccccggctccttcagctgtactcactctttaggtctcacaattaccattgttcctggcccggacttcaatctggcctctcacattattcctgatatcacacctgacccccatgactgtatccctctgatccacctgatattcaccccatttccccatatttccttctttcctgttcctcaccctgatcacgcttgatttattgatggcagttccaccaggcctaatcgccacactatagcatagcctgactttgctggtgtgtggcgagtcgacgc

SEQ ID NO: 565367 - DNA, 270 bp, Homo sapiens
  misc_feature (263)..(263): n is a, c, g, or t
tgcgggtctcttcgtgactagcaattgctcagcctcagggttgtgcccaagaggccctggggtccatgccctgtccaggccttatgccccaaggcacaccttgtttggagaagccacagcacctgggagcaacaaccagccccatccagcaagcgccataggtgtgaaatgtgccacaagcattgaccgctgggcttggccagatccacagaacgagagcggccggtgtaccccaaatcacgtaagctgagggagcacacgcncgaggga

SEQ ID NO: 565368 - DNA, 920 bp, Homo sapiens
tggggtcgtgagtcccactcactgtccggacgaggacggagaggtatccgtggctgctatcggtggatgacgcctcttggtcctgtcctccggaccgccgtatggccagtcgcggcgacgccagtctcccgcgggctctcgcacggggccgccgacgccgtcgggccgtcgtcatccgctcgctgtgtgcgctggcttagctgctccaccgacttagttgaggcttacgacgaaggtggaagactgtgtagccaggcacgatgcatttgccccctgagctcctctttgggcaccggaccagcttgaaccgctgcggttcttggcggtgcgcctgcagggcttccgactatcgtcatgtgcctcatatgctttagagcgatgggagtcgtgtaacggaagcggttatcctctgcgctctgctggtgtacaatccgtgggcctgggaagggactgtcgtggatgcttgctgatcggccagctgcgtgccgtaggcggagtctagccgactcggttaatggctggagtggtaagtcggggttgcatcgtgttggcaccctcgggttcatgggaatagtgagcatgcgccagaggtgatgtgtgccctcgggtccaagacacttttccttgattcactgtggccatgatctttggtgggaaggctgctgaactggactcgtcaatgacattaccagccctaccatggtcctcattcgacgattcagcaactacaggtctggaccatcagacgtattgagtaacatcatgggcttgcagggatgtgtgcgtaatggttgcctgtgcatgtgtgagcgaaccagctgaagaatgtgacaagaggagctggaaaggagcctcggtcaaaaagcactatgcatgaaggaaaatgggtaacaaattcatgcatatcaaagaatgatact

SEQ ID NO: 565369 - DNA, 341 bp, Homo sapiens
ttcgtcgacacgaacaacggcagaccgccccagccaggttgtggcgtagacctcgacaagcgccagggcctgcaaagaaggcatccctggccctggatcaacttcctcggacaaattgtacagcggcccttcctagcagtgcctgccgtccccggcggactcgctagcacccactgccaccacgctcctcggaattctcagaacgacacctgcgacactgtcccgcacacagctgacgctcccctggagaggtttctgtgggcccgcctgctgtgcctatcacgtcaaccagtaacacttgtagtgccgttcttcttcgacgtaagggtaccgcagctcga

SEQ ID NO: 565370 - DNA, 959 bp, Homo sapiens
acaaaaataagtggatgtggtggtgtgcgcctgtagtcctagctactcaggagactgaggtgagaggatgacttgggcctgggaggttgaggctgcagtgagctgagatggtgccactgcactctatcctgggtgacagagtgagaccctgtcaaaaaaaaaaaaatttttttttttggcctgtggacaccaaccaagtggttggtcccatatggtggatacttctataatagataactttttgggttatgattatggccccttatgaaaatgtccatttggtagcaaatcttctgcctgaattatttgatatggtaatggcggggagggggggcatacgtaaggcggggaaagggcgcctggcccagggcgtattcggaatcagggatttacaaacaacaccaacgaacaccacaaaacaaaacaacaaacttggtcgcggcgcgccgtcggcgcccagaaaaaaaagtttcacaaaacccacttcgggggggggccggcggcggcccagtgggttgcggtcacctcggccacacggccgcgcccaaggaggaaactctgggggctgcgacacacggtcgcggcgtttccccacacaaaaaaaagaaggcggcggcggcgaaagggacggtcttctggaacaaatcccgaagggagctcggcgagcccaccggggcgttcccaacacgcaggggagcacgaagggacagccaataaaagaacccgcggcggcgggacggaaagagagaacaagcagatgcacatcagaacaaaaacaacacaccagaacgagcgacgacaacaccacaaagaagaacgagatcacagagaagcacaaacgtacaacagcgacagacagaaatacaaaaggacaacgcagaaacacgaacacgaagcacagatagtacagaacagagacaacaatacaagaagacgcaccatagaagcgtacaactgta

SEQ ID NO: 565371 - DNA, 266 bp, Homo sapiens
ctgacctagaggatccccttgcggcgcgagacaagagtttgagcttgcagtgagctatgatcacgtcactgcactccagcctgggtgacagagcaagaacccatctcaaaaaaaaaaaagcgagcgcgagacagagctggcagaaactctaatggctaagggctggactcgtagagtccgatagagataagtgatatatcttacagctgtattggacatgtgtcaaggggtggggcaccatttgagccacttgagcagagcagccc

SEQ ID NO: 565372 - DNA, 1013 bp, Homo sapiens
  misc_feature (1)..(1): n is a, c, g, or t
  misc_feature (66)..(66): n is a, c, g, or t
  misc_feature (76)..(76): n is a, c, g, or t
  misc_feature (83)..(83): n is a, c, g, or t
  misc_feature (86)..(86): n is a, c, g, or t
  misc_feature (88)..(88): n is a, c, g, or t
  misc_feature (90)..(90): n is a, c, g, or t
  misc_feature (100)..(100): n is a, c, g, or t
  misc_feature (107)..(107): n is a, c, g, or t
  misc_feature (192)..(192): n is a, c, g, or t
  misc_feature (285)..(285): n is a, c, g, or t
  misc_feature (298)..(298): n is a, c, g, or t
  misc_feature (382)..(382): n is a, c, g, or t
  misc_feature (433)..(433): n is a, c, g, or t
  misc_feature (469)..(469): n is a, c, g, or t
  misc_feature (475)..(475): n is a, c, g, or t
  misc_feature (483)..(483): n is a, c, g, or t
  misc_feature (549)..(549): n is a, c, g, or t
  misc_feature (551)..(551): n is a, c, g, or t
  misc_feature (554)..(554): n is a, c, g, or t
  misc_feature (558)..(559): n is a, c, g, or t
  misc_feature (590)..(590): n is a, c, g, or t
  misc_feature (596)..(596): n is a, c, g, or t
  misc_feature (599)..(599): n is a, c, g, or t
  misc_feature (603)..(603): n is a, c, g, or t
  misc_feature (618)..(618): n is a, c, g, or t
  misc_feature (620)..(620): n is a, c, g, or t
  misc_feature (622)..(622): n is a, c, g, or t
  misc_feature (624)..(624): n is a, c, g, or t
  misc_feature (780)..(780): n is a, c, g, or t
  misc_feature (799)..(800): n is a, c, g, or t
  misc_feature (815)..(815): n is a, c, g, or t
  misc_feature (851)..(851): n is a, c, g, or t
  misc_feature (868)..(868): n is a, c, g, or t
  misc_feature (875)..(875): n is a, c, g, or t
  misc_feature (885)..(885): n is a, c, g, or t
  misc_feature (924)..(924): n is a, c, g, or t
  misc_feature (950)..(950): n is a, c, g, or t
  misc_feature (1013)..(1013): n is a, c, g, or t
nttggttcttttcctcttccaacagtcaggatttaaacgtttctatacttcagccaaagcatttgnatctaatgtntacattnttntntnttcattcttnattttcntccacctgtcaccaaggctcacacttatggctctgttatctttccctggctacatctgagtatattccactctgtcttttttggnaaaaagcatgaaggcattcattggtcttttgcacttattaggggaggtggcactcacagtccctgagctgtggtttttgacagctttagcatncaaagggttgggngggagctgtgatgatccaggtgagccacagtttttactgaatccagatcttgcaaagtcttgaccaccaggtcctccacaaganaaagatgcacgacgctggcgagccatactacttaacacataaactgcagangagtccataggtgtgaagtcatagcttttaaatgtntcaaanacacctgnatcatcaaaattaatggcatcggggtgtccaggaggataagaaatacatcgccaatatgtacttcncnacntggnntgccatgctgtaccacagtcaagcttggatnaaatgntgnccancctttatttttcacntngnangggtggtccagcttacactctacggtaagtaaaccatcttctactgtaccaggatcaaaagtcaacttcagtacagactcgccaaatgatacactttcttcatgtgataacaactttagaccatcagaaccatagcccttgtgtatgcccatttgnagatcttcctcattatcanngccttcagctctagncaaatctttcaactcttggcattccttattgcttcncttatgaaagcacagtngtgtgcntttcaaaaanaagtgacagacagttgaaggccaggaattgcaccatccnaaatcatcatcatctgacagggaggncatgcagaaaaatgccagaatctgactcactatttgccctttcgtgtcttactggttgtttcn

SEQ ID NO: 565373 - DNA, 163 bp, Homo sapiens
  misc_feature (154)..(155): n is a, c, g, or t
gctggacggcatctatgctttatttcaccaacatttgttttcaaaactatactgaaccaaaacctatttggcatttattgtcactaagatgtacgcaagaaaagagttagccacattctatatcaagaattagctaagaattctataacaactnncttctgct

SEQ ID NO: 565374 - DNA, 368 bp, Homo sapiens
tgggcatcacgctactggctgctgaccaatagatatgtgaaccagtcttggtctgcgacagtgatctgatataaggacctgccagtactggacagagtcaatccatgtagcatgtcgtgctcgtcaccgtgagaataggtaagagttctgttcagcggttgccataatgcctctgtccaatccgcaacccatagcatttatcttcttggccatctgatccagccgtgagtaatgtcaggacagaagtcacggcttgagatattagcttctgacgtagtcgagaaatataccactatcttcttgtcagtaagatcctgccgtgtgtggtgccaggacagaagtggcgtcatgggatatgactcaagagc

SEQ ID NO: 565375 - DNA, 666 bp, Homo sapiens
tgcagtaggcccgtataggtataaatctataggaggcaaaagcttgcatccttcctgttttcaagaagtgaatgtcttaccagtccattattatactaatcaaaaggcctggatcactcgggataccttttctgattggtttcataaacattttgtaccagtgccttatgcttattgcagggaagctggactgaaagaagagtgaaagattttgttatccattgataactgttctgcttatgctgcaaccgaaattctcataaaaaataatgtttatgccatgtacctttcacccaaatgcgacttcattaattcagccatgtgaccaggatatccttagatcagtgaagggtaaatataaaaacactgtcttgaacatcatgctagcagcagtgaacagaggtgtgggtgtggaaggttttcagaaggcgtttagcatgaaggatgtcatacatgctgttgccagcacttggccaacagtgactaagacacagtcatgcctgcttggcataacctctggcctgtgactattcagtgatgatgatgatgatgaacaaggtagtgacttggatggattccatatgttaaagtgagaaaaaaatgatatctgacctccttttatatgcaaaaaatacatctttagagtctgtcagtaaacggaaagac

SEQ ID NO: 565376 - DNA, 189 bp, Homo sapiens
accagggcggcggtgacggaatctcagttacagggcacttcagacaccacctccaacaacacagcaaccggtgatttccacaggggcctccagcttcctcagcagtcacgtccccctctcggagtccctccccttctgcctcagcctccacctcggaggcatccagggccagggagaccccggtctcca

SEQ ID NO: 565377 - DNA, 402 bp, Homo sapiens
agagcagtgacggaatctctgctctctgcaaccttgcctcctggggtcaagcgattctcctgcctcagcctcccgagtagctgggattacagtgtcacatggcgtcatcccaccactctaatgatcccctgagctccccctcgacattcctccctctcccccatccctctcctgcgccccaggcaaccactgatgtctcactgactccatagctcagccttttccagaatgccgagagctggaatcctacagtcggtagccttttcccattggcctttttgaccaagcaataggtgttcaagtttgctccatttttcatggcttgagagctcatttcttttcagcgctgaataatactccattgaccgcgtgcaccacagggcgcctgctcattcacctatt

SEQ ID NO: 565378 - DNA, 401 bp, Homo sapiens
gttgtactgggctaaatttttgtcagtatgtgattgactaatctcaagcttagggtgaaccctcgtagtaagctcaaggtcagttcgggtacacttgaataagcgtagaattgagcttatttcttgctcacttttcagagatttcatgaggcagttgctcattctggatgctaattatcctttatatacttgataagtaggtagggtagaattctctctggcaatggtctatgtgtatattattattttagtctagaggtgttaggtacatgtaagtcttagaatttcccgacgtgatgctttgcggtgaatctggttgaatgtgatcagtgggaatacccagtctgccacctttatccttgatttctcagcattttattcagtaaacaggcttacctttg

SEQ ID NO: 565379 - DNA, 206 bp, Homo sapiens
acagtaaatctgacgggacatagtctttggggcagtatgatagatgcccacagcatgaagcaaatatcttttattggaactatgcacacttcaatacttcgccacttatagtctatagaacgggagataacatttctctatcacagagagatcacgcgacctatttacggcaccactccgacaataacacgaacctcgaccgggag

SEQ ID NO: 565380 - DNA, 472 bp, Homo sapiens
  misc_feature (37)..(37): n is a, c, g, or t
atctatcctactgtacagtatccattagaagtgcttngtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaaggtatttttgatactttttgggttgacatataagggtgaccaaccctatttgtttttatcttaaaggacaaagatagtgatttttaaaaaccaaaatgctatattttgtattttaaattgctaattttaatttcaataagtttaaataaaagtctgcatgcatgtgtaaaaa

SEQ ID NO: 565381 - DNA, 188 bp, Homo sapiens
tcgaaaaattatttggggggttttttttttcaccctcccttataaaccacagggtacctggaggtttggggcctttttccgggggaaaaaaaattttgaacggttaaacaccagggccccttggttaaaactgggggtaagggggtttttttgcgccggggttaaaaagggggcgtttttatttgggg

SEQ ID NO: 565382 - DNA, 375 bp, Homo sapiens
  misc_feature (100)..(101): n is a, c, g, or t
tagtagatcacagcgcaaattacccctaataaattaattaaccactcattcatcgacctccccacccatccaaccatatccgcatgttgaaacttcagcnncacttctttggcgcctcctgatcctccaatcaaccacaggacttattcctagccatgcactacttcaccagacgcctcaaccgcctttgcatcaatcgcccacatcacttgaggcgtaaattattggctgtatcatccgtaccttcacggcaattggccttcaatattctttatcttcctcttcctcaaaatcggcgaggctatattacggatcattctctactagacctgaacatcggcattatcatctctgcaactttagcacagcttcatg

SEQ ID NO: 565383 - DNA, 365 bp, Homo sapiens
  misc_feature (162)..(162): n is a, c, g, or t
  misc_feature (199)..(199): n is a, c, g, or t
  misc_feature (248)..(248): n is a, c, g, or t
  misc_feature (256)..(256): n is a, c, g, or t
  misc_feature (272)..(272): n is a, c, g, or t
  misc_feature (292)..(292): n is a, c, g, or t
  misc_feature (318)..(318): n is a, c, g, or t
  misc_feature (345)..(345): n is a, c, g, or t
  misc_feature (355)..(355): n is a, c, g, or t
caacaatctgttggggcgcttcgagctgagcggcatccctccggcccccaggggcgtgccccaaatcgaggtgaccttcgacatcgatgccaacggatccgtgaacgtaacggccacggacaagagcaccggcaaggccaacaagatcaccatcaccaacgncaagggccgcctgagcaaggaggagatcgagcgcatngtgcaggaggcggagaagtacaaagcggagggacgaggtgcagcgcganagggtgtnagccaagaacgccctnggagtcctacggctttcaanattaagagcgccctttgaaggatttnggggtttcaagggcaagttcagcgagnccacaaatangaagtttttt

SEQ ID NO: 565384 - DNA, 117 bp, Homo sapiens
cctgacgttcgcctgcggagggagagagagttatcttggtttcctttcacttggtttcggtctgcttcaaagcaaacatcccagttgcaaatgttctttgtggctcgaatcctggca

SEQ ID NO: 565385 - DNA, 1616 bp, Homo sapiens
  misc_feature (600)..(600): n is a, c, g, or t
  misc_feature (710)..(710): n is a, c, g, or t
gtccttgaaaagagtgtggtggtgaacgcacccggctgctgttttgcaatgattgtcttcatggagagatgaattggtgtgatgtttgatgtaacagctcccatggggagcgggtggttgtggttgttctctcgctgttacgaccacgatttgaacgcacgtttgcgacagccacaagcgttgtgacagaagaatgtattttttgccaccgacacgaccaacaccaggtgtgcttgggagagagacgattatatttgtgtcctccagaaagccgcagacgccaccaacctttttttgtggggacaacactagagttagttctgcttggtttccgcgggtaatataattctctccgctttatgttcctcaaaaaggggttcttcctccaagaggagagccgcctcaattgtcttatcttacctcaaaatcccctccaccaaccacattttaaagagggggttttcttttttaaagggaactttatattatgacagataaaaaatgtggggctttttcttagaaggttgttttaaggctcccaccgttggagatctctaggggattgagcgccccccacaccgtccggagcataaaagtgtntgggtgctgcccccctttaatgggggaagaatactcttgtgtgtgtgctgtacagcacgccgcaaggcggtggccccctcagatggtggacaactccccgaaaaattttnttgggggaggagagagaaattttttgtggagagaaatggccccccccactctccacatcgggtgagaagagaaaagtgtgtattataacatagataacagatttgtatccctctttggaggggagaccttctttgtcgcgcccacgctgataataacactcgcgtttgtgtgtttgttggagatgtttgtatatatattatagaaatgtctccccacatccccccggcgtgttttatactcttctatagatgatatatagagaatatagggagactacaccacacaaacatttttggtgtctctttggggagccctctctcccacttcagacactctatatttatccccgctcggaccaccaaagatataggtgtgtatagagagcaacagagagatctctcgagagatttgttatattggagagcgctcgagaatttgttctctttttgtagaaataggagaggtatattcccccgctatgggtcccaaacattttgaaaatccctcgctagagagagaatatatatctatctctctgtggctcttgtgtataaacacacatacacatagagagagagtgtgagagcgcctcccccaccccacagagaaaggcacacacaatacatatgggcgcctcttttataggaccacactctttatatgtacacaggtgaagaagaagagaaaatggcacacatgtgtcctccctatttgagatacacgagtaccacggcacatatatgtcactcttatttgcgttttggtttatttgcacctttgcacaaataaatgcacattttttacacacaaagtggagagaggtttattggcacacactttctgcggtgaggccacgtttatttggggccaagtttcccaaaaaaattttcctttcaagttttgta

SEQ ID NO: 565386 - DNA, 178 bp, Homo sapiens
cgtgtggggtactaagggcagtttcctaattgccatctcactggagatgtttaaagttggctctatcctaatgactcaaaactggttcttaactaccatgatgctttgagggcccggaattataaatatatattatattttaattgttggagattattttgacacatttctttgatac

SEQ ID NO: 565387 - DNA, 127 bp, Homo sapiens
cagagaaaacgccggacatacactacatcggcgatcatctgcaggggggtacggcgaggttagcgcggcttgctagcacgtcatcaaaacagctattagtggcgagtagagtaacgaagtccgggag

SEQ ID NO: 565388 - DNA, 2073 bp, Homo sapiens
  misc_feature (201)..(201): n is a, c, g, or t
  misc_feature (594)..(594): n is a, c, g, or t
  misc_feature (898)..(898): n is a, c, g, or t
  misc_feature (1721)..(1721): n is a, c, g, or t
  misc_feature (1837)..(1837): n is a, c, g, or t
  misc_feature (1928)..(1928): n is a, c, g, or t
cgtgacgtctttgtagtcgtctgtcagtgtacttggttgcgtctcgcgtgctgctcgggtcttggtctagttagcatcatgtcaggtcgctgctcattactcgtgtagttatccccgtccggtgtgtggccctacttgtgttgctcgtcggcggacactatggcgtgttgtcctgtagacagcgtgcgggtgttttgtccnccgcggcgcatgtagttgtgtagccagcggcctgtaaggtggctagcgcgcgctgttgggggtgcgaattgtttcagcgcaccaggggtgtgttggttttgtcggttgtagtttagttgtcgtctgacgcgactgtttttgaggggggttttctactcgtgcgtaccatgtttccttcgggggaacactccaggagtacatcttgccggcggttgtggcactattgacccagagtttttagtgggcgctactcgaatggcgtctcgttgttggtgcgctcgtctttagttaaaggtggtgcgtcactccgggcgcttccttcctgttgcctagggggtccgtctgttcattcgacgaagatgtttcccgtacacgatcccgatagtaaggcgnaaaaagttgttatgagggggcacccccaacagtgataataagtttctttgtgggggataagctaccatatgtagtagagaggactctttgttgtctctttgtataatatggctcgctgtgtcccattagggaaagttgctccacaacgtggttgtcccataatgggtgaattattttttggggacggaaatttaaatattgactcagactcacatggcgtgtggtgttagacaaccgacagtgtgtccaccgtgggttccgccgtcccaccgccgtgtttgaatatagcgcccggtgctgatanttccgctctgaggatagataagacaccccccgggtgtgggggcggccccacacaataggggatgattgttatatagatgtgaatgtgtgaccatcaatgtgttttggggaggaagaagacctgttttggggcgcacacatcaattaggtgtggtagatcttcctgtcgtatcggtagacacactacaagcaaagtgatatttgttggttgtgttgttgtcgaccgccacgaacatgagttggggtgtgtcttaatcaatttggagtacgaagcttgtttctctcgggtggaagattgtgtaacaaaaccgtgttctttgtcaacagcgcagggaacgccccaccgtgtgggcaacataacacatttgggggcccacgccatcaacacacgtcgtgagggggggtgtacccacacatggatgtagaatatagcgcacagcagcattgtagaccttctttgtggagccaacaccacaggtgggtggtgtagaatattattgttatatatgaaataggggtatcccacaataggactcacggggtatacacgccgctggggagaagatttcgcgtgtgtgtgcgcctctgtgtgtggtgtgtataaaatgtgggggagatacgcgcgcccaccactagtagaacacacatgtgtcccctcgtgaggaatgggtaataggtttctgtaggggcggctctccgctgatgaactccatctgtctcgtgtagtgtcctctggcttataggctcggtagagagataatggtgagtgtcctctgagtgataacacactctgtgagacacacctcgtgatatttctctataangaagtggtgatattgttagtgtgtgagaactcttgttatcacagagagtgtggctctttataatagtacacctcgtgaagtggaggagaaactgagttttatagatatcaactctnggaaagatttgtgatatagtgtgttgatataaaactgccacgtgtgtgaaataggtgtctggtgtttcacatgaccgcctcggattgtgtngccacagagactttatatgtcaccacagagtggggtgattataacttgtccagaatttttttgtcaatcaagccctgtgatatttaaaccccgtatggcaccttagtatgaggctttttaatagatatcccatattcctaacgtt

SEQ ID NO: 565389 - DNA, 1130 bp, Homo sapiens
ggaagatgccggcgccatggctggagaaggaggaggctggcggcaggaattagcgaggaggaggcggctacaggtatgaccggtcagatccgcctgtggggactggaggcccagaaacgggtgcaggcctctcggcgatgcttctatgctgggactttgaaacggactctgcgcgtgctgaaattgccaagaatctcatctctggcaggagtgaaaggactgaccatgctggaatcacgaagcagggtaactccagaagatcccggagcatcagttctatgagttcgtactggagtcatgttggaccgacatatagggctgaaggcctctttggagccgagctcagaatctcaaccccaatggtggatgtgaaggctggacactgaggatactagagaagaaagcagagtcatattcacactcagattcgatgctgtgtgtctgacttgctgtatccagggatgtcatacgttaagagttgaccagatctagtcacatacagatagcatcaaagtatctatatacagtgagatgtttgtggctaccatggatacacatttgccaatctaggagagcatgagtttgtagaggagaaaactagaagttgccaaggtagcaaggagtagaagatggtgccgacacaagagagcaaaatgattcttctgagacaagagggtcagaataaggtggtctactgccctgttaaagatgcctgggaggtgacgtggagcaagtgagaaagcacagctgcctgaggggcacaacttccgactagattctccttacaagtaatgcttctccgaaatgccccagttttcacagagataggaaggaaattaggacacgcaaatgggtaatggcacacttatacgggaaactcttcaaaaagaaattgctttctacttaataggacattaagggaccaggctattgtgtaggctatagcccacagagtaacataagtagtgtagcacacacagattacaagtacacgctgcacactaaactgatcgaattacataaaaggatgcgaagagaaagaaattcgaacgcaataactatacacagacaaacgagtatgttctacatacatggtgaggagttaaatagaagtatagactgattaataa

SEQ ID NO: 565390 - DNA, 216 bp, Homo sapiens
ggggatttttttttttccccttttaagatttaaaggtctcccccgcgtcccccaacaccccaaagatccttccttttggggggggttttgttttcccaaaaaaattcccaaaccaaatggggcaaagtctttttttttccccggggaaccaagggaaaaaaaaaccgtttgtgtttttccggtttccctgaaaaaaaaaaggttgttttggttcca

SEQ ID NO: 565391 - DNA, 500 bp, Homo sapiens
  misc_feature (238)..(238): n is a, c, g, or t
  misc_feature (243)..(243): n is a, c, g, or t
  misc_feature (370)..(371): n is a, c, g, or t
ttgagcgcaataaaggtcaggatgatgtactccagagacatggcgtaaacgcctgaagtgcaaaaataacgacgctaatcacgttaataatcacccacaacagccagttttccacatacttacgcgtcatcagaatcattgccacgatagataacaccatcatgcatgaatcccagaacgggaaagcgtccggttgcagttcaggcatcacaacctgtaatcctaatgcttgcatgancatgnctgccacgggggtcaaaaatgcaaacaccggattgataaataccgtcatcagaccaatcgaaacaacgcaaaccgccaaccagctgagtgccttcggcaatggcaaccagcgaatttcaactccgcnngttctgactggtttgtcgcgaccacgcataccaaccgtaaatattcgcggcaaagaaaacacctgtaatagcaggctggcatacagctgaatctgaagaaatatgccaacaaggtgacgttgatcaggc

SEQ ID NO: 565392 - DNA, 672 bp, Homo sapiens
agcggacgttgcggccaccgagcagccggctctcagcacatccccctttcgcacctgtctcctgttccattcgccttcctctatctttcctggcccacgccgctccgaggcctcgcgaacgccgagcctgcagacctgcccccgcggacaacagtgagcttcttgtatggtagtcgctcttctaaaacttttaacaccaaagaagaacattccagagggttctcaccagtatgagctcttaaaaacacgcagaagccacacattggcagatggcaaccattcggatggctgtcatgcctttccctgaaggggaagcatctcacatgaactgggttgcaaggtaaacactgtggattttcacttccaatcgagatcaacatgctattatggaacctattcacagactatcctggtacagcaaggaccaggttgtcccagtggattgtacaggatgggccccacacatactgagataatcactgggggcacgtaatgtgacaaccgaacacccttcacacggagcacccctacattaaagcgtgacttcgtggaacccaaagaagctaatattagaatttacgttaggaacggaccttaggggttcaagggaaccaggttgggatgactgaagacgttagttagcccatcgaacaacattggggtcccgatccc

SEQ ID NO: 565393 - DNA, 113 bp, Homo sapiens
ttcttttccccttctttaagggttactgatcacattcatataaagttcaaacatcttagcctatgagggtccctcctccccaaactctgctgtgcgatctggcccctgtgcca

SEQ ID NO: 565394 - DNA, 782 bp, Homo sapiens
ccacgcgtcgggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactaccatctcaaaaaaaaaaaaagagaggaaaaaaaaattggtctggcctatcctggaagattggccctggttggtgagagggaagcccaaggcaggtcactgtgggacaggtggcctggaccaggccccaggttttcaaggccatccaaggcccagtcaccaaacttggagagagaaagaagccttcagggtggattctgggactccattaccttttggattggataccggatggatacaatcccaggtggagaacctggccccataaatccagaaaaccacttggctatctaaagagtccctaagttgggggcttattggtcccacagcaacgggtaccggggaacagaggggcacagccggatgaaggggccacacagactcagcccatacatacccgggtctaaggtgcccaggggagcccgggaaccacacctgggggagcctacgggaacctaaggtcccacgtggcacagttctacgacggggctataagacca

SEQ ID NO: 565395 - DNA, 110 bp, Homo sapiens
tcattggaccctttttgtgacgattggtctctgtggtgtgattctcttcccaggtgtacctttctacctacccctagtgtccttaaagtcctcctaccacagggatcata

SEQ ID NO: 565396 - DNA, 213 bp, Homo sapiens
ccggacagaatacactcaaacatcagcgtaagtaaacctgactggttcgggggattcttggtcttgctgcatttcttgccctttttcaggctgctgtacactggccgtcgtcaaagacgcacctcacaaatccgggtttctttcacaagtgcggcactctagggttgtcatatggtaactcgttgtggagataccatgtcccacagtgtcttt

SEQ ID NO: 565397 - DNA, 794 bp, Homo sapiens
  misc_feature (86)..(87): n is a, c, g, or t
  misc_feature (97)..(97): n is a, c, g, or t
  misc_feature (117)..(119): n is a, c, g, or t
  misc_feature (125)..(125): n is a, c, g, or t
  misc_feature (164)..(164): n is a, c, g, or t
  misc_feature (176)..(176): n is a, c, g, or t
  misc_feature (206)..(206): n is a, c, g, or t
  misc_feature (244)..(244): n is a, c, g, or t
ctctgaattccatagtacggagcgcgcattggttggtatcgggaattcggcattatggccgggcataatggaattctgaagaaatnntggggagggnaggggagttggaacaaatgnnngttccntggaggccagtccagtgctcagacctttagactcattgnaagttgccactnccaacatgagaccaaagtgtgtgactagtnaatgaagtgcgacagcattaaagactgatgctaaaccncaaaaaaaaaaaaataaaataatattgtaacataattaaaaaatcattaatccgattagtggtctcatgtcttaagtttcgatccacctaagatactccatcttacataatcctcccttttaaattatgtattataatccttccttttcattaatagtctcccattcatttctttaatctgacagttgcctatctgatctaatatttgaaagtcactctctactagttcctcgtattctatttctcgttttaatctgcttagctttactcttcattctattctaatttttctcattcatctctatctatttcaaccttctataatctgctaaatctctcgatttcttcttccacttcttctttatataatttttcaccaattgttatgtctgttaactccttcttctttcgcatacttcttacatggttatatcgtctatggcttctttactcacttctcttactctattctctagcacagtctctctactcttgctacctcgacaatctcattatacactttttataatttttatttctcttggccctt

SEQ ID NO: 565398 - DNA, 803 bp, Homo sapiens
cttcctgctaagcctaatccaagccttacccagctgtgctactgtcatttgcaaacgcaaggaaatactactactggtactaaaactacacatgcaagatgtcacgctacgaacatatgtgtttatattttaccttcctgcgatgtggggtaggtgcttgaacgctacacatgtgctgtttctagtttcttaaatagcccacacccctggatgcaaacaaggcagggttatttttttacccatgagcatcctgtgcaggcaatagacttccctcatgtcatccgctgcagggaggagaaatgtaccccaattgcacctgagcattcctggtcccctcagccaagaacctcagggtggtccccagaacaagccttgtggtgggggacccctgtgcttgatgcaggtgtatggaggcctttttgccttaccctgtggggaaggaaccattgtaccccaagttatccttcccctggcctttactgggacccagatggtcctcctttacatagacttgtcacaccaggaaacgtgcacgacccctatgtctcccgcaccatttcaaccactttctggaaatcccaacttccccagacttgcaacgggaagaatagaatattcttggagcatcattgcacccagcgcatactcgtcgcatattcgaacgcgccaacaaggttgagataacaaatgaagtaaacctgtcattagagcgtgtaataaccagttacacaacgagggtcatctaacggtcgcaactgattacaatccaaaccaaggttccctggcatcataaacaacagaat

SEQ ID NO: 565399 - DNA, 200 bp, Homo sapiens
gattagaggatctggcagctatcggtcatgtactaaagctaccacactgacagcatctagaatgtactgagcctgtgcagccatgacacctctgtcatctcagcctcactgttccttggaacaccccactgtagctagattcaagaggagaggaattttgcagagaggggcccgggggggccccccccacaaaagggggg

SEQ ID NO: 565400 - DNA, 1045 bp, Homo sapiens
  misc_feature (50)..(50): n is a, c, g, or t
  misc_feature (80)..(80): n is a, c, g, or t
  misc_feature (147)..(147): n is a, c, g, or t
  misc_feature (297)..(297): n is a, c, g, or t
  misc_feature (337)..(338): n is a, c, g, or t
  misc_feature (348)..(348): n is a, c, g, or t
  misc_feature (368)..(370): n is a, c, g, or t
  misc_feature (376)..(376): n is a, c, g, or t
  misc_feature (415)..(415): n is a, c, g, or t
  misc_feature (427)..(427): n is a, c, g, or t
  misc_feature (457)..(457): n is a, c, g, or t
  misc_feature (495)..(495): n is a, c, g, or t
accgcctcagcaggggcctcctgacctctggctccgtgaagcgaatgccnccacgtgggtcacactcccattctgtaagncatcttggcacactggggcttaccgtgccccagtaatggtttcatggactatggactctttcaaggnatctgatccttttgaattttgcacgcccagatacatcccttttgataaagggtctttgcttctgattacaggagcactgtggaacgtctgtaatatgtttttatattcctgtatagttggtgtacactcaaaactgtccccggcagccantgctctctgtatagggccataatggaattctgaagaaatnntggggagggnaggggagttggaacaaatgnnngttccntggaggccagtccagtgctcagacctttagactcattgnaagttgccactnccaacatgagaccaaagtgtgtgactagtnaatgaagtgcgacagcattaaagactgatgctaaaccncaaaaaaaaaaaaataaaataatattgtaacataattaaaaaatcattaatccgattagtggtctcatgtcttaagtttcgatccacctaagatactccatcttacataatcctcccttttaaattatgtattataatccttccttttcattaatagtctcccattcatttctttaatctgacagttgcctatctgatctaatatttgaaagtcactctctactagttcctcgtattctatttctcgttttaatctgcttagctttactcttcattctattctaatttttctcattcatctctatctatttcaaccttctataatctgctaaatctctcgatttcttcttccacttcttctttatataatttttcaccaattgttatgtctgttaactccttcttctttcgcatacttcttacatggttatatcgtctatggcttctttactcacttctcttactctattctctagcacagtctctctactcttgctacctcgacaatctcattatacactttttataatttttatttctcttggccctt

SEQ ID NO: 565401 - DNA, 236 bp, Homo sapiens
gccgacctctctggaagattgatgagcatgattgaagcacgtggagcacaggtcagcgtgggaagagggttatggtggacatgggggtggggttgtctccccgacctcctcacattatgcctacaagaactcagacactagtgcaggttgcctttgcagaaacaaagtcagggttcttcaagtctcaaagggaagggcaggatcaaatcttgcctctcagttccatacaaggcagt

SEQ ID NO: 565402 - DNA, 1510 bp, Homo sapiens
ccagctaactctacccggtatgtcacatgcgccactcgctgtcgtcactgtatgtcatgggttcgactggcatatcgtggcatcctgtcgatcagtgtgctgtgggaatcttcactcgttggatcgccgataggttcgctatttactacatctaacttatgtttgagatcgatgtcttggactgcttatacctccgtgtgcatagatagtacctcgcgtaaccgaggctgaactatcagtgggaggaaagcctcatacgctcggttacgatgccatgtgctactgccgatagttggtaagcactagtcatgtagactcatacagcttggcatagtcatgtccttgaagatcgaccaagagatatctagcggcgcgtgactggtcagactgtggttaatattcaaatatactaggtctcgagactgagtttccaagcttagtctgttagagttgtgtctgggtcatgccatatacgcagccaggcctgagactcgaccttgtcccgttctgtgtcacaagacctctcgtgtgtaagtagctctgctggtagatacgatacttgctagcacataggttgctggctaattcgcacaggatctgtgtggcgcatacccagctcccctataacattgtcgctattgattagctgagatatatcctttccttgtgctctagcggcggtacctagatcgataaattgagccgatggaccccagcatattgccctctatgtggttaccgctatagctcggtcccaacgttgattttcgcaaaatatacacccaatctaggttttacatttacctgcaagggttgcacttgcccccttatattgatttcgaaacgtccttagtctggagacaaaaactgttttttactcaaaggcaaattccgccgccagattcagcgccttagaccattgtccactaaacggtggttaattgggcctatggcgacagggcacactaacttattcggttaaaccttggaccaggattgtgtcctatggttacaagacttccattgtccggtcttttacctaagggtctttagagagccgagtaatgttcagtgccgagagggcctaatgtggtgcctccctcttcggtgtaccaattccttggccgcctcggtatgagtgcaaacgtgcgtttccaagttagagccattaaagaggccccagttgcctaattaggtccctgttttgcctacaactaggtcaagagcctctgtcgtgtggcgcgagtagcggaacagccggagcggttctgtggcagaaggttagggacgtcacggtgtgggccattacagagtgttggcctaggactttaatttggccgggcgggcgcaaatttcttggcgcccctttggttatatcaccagttgcccggttttggggcttgcgcagttaaacccgcggcaggactagagcggttgtcgctggcctcctatcccttggtgtgcccattccagggccccggggggttggaactttgtcgtttccacagtc

SEQ ID NO: 565403 - DNA, 180 bp, Homo sapiens
gaattgctggacggtcactcgacctgtagagtttgtgcatttggatttgctgaatgtataccccagtggtgaggtataacatgttcctctggaacaggaattaaaagaaattcaagaacgtgtaagcagaaactcagttgtatgtgagaaaacccaatttctcatccttgggcaggggtc

SEQ ID NO: 565404 - DNA, 371 bp, Homo sapiens
tttgtacctttagataactagcttaccgtggtgtggacgggtagagaatgagggagacggagagactttggagtcagactgagtagttttaatctgggctccatcacttactagctgtgtggcgttgggggagtaaataagcctctctgagcttcagtttcctcatttatagattaataatagcaacaatactcagctcataaccactcaggttgtttgtgaagttcaaataaggtaatgcttataaaactgagaggccaggtgcggtgctcatgcctataatcccagcactttgggaggctgaggcgggcgggtcacgaggtcaagagattaagaccatctggctaacacggtgaaaccccgtctctact

SEQ ID NO: 565405 - DNA, 523 bp, Homo sapiens
  misc_feature (168)..(168): n is a, c, g, or t
  misc_feature (423)..(423): n is a, c, g, or t
  misc_feature (425)..(425): n is a, c, g, or t
  misc_feature (428)..(428): n is a, c, g, or t
  misc_feature (441)..(441): n is a, c, g, or t
catcacgtggtaaagcgatgtaaacacttgcagactggtttttgtgagagtgtttattggataaacactcaggcgtggggttgctgggccataggtacagtccttactttgttagaaactcaccacacgctgttttccacacccttcgcgccatgtcacatccccacnggcactggatgagatttccaggtgctgcagtcaggccagcgtgtggggtggagtttgctgtttttagtgtgtcggttggtgtgcagtgttggcacacggtgttggtgtccagtgttgacacacggtattggggtttgctgttttaagtgtgtccagctggtgtgcaatggtggcacagggtgtaggtggggtttgctattttcagcgtgtccggctggtgtgcagtgttggcccacggtgttggtggggttggcngnttnaaccgtgtctggntggtgtgcagtgttgtcacacagggttgggggggttggcggtataaagcgtatccggctgttgtgcagtgttgtcacacagg

SEQ ID NO: 565406 - DNA, 1227 bp, Homo sapiens
cccataggaaatgacccgcagtgctcagcagtaacccctgactgcgcgcagatctcagaatcctccacctcaatctacagccacgtgccagcaataagaagacagagtttcagggccaggcgcggtggctcacgcctggtaagtctcagatactttggagagagccaaggatgggaggatcacttgaagttcagtgaggttcgatgaactcagacctgcccaagcgatggtgaagccccgtctctaataaaaagaatacaaaaattagccgggatgtggtggtgcacatctgtaatcccagctacatgagaggctgacataggagaattgcttgagcccaggaggtggacgttgcatgtgatgccgaagattgcaccactgcattccagcctaggtgccagagtgagacttggtctcaaaacaaaacaaagacaaaacaattagccaggcatggtggcacatacctgtagtcccagactacttggggggctgaggcaggaggatcgcttgaagcccgggtgtctaaggctgcagtgaactgagatcaggccacagcatctcaacctgggagacagagtgagaccctgtctcagacataactcgaaaggccagagctaggtactcacacgggtgcatatgttataccaaccacattcacaacttccaaggtatccaaaacggtgtttaagtccaatagtagtccagggtgagccaatcccttaacgggcagctcaagacctatgtaaccaaaggtccgtgtgtacccataccaatcaccgccgaaatgcacggagcacgggcgcacgcgtacattccacggggcgtgcaacgttcacttccacgtagctacccttagacacaaccaccacaaacagggggcgcggcagaaaaagacaccaccaagggggccaaggccagcgcaacccgctctgtgtaccaagggagccccaagaaggacggcagaacaaaccccaccgcacacgccagcggaaaaacaacggggcggacgaacaccgaccccagacgacacgagccagcccccaacctacgcgcagccaaagcgtgcacccacacagcgaccaccacagcgaacaccagcacagcacaggccgaaccagccgctgcgcaagcgcagcgcagaacagccctcactatgactgcgacaccgaaaccagcacaaagcgcgaaccagaaccgaagagcgcgacgaaagcaaggccagcgaaa

SEQ ID NO: 565407 - DNA, 914 bp, Homo sapiens
  misc_feature (1)..(1): n is a, c, g, or t
ncgccgggggtggatggcgagggacagctaggttatacagttggattacttgggagtgtgtgaggccacctactaagaatacttgggcaatagagattgacaaattaaacccataagccaggtagacgaggagcaaggaaatgtctgggaattcgtatttcatcggcatatattgaagacatcttatgcttctaattgccgggtgagtcaacctctgcggactgaagcatcactaaaagctctaaggagaacgtcggtctttttaatcctctgaataggaatcgattacatttaaaaactgcccgtggtgtcgtaccgcgtcggtaacagagggtagacaaacagcgagtctaagggaaagaggtgcccctgcctccccaggcagacagggcccaggcccggtaacggagtcgtgccctctttatgcccaaagccgcggacgggatgcgaggtcgaggaccggcgcgcggggcggagcggggatgcaggtaacagggcccgcgcgatcattccaccggctacggacagccgacaaagaccccagaggcagtgtccacgacagcggggtcctggatggctgtggcctcgggtcgtccggggcttctcggtgcgcccgccccgaccccgtttctgactcagcatcccaggctcccacaggggcgggagcgctccccgccgtggcggggcagtgctgacgatcgggcccgagccgcttggaccctcagccgggggtctcacttagccagccgggtgctccgcggccacggcgggggctcccggggctcctcgaaatcaggacacttccggtttcgaagcctggcggaggctaggaccgagggggggcgcgtggggggtggcgggggcttaggccgctggagtacacagcgggggatgcggtggttcgggccgagggg

SEQ ID NO: 565408 - DNA, 258 bp, Homo sapiens
cggcaccgctctcgtgagactgatgagagtctctagttccatcaggttgctgcacatggcattattttgttctttttatggccgagtagtattccattgtgtatatataccacttcctcctagtccaatcgcctttcaatggacatttgggttgtttccatgtcttggctattgtgaatagagctgcaatgaacatgcgggtgcatgtgtcttttttaaggaaaggtttgtccagatatgcacccaagagtgggattg

SEQ ID NO: 565409 - DNA, 459 bp, Homo sapiens
aattgtcgctcttgtcccccaggctggagtgttatggcgctatctcggctcactgcaacctccaccttccgggttcaagcaattctcctgcctcagtctcccgagtagctgggattataggcacctgccaccacacctggctgatttttgtatttttagtagagacagggtttcaccatattggccaggctggtctcgaactcctgagctcaggtgatccacctgcctcggcctcccaaaatcctgggattacaggtgtgagccaccgtgactggcctgtttcattaatttttatacaatcctctgacctcccagcctctctctctcccataggactgactatagaaaggacttatctctgtccaggcatcatgatgtgataagagaaacacacagtagcatctagaaaaatgctgaaataaattttcacatagctaatatcctgtgattttgtgcaag

SEQ ID NO: 565410 - DNA, 134 bp, Homo sapiens
caaagtggtggactgttccaggccctccagtggggtgatgttgggacccttaggatggggctcccagctcctttttcctgtgaatggaggcaaagacctccaataaagggccttttgggctttttttaccctta

SEQ ID NO: 565411 - DNA, 147 bp, Homo sapiens
acgagatgctagaggcctctgctcgagagcatcagggtcagcacatgagagatctgctggaaatgccagcagcctcctgacagtcatggcgaccgacaggttagagaaggaggtccacaaacgaccaaggacaaacatttgcgcaca

SEQ ID NO: 565412 - DNA, 449 bp, Homo sapiens
aagtcaagggttataacaaaaaagccccagcccattcctcccattcaagattcccactccccaaaggtgaccactttcaacttttgagtttttcagggataaacccccatgtttttaagtaaaaagcttaaattgttcccttcttttttttttattttttaaagaaatctatttcataccatggaggaaggctctgttccacaaatatttcccctttttcattctctcgggatagttttgtcccaattatagattagatccaaagtttacataactaatacagctgagctatgtagtatgctatggattaaatttacttatggaacttttattgtttttggcattaacagtgtttcaaaaaattttttgggtaaacccatcagtgattcattcccaaattttttaaaagcataagggtctcaatatattaaaacatattgaataatcca

SEQ ID NO: 565413 - DNA, 924 bp, Homo sapiens
  misc_feature (18)..(18): n is a, c, g, or t
  misc_feature (25)..(25): n is a, c, g, or t
  misc_feature (30)..(30): n is a, c, g, or t
  misc_feature (32)..(32): n is a, c, g, or t
  misc_feature (77)..(77): n is a, c, g, or t
gttggcgagttttccttnactgtgnaaagnanagcatgcttgaattacttcaagttttttggaaagaacacctgggnaaattcatcgcaaaaagacatcacctaggcacatcgtcgtcaggttatccaaagttaagatgaaggaaagaatcttaagagctgtgagacagaagcaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggtgcttagctatttattttgttatctattgttgttgctcaaactgttcaagctttggccattgggagctctttcacattggctcttgtgtacttttggcatgccctcatccactttgtttggagcacttcctctttctggcaccacaggatgctccaggctcatctatgtgttttcttctctgcattggccctagacttagtcatttctcctaggagccctggttctttttttttttttttttttgatgaatggccttagaaaccaagatcttggtgatgggtgtgctcattgctactgtgatgacactgcttctacacattctaaatgaacagaactaggaaatatatgtatggtgtactaccacatggttatacatagtcctaattatgttcctatatgcatatttattaaactaaacattagttcactgacattacaaaagtctgatgattattgatgtgaagaaataaaaataccccctaatctcccaatcttctatgattgggttatgtgtaacaaacacaaagggcttcttaaaacacaattaaacaaaattaaagtcatactaattctttgacttgaatccggac

SEQ ID NO: 565414 - DNA, 671 bp, Homo sapiens
  misc_feature (297)..(297): n is a, c, g, or t
  misc_feature (438)..(438): n is a, c, g, or t
  misc_feature (449)..(449): n is a, c, g, or t
  misc_feature (451)..(451): n is a, c, g, or t
  misc_feature (456)..(456): n is a, c, g, or t
  misc_feature (462)..(462): n is a, c, g, or t
  misc_feature (518)..(519): n is a, c, g, or t
  misc_feature (526)..(526): n is a, c, g, or t
  misc_feature (531)..(531): n is a, c, g, or t
  misc_feature (533)..(533): n is a, c, g, or t
  misc_feature (614)..(614): n is a, c, g, or t
  misc_feature (620)..(620): n is a, c, g, or t
  misc_feature (643)..(643): n is a, c, g, or t
  misc_feature (671)..(671): n is a, c, g, or t
aaggctagagagactgtgtaatcggacgaggcaggagcgcacgcgcggggaggccgggcattgctgcgtcacagcgcgccggctcaccacccttcgttgcacgcacgcacgtcattctccgtcctcgcgcccctatttcctacactttcctcttctccccgaaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtngactccctagcagcagccagacgccatgagatggccacggacacacacagataacgacacgatccacacactggacacacggttacacaagtgcatgcctggcatatctggcaaaagtggtacgatcgaagggactatgtnttcattgaatntngtgtngaaganagtaaggatgtaaatgtaaattttgaaaaatccaaacttacattcagttgtctcgnnaggaatngaaananttaagcatttaaatgaaattgatctttttcactgtattgatccaaatgattccaagcataaaagaacggacagatcaattntatgtngtttacgaaaaggagaatctggncagtaatggcaaggttaacaaaagaaan

SEQ ID NO: 565415 - DNA, 262 bp, Homo sapiens
catctagatacttataactattgtaaattaatttaaagacgaagaaacgaaagctcggccgcaacggtttttattttttatttttttgagatggagtctcgctctgtcgcccaggctggagtgcagtggcgcaatctcggttcactgcaagctgcgcctcccaggttcacgccattctcctgcctcagcctcccgagtagctggtactacaggcgcccgccaccacgcccggctaatttttagtatttttttaagtagagat

SEQ ID NO: 565416 - DNA, 645 bp, Homo sapiens
  misc_feature (297)..(297): n is a, c, g, or t
  misc_feature (320)..(320): n is a, c, g, or t
  misc_feature (329)..(329): n is a, c, g, or t
  misc_feature (344)..(346): n is a, c, g, or t
  misc_feature (351)..(352): n is a, c, g, or t
  misc_feature (357)..(358): n is a, c, g, or t
  misc_feature (360)..(360): n is a, c, g, or t
  misc_feature (364)..(364): n is a, c, g, or t
  misc_feature (371)..(371): n is a, c, g, or t
  misc_feature (374)..(375): n is a, c, g, or t
  misc_feature (378)..(378): n is a, c, g, or t
  misc_feature (384)..(384): n is a, c, g, or t
  misc_feature (412)..(412): n is a, c, g, or t
  misc_feature (423)..(423): n is a, c, g, or t
  misc_feature (425)..(425): n is a, c, g, or t
  misc_feature (430)..(430): n is a, c, g, or t
  misc_feature (436)..(436): n is a, c, g, or t
  misc_feature (492)..(493): n is a, c, g, or t
  misc_feature (500)..(500): n is a, c, g, or t
  misc_feature (505)..(505): n is a, c, g, or t
  misc_feature (507)..(507): n is a, c, g, or t
  misc_feature (588)..(588): n is a, c, g, or t
  misc_feature (594)..(594): n is a, c, g, or t
  misc_feature (617)..(617): n is a, c, g, or t
  misc_feature (645)..(645): n is a, c, g, or t
aaggctagagagactgtgtaatcggacgaggcaggagcgcacgcgcggggaggccgggcattgctgcgtcacagcgcgccggctcaccacccttcgttgcacgcacgcacgtcattctccgtcctcgcgcccctatttcctacactttcctcttctccccgaaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtngactccctagcagcagccgccgncagaaaggnccgcccaccagttcnnncgtgnncctgnncngttnacaaagnagnntgnttctgnaaagtggtacgatcgaagggactatgtnttcattgaatntngtgtngaaganagtaaggatgtaaatgtaaattttgaaaaatccaaacttacattcagttgtctcgnnaggaatngaaananttaagcatttaaatgaaattgatctttttcactgtattgatccaaatgattccaagcataaaagaacggacagatcaattntatgtngtttacgaaaaggagaatctggncagtaatggcaaggttaacaaaagaaan

SEQ ID NO: 565417 - DNA, 533 bp, Homo sapiens
ccttgttacggccccggggtatcgggatctggagagccgcccaccgtctctgaccgctcgactcctccgcccgggccgtcggccggtccagccgcggtcggcgcctggctgtgaggtggattcccgggccagtctgaccatctccctccagtttttccacttcgttcggaccttctcataactatgtccacccatctacgtcgtcccctcacgccagatgaccttccccgagaccgtccgaagccctcatagccgctacgcgtaatggggaggcatggggagggtcccggatggggcaggagcctaacgaaccgcgatgttagactcacagaacaaagcaacggagcgaatgaaccagacaaccagaacatcaagacaaaaaacaagccatgatccgagacaccacggacgacacagaggaacaactagagacaacatcgacacaaaaagagagggacaaaggaccagagaaacagagacagacgcaaagaacaaacaaaacaacagaaagacaagtaaaaggaaaacaagag

SEQ ID NO: 565418 - DNA, 949 bp, Homo sapiens
  misc_feature (544)..(545): n is a, c, g, or t
ctgaaagctgagcgttgaacggtggtatcaccattgatatctccatgtggaaatgagagaccagcgaagtactatgtgactatcattgatgccccaggacacagagactttatcaagaaacatgattacagggagcatctcaggctgactgtgctagtcctgattgttgcatgctggtgtgggtgaattgcgaagctggtatctcgcagagaatgggcagacccgtagagcagtgcccttcgtggcttacacactgggtgtgaaacaactaatggtcggtgttaacaaaatggattccactgagccaccctagcagtcagaagagatatgatggacaatcgttcaaggaagtgcagcaacttacattaagaagaattggctacaagcccgacacagtacgcatgtgatgccaagtttactgggatttggcaactgcgtgatcaaccagtgtctaggaatgcctataggatgctagagcaattgccgtttgcgtgtgcagaagggattgcgacaaatgtctagcgcgcgtaaccggagtgcgcannatgcgcggctgagatacccaacgcttgcgttgatggcatctggacgtgcgatctctaactaaccaagctgccgttccaactgagcaagtccctgtgcgcctgcctctccaggatgtctacaaagttggtggtataggtactgtaccgtgttgggcgagtggagacttggtgttctcaaagccggatatggtgggtcaccttttgctccagtcaacgttacaacgggatgtaacaaatctgtcgaaatgcaaccatgaagcttgagtggaagctcttcctgggggaccaatgtgggccttcaaaggtccaagaatgtgtctggtcaagggactggtacgacgtcgggcaacgtctgcttggtgaccaggcaaaaatggaacccagcaagtgggacagccaggtgg

SEQ ID NO: 565419 - DNA, 246 bp, Homo sapiens
agagagctgctcaatcatctgatgctacgcatctggactcccctactgttgagcgcatttcaattatagatagcgttcagctgactggttggaagtcactctaaagatgagtcactgttgtctgtctctctccagatcttttgggcagtacatctgtggcccttaagaagctctctcttaattcccatgaggcatccaggtggtctgggctatgggaaagaaccttcaacttgggagtagaccagg

SEQ ID NO: 565420 - DNA, 101 bp, Homo sapiens
agatcagctcggtacctcatagctgaagttgctgaatgatcctcctgttgctataacccactggcctccctgagcatgtcattgacagtgaggtcccaccc

SEQ ID NO: 565421 - DNA, 219 bp, Homo sapiens
  misc_feature (7)..(7): n is a, c, g, or t
  misc_feature (17)..(17): n is a, c, g, or t
  misc_feature (86)..(86): n is a, c, g, or t
  misc_feature (119)..(119): n is a, c, g, or t
  misc_feature (151)..(151): n is a, c, g, or t
  misc_feature (158)..(158): n is a, c, g, or t
  misc_feature (187)..(187): n is a, c, g, or t
aaccttnaaagataaanaccaaacttatcaccctctcatcccaaactgctcttctttgagagtttcccaaagaatcatctgttaantccttcttctcccctaactcttcacatgtaaanacccagccaccaagttcagttgatatcccccnggaaaantgatttattcttggcctgtctttgctaanctcctaatcaaggcagtttcttaaatttccgt

SEQ ID NO: 565422 - DNA, 336 bp, Homo sapiens
  misc_feature (239)..(239): n is a, c, g, or t
  misc_feature (272)..(272): n is a, c, g, or t
  misc_feature (284)..(284): n is a, c, g, or t
  misc_feature (320)..(320): n is a, c, g, or t
  misc_feature (328)..(328): n is a, c, g, or t
tctgtgaccttatgctccacactaactctggcagagctcccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaaggggatttcaccttttgacctcttacaggggcnttgggtttccgttggcccccagccaggaacatnttttttttcccntgttgaggcattttccatggaggctgggggcattgntttttccntggggggg

SEQ ID NO: 565423 - DNA, 150 bp, Homo sapiens
ggcagtccaccactactggccatctgatctataaatgcggtggctcgacaaaagaaccatgaaaataagagaagagcgctgagatggcaaggcctgtcagtatgcctgggcttggataactgaagctagcgtaacgtgttcccttgaatc

SEQ ID NO: 565424 - DNA, 528 bp, Homo sapiens
  misc_feature (32)..(32): n is a, c, g, or t
  misc_feature (34)..(34): n is a, c, g, or t
  misc_feature (144)..(144): n is a, c, g, or t
  misc_feature (169)..(169): n is a, c, g, or t
  misc_feature (224)..(224): n is a, c, g, or t
  misc_feature (316)..(316): n is a, c, g, or t
tcatacagcgtcagggcagtgcgggtaaggtnangttagatgactggtgatatctcaagccgtgatggggagcgcgacaggaaaagacgagtagtgttggaaagggttaggaaataatggaaaggggaatcagtgattggacangaggggtgatgacagcgggcactgnaaagttctcccactgacaggcaggagagaagcagtggggagacactgacaggtgnggtcactaacagcagggcagggtactaatgggtccctaacagataagggatgaaggaggtagcatgaaaggggacaggaactgacaacaggngagaactgatggggaggatctgacaggcactaacacagaggccgatagcaaagagcggaagggccacaacaggcaggatgagggagacacttatgagggaaacttactgacagtggggctcactgacagaggcactggcactgatggggggcactgacagagaagatcaatgacaggtggggacattgctgacagaaggggtcacagagcgc

SEQ ID NO: 565425 - DNA, 1135 bp, Homo sapiens
  misc_feature (6)..(6): n is a, c, g, or t
  misc_feature (13)..(13): n is a, c, g, or t
  misc_feature (39)..(40): n is a, c, g, or t
  misc_feature (77)..(77): n is a, c, g, or t
  misc_feature (150)..(150): n is a, c, g, or t
  misc_feature (1095)..(1095): n is a, c, g, or t
ccctantgggaangctgaagcccgcgttggagggagctnncccctccagttcatgtcctggctgcccctggaattcngcactggagaggttgggtgggatgtgcagaacaaacaggacttcctgcttgagcaagtctggacatcagagcnggagatggggactgagaccacaatcagctgtgcaccctgtggtcagggaagaactcactggagtctcatttgactgagaaagcttctttcaaaggaaatgcaactgtcttaagactgcctccccagggatctcattaaacagctgggaaagatcaacctccagagaagagaagagactggaggcagccaccaagcccagactttccccctgttcttctgagggcagctcccggaggttacctgggagacttcgtctgcagccaagacaaccttcactcccacataccctccctggagcacgggactgagcaaccccactcctcctttctgtgaggagggcattcgggcctcagccatctggaccctctgagttcacatttcccaagacctccatgaacacatgtgagtgtaataaatgttctctgcttctctcttgttaacatgtgtttctgctgtaggggtgtcagctgtggccctttttcatggggaacaaagggatcatcctgagcttcctgatgtgtacagaaagcacagagttcaagggggaagattcagaggatcacaggtgaatccggtcatctggaaactcctgtgagcatctccaacagcagagacacacgtagactcctgcaaacccagctcagctgccatcctcccttggcagccaaaggtctcagaaaggcacgtttccaaaacttggttttctcacctataaattggggcaaaccccagtctgtgtctattgggagaattaagtgagatactgcacgtaaactctggcacaatttaaacatcaaaaatggcagctataatttaggctaataatttaatttctttctttgagccaggtgtcttgcctgtaaaatggggatattttgttataaaaaaattaggaagaaaataaactggtggcctcgttggcctcagcggtggagctctgcggcnagcccacactctcccatttttttaaccataactcaactat

SEQ ID NO: 565426 - DNA, 904 bp, Homo sapiens
  misc_feature (1)..(1): n is a, c, g, or t
  misc_feature (36)..(36): n is a, c, g, or t
  misc_feature (67)..(67): n is a, c, g, or t
  misc_feature (84)..(84): n is a, c, g, or t
  misc_feature (864)..(864): n is a, c, g, or t
nttagagcaaccccgaggtacttgaaaatttgttgnagcaaaaaacttcattccaaaaaccctcctngaagcaagggattaacnacacccattcctctttctgtgaggagggcattcgggcctcagccatctggaccctctgagttcacatttcccaagacctccatgaacacatgtgagtgtaataaatgttctctgcttctctcttgttaacatgtgtttctgctgtaggggtgtcagctgtggccctttttcatggggaacaaagggatcatcctgagcttcctgatgtgtacagaaagcacagagttcaagggggaagattcagaggatcacaggtgaatccggtcatctggaaactcctgtgagcatctccaacagcagagacacacgtagactcctgcaaacccagctcagctgccatcctcccttggcagccaaaggtctcagaaaggcacgtttccaaaacttggttttctcacctataaattggggcaaaccccagtctgtgtctattgggagaattaagtgagatactgcacgtaaactctggcacaatttaaacatcaaaaatggcagctataatttaggctaataatttaatttctttctttgagccaggtgtcttgcctgtaaaatggggatattttgttataaaaaaattaggaagaaaataaactgtaattgccctgtgcaaaacatcccacattaattcaatgaattattaataacaaaaagatggaaaaattattttcccatttaggaaaaaatgtgaaataatagcaaacctaggatgcttttataattaatgcaaataataataaaatgtggcctcgttggcctcagcggtggagctctgcggcnagcccacactctcccatttttttaaccataactcaactat

SEQ ID NO: 565427 - DNA, 579 bp, Homo sapiens
  misc_feature (6)..(6): n is a, c, g, or t
  misc_feature (13)..(13): n is a, c, g, or t
  misc_feature (39)..(40): n is a, c, g, or t
  misc_feature (77)..(77): n is a, c, g, or t
  misc_feature (150)..(150): n is a, c, g, or t
ccctantgggaangctgaagcccgcgttggagggagctnncccctccagttcatgtcctggctgcccctggaattcngcactggagaggttgggtgggatgtgcagaacaaacaggacttcctgcttgagcaagtctggacatcagagcnggagatggggactgagaccacaatcagctgtgcaccctgtggtcagggaagaactcactggagtctcatttgactgagaaagcttctttcaaaggaaatgcaactgtcttaagactgcctccccagggatctcattaaacagctgggaaagatcaacctccagagaagagaagagactggaggcagccaccaagcccagactttccccctgttcttctgagggcagctcccggaggttacctgggagacttcgtctgcagccaagacaaccttcactcccacataccctccctggagcacgggactgagcaaccccactcctcctttctgtgaggagggcattcgggcctcagccatctggaccctctgagttcacatttcccaagacctccatgaacacatgtgagtgtaataaatgttctctgcttc

SEQ ID NO: 565428 - DNA, 403 bp, Homo sapiens
gggctcaaccccccgctgtgctctgcggttcgcagctgcagccgcttcggtgctccaagaccagagaggaagcaaagacagagctttcccagccaggcatcgctgctttggccttgaaggtgacaaagaagacaaggaagacaaggaaggtgatccgggaggctggagagcttgtcaaggtcacagacccacggttttccgccccctagggtccaagctctttcctggacatctgcaggcaatgtcgacacgccctccagtgtctgtggcgggcaaaggatgtgtctccacccccagaccttccgatcctgtgctgaaagtgtccctcagcctgtttcctgagaagcccaggggcttttggcttgttactttttctttctcttgaagtaaacagaataaaaga

SEQ ID NO: 565429 - DNA, 136 bp, Homo sapiens
gtctatctataatcgcccacggacttacatacctacattactattactgactagcaaactcaaactacgaacgcgactcacagtcgcatcataatacctctactcaaggacttcaaacatactactacccacataa

SEQ ID NO: 565430 - DNA, 286 bp, Homo sapiens
  misc_feature (20)..(20): n is a, c, g, or t
  misc_feature (25)..(25): n is a, c, g, or t
  misc_feature (40)..(40): n is a, c, g, or t
  misc_feature (43)..(43): n is a, c, g, or t
  misc_feature (66)..(66): n is a, c, g, or t
catgtagtgcatgacatccngagancaggcaagacatgcntcnagctgtacgactcactatggggncacacccacggttttccgccccctagggtccaagctctttcctggacatctgcaggcaatgtcgacacgccctccagtgtctgtggcgggcaaaggatgtgtctccacccccagaccttccgatcctgtgctgaaagtgtccctcagcctgtttcctgagaagcccaggggcttttggcttgttactttttctttctcttgaagtaaacagaataaaaga

SEQ ID NO: 565431 - DNA, 137 bp, Homo sapiens
ccccgggccccgggggggggttttgggggggggggccccccccccccccttttcccggggcccggggttcctttttttggcccccccccccccccccggcccccttaaaaaaatgggggggttttttttttttttta

SEQ ID NO: 565432 - DNA, 1317 bp, Homo sapiens
  misc_feature (6)..(6): n is a, c, g, or t
  misc_feature (13)..(13): n is a, c, g, or t
  misc_feature (39)..(40): n is a, c, g, or t
  misc_feature (77)..(77): n is a, c, g, or t
  misc_feature (150)..(150): n is a, c, g, or t
  misc_feature (1277)..(1277): n is a, c, g, or t
ccctantgggaangctgaagcccgcgttggagggagctnncccctccagttcatgtcctggctgcccctggaattcngcactggagaggttgggtgggatgtgcagaacaaacaggacttcctgcttgagcaagtctggacatcagagcnggagatggggactgagaccacaatcagctgtgcaccctgtggtcagggaagaactcactggagtctcatttgactgagaaagcttctttcaaaggaaatgcaactgtcttaagactgcctccccagggatctcattaaacagctgggaaagatcaacctccagagaagagaagagactggaggcagccaccaagcccagactttccccctgttcttctgagggcagctcccggaggttacctgggagacttcgtctgcagccaagacaaccttcactcccacataccctccctggagcacgggactgagcaaccccactcctcctttctgtgaggagggcattcgggcctcagccatctggaccctctgagttcacatttcccaagacctccatgaacacatgtgagtgtaataaatgttctctgcttctctcttgttaacatgtgtttctgctgtaggggtgtcagctgtggccctttttcatggggaacaaagggatcatcctgagcttcctgatgtgtacagaaagcacagagttcaagggggaagattcagaggatcacaggtgaatccggtcatctggaaactcctgtgagcatctccaacagcagagacacacgtagactcctgcaaacccagctcagctgccatcctcccttggcagccaaaggtctcagaaaggcacgtttccaaaacttggttttctcacctataaattggggcaaaccccagtctgtgtctattgggagaattaagtgagatactgcacgtaaactctggcacaatttaaacatcaaaaatggcagctataatttaggctaataatttaatttctttctttgagccaggtgtcttgcctgtaaaatggggatattttgttataaaaaaattaggaagaaaataaactgtaattgccctgtgcaaaacatcccacattaattcaatgaattattaataacaaaaagatggaaaaattattttcccatttaggaaaaaatgtgaaataatagcaaacctaggatgcttttataattaatgcaaataataataaaatgtcactattctaccattcaattttagaaataaaaaagtggcctcgttggcctcagcggtggagctctgcggcnagcccacactctcccatttttttaaccataactcaactat

SEQ ID NO: 565433 - DNA, 480 bp, Homo sapiens
  misc_feature (440)..(440): n is a, c, g, or t
gggctcaaccccccgctgtgctctgcggttcgcagctgcagccgcttcggtgctccaagaccagagaggaagcaaagacagagctttcccagccaggcatcgctgctttggccttgaaggtgacaaagaagacaaggaagacaaggaaggtgatccgggaggctggagagcttgtcaaggtcacagacccacggttttccgccccctagggtccaagctctttcctggacatctgcaggcaatgtcgacacgccctccagtgtctgtggcgggcaaaggatgtgtctccacccccagaccttccgatcctgtgctgaaagtgtccctcagcctgtttcctgagaagcccaggggcttttggcttgttactttttctttctcttgaagtaaacagaataaaagagtggcctcgttggcctcagcggtggagctctgcggcnagcccacactctcccatttttttaaccataactcaactat

SEQ ID NO: 565434 - DNA, 442 bp, Homo sapiens
gggctcaaccccccgctgtgctctgcggttcgcagctgcagccgcttcggtgctccaagaccagagaggaagcaaagacagagctttcccagccaggcatcgctgctttggccttgaaggtgacaaagaagacaaggaagacaaggaaggtgatccgggaggctggagagcttgtcaaggtcacagacccacggttttccgccccctagggtccaagctctttcctggacatctgcaggcaatgtcgacacgccctccagtgtctgtggcgggcaaaggatgtgtctccacccccagaccttccgatcctgtgctgaaagtgtccctcagcctgtttcctgagaagcccaggggcttttggcttgttactttttctttctcttgaagtaaacagaataaaagagagttgctcagaaataaaaccctggcctcgttggcctca

SEQ ID NO: 565435 - DNA, 378 bp, Homo sapiens
cggggagatatgggaaccaaataaatgaaatggtttaatttctcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaataaaaaaaaaaaataaaacaaagttaaaacagggggccttatgctaaatagaatttgaataaaattgcataaagatttaatttttagtttttttaaatcgtctgttttaaaagaatttaatggaaaggcatttgaggcatcttgcaaaaggtcctttttgaagaaatgttgtgaaaggaaatgtggacgtggtatttttggattaatttcctgtgaaataatt

SEQ ID NO: 565436 - DNA, 1028 bp, Homo sapiens
  misc_feature (76)..(76): n is a, c, g, or t
  misc_feature (106)..(106): n is a, c, g, or t
  misc_feature (217)..(217): n is a, c, g, or t
  misc_feature (267)..(267): n is a, c, g, or t
  misc_feature (691)..(691): n is a, c, g, or t
gcaactagtcgtgctcactgtagtcgggtcgcgctcgacgagacatccggctcaccgcacttgttatgctctgtanactggacagcacgacgcgtctgttcgtgtngacctgtagcgagctgcgctagtacacgacgcttgatagtgtaggcttgtctagcgctatcatatacgcagctcgcatgcacatgtatgcgtaggcacgcaacggcctctngtgcgtagctgctctactgctgtacatcacgccgaagggtcgtgtcagtngagacagttatgactgcggcgtcttgcgcagacgcgagaactatcatggcagatcggccggtcgtgaataggccctctgtacactactgacagatagtggtgcgctgtgcacgtaaacaagttcacgttggcgaagctacggcgcagcatctagtcttcaatgcattgcgctgctgccacagtgtacctacaccgttactctatccctggatctagatcacgtctgcagaccgcgctcactcgcatctttcttcgacgctatgagaggtatatcactgcagcttctagtcccactagactctcgtgcacttgctcgagatagaacttacgaacgacattgcgactgcgtttcatgcatcttactcctcggtatcaaccatgatcccaagacgatcatgcaccgcttatctcggagtcgatatcngggtacgcacaaagctctcccacagtctactcacgtaccactcgtacatgagcgacctcagtatgctacaatagttggaaatgtacagcgcgcttatcgatcctacgatttacaaccaggacgtggacttattatagccttccatccttaattctacaaatggtatgatcgcgcaacaatccaaagtttctataaagtccagacccctagcacctgctccacattaggttcataccaccttggtatcacgccattcggtacgagattgcaccactcatcaacatggcgggagagcctatgtcggaccaatcacgtctgtccccagttttcaaggctc

SEQ ID NO: 565437 - DNA, 126 bp, Homo sapiens
caccgtcacgattactcaaatactaactgttgctttgaaaaagagtcatggaaactcaggcttggagagacttaaacattccatccaggcacccatgtgatgccttaatcatctctattttgcatt

SEQ ID NO: 565438 - DNA, 129 bp, Homo sapiens
gtccttgtgtgtctcatgtctggggtccatgatagttgccatgcaaccagctcctgaactaccgtaaataatcttgccaaccggggacagctttaggagcaaagaattcggatcgcaacccttgaatac

SEQ ID NO: 565439 - DNA, 247 bp, Homo sapiens
acgaatccactacagctaagaaaattactcccgaaggttacgttttgagggatgaaacggcaaaggagcgcgaaaatgcacttgcgacagctcttctcttcagaacagcaggcttccatctcgcatgtgtggactacagcatctactacagaacttgaagctttccgattgcttcgtggaagacggtccatcaatatcgtagagcacagcagaaaattagggccatttcagaatttagagagtttaa

SEQ ID NO: 565440 - DNA, 483 bp, Homo sapiens
  misc_feature (118)..(118): n is a, c, g, or t
  misc_feature (156)..(156): n is a, c, g, or t
tctctacctcacgctcttccccccctcctaccacaccccaccactacgccacccaacaccattcgggctaggtacgaggccgcgtgtttaccattacccagcctgacaggtgggcatngtggacatccatgcagcacaaccccaatggacccccanccccttggatgcagcaccacaccaccgatgaaccaggcccccaccctcctgggcaccatggccctcctccaatggtacctgggaagtactgcctgtgggctctgggtgtctatcgcctgcatcaaggaaaaggtatgatgccgccaccacctatgggcatgatgccgccgccgccgccgcctcccagtgggcagcccccaccctatccctctgatgctcttgcctcatgggaataacagtaggaggagcctccgccaacgcctcagtgcagcagcagtatggattccagtaaccccttgcaatggcagccaagatcactccccgcgg

SEQ ID NO: 565441 - DNA, 107 bp, Homo sapiens
cagcctgcaagcttgggtttaatttgctcttcttttctaatttcacagggatagaagcttagatcactgatttgagaactttcataattttctattatttcagtgat

SEQ ID NO: 565442 - DNA, 182 bp, Homo sapiens
ttctccctgacaccaatatgaataactcatgtaaggtgtggcaagccacagataaggacttcagacaatccagcatgaggacaagtggtttatacatgaatagcacatggctagtctttcagtgttagcagagtagagagagaacaattaatagtctcagatgggagggaaagatgaaatga

SEQ ID NO: 565443 - DNA, 381 bp, Homo sapiens
gttgcgaccggtgtgaattccctgtgaggggctcaagggttatggctttcatgtctaggtctggcgccagaggagggcgaggcagatcctgggccatgggaggatgacgtggtctgaatctggagtaattaatgccacccaaagaaaaggccctgccaggtccaatgttgtattagatctgatgatgctgatatttacaaaacactgatcgttcgaaagcttgaatctgttcctcctcgaatgaccctgtggatgcctgacctccaccgtacctccgcatcactattcatgtccttttaggaaaatgttcacgtgcctcacgccatatgtgggaagggcgtctttttaaaataataaagtgtgtcaccattagcctttcga

SEQ ID NO: 565444 - DNA, 304 bp, Homo sapiens
tcttgggagctggtgcagaaggctcaagcccactcggccggccctgcttgccccagggcagtgtggtccgggggggcgggctgtggggaaggcccacttacttggcaggggctccgtggtctggccctcgccttggggaccgtgggcggaaaaggtctctgccaccatgcgctccacaggtgtgaggaggaggccgggggtggggccgccctccgccagcttcttgcgcacagcacctcgcaggtcccgccacttgtgcttgaggtcccccaggtcgcgtagttctagatcgcgagcggccgct

SEQ ID NO: 565445 - DNA, 501 bp, Homo sapiens
  misc_feature (33)..(33): n is a, c, g, or t
  misc_feature (77)..(77): n is a, c, g, or t
  misc_feature (102)..(102): n is a, c, g, or t
  misc_feature (308)..(308): n is a, c, g, or t
  misc_feature (316)..(316): n is a, c, g, or t
  misc_feature (325)..(325): n is a, c, g, or t
  misc_feature (329)..(329): n is a, c, g, or t
  misc_feature (335)..(335): n is a, c, g, or t
  misc_feature (346)..(346): n is a, c, g, or t
  misc_feature (348)..(348): n is a, c, g, or t
  misc_feature (395)..(395): n is a, c, g, or t
  misc_feature (461)..(462): n is a, c, g, or t
gttgatctttgtatttcctttttattattccanatgttttgaacagagataaggatgaggagccaactgtaaaacangagattgaagaaattgaggaagaantggaaccacagggtgtaatagttacaagaatcaaaagtgaaattgaccaggatcctatgggtagagaaacatttgaacttgttggtaggttagataaacaaagagggatcttcctatgggaaatccaagggaatctttgacccaggaacagagaatgttcagagaaaacactaacattatcccgtaaaagaccaaacttagaaganaaatgccntaaaatgtnaaanaatgtngaaagggtttngncccgcaaggcccatttcattcaaccattaaagggtcccatcttggtnaagaaaccttttcagtgcaatgaatgttgggggttttagtcgcagttcatttggtaatggacatcnnataatttacactgggggaggccctatgagtggtctggtg

SEQ ID NO: 565446 - DNA, 893 bp, Homo sapiens
aacagcgtgttgtacccccgtgtcccggagcgccacccccggcggtgcccccctaggaaccccgtgccgatcctccttcgggatttttccttgccccggggcgggactaccaatttttccaccaggacacgctatgtatccctttgccctcttttggggcacacataggaacaaaaggttgtccaaaggaaagacaggggatgggttcccggccccgggaattctcccgcggagaattttttcgccaccccacggctctgcgcccggcccgcgcgttgtgtggcggcccgacgcacagtcttctttgggtgttcctcccctcgaagcggtcccagcccatgattttgtcgggcgaacgcgcaccaccccgcaaatctctggactggcggcggggaaattatcccttttccccaccccgccccttttaaggggttgggccccgagatatgacctccatttgtggtgggttgtaggacaacaccaccaccactgtgctcctcctccgcgagagggccgggaacgactcccctcgagggatggaagggggaacacacgacgatccacccctaacgagaagatccccccccctgccaggaaccccccacgagtgatttttgtgacacaacagaaagagattttcaagaggatggtcaaaattccacccccggcctcctacccccagtgtttggggacagcaccacgacctcccgtgtgagaaacgcggtgagcgactttaggaagattctgtggcccctaaagaggtctcacttttggggcccttttttcgaggcccccacccccaaaccccttccccccggcccccccctgggggtttcccaaaaaaaaaaaattttttggccctttttttttattaatattttttaaaccacaca

SEQ ID NO: 565447 - DNA, 481 bp, Homo sapiens
  misc_feature (194)..(194): n is a, c, g, or t
cactatgtcctatcaataggagcgggatttgccatcataggaggtttcattccctatttcccctattctcagggtacaccctagaccaaacctacgccaaaatccatttcactatcatattcacggggggaaatttaacttttttcccacaacactttttcggcctatccggaaagccccgacgttactcgggntaccccgatgcaaacaccacatgaaacatcctatcatttgtagggtcattcatttctctaacaccaggaatattaaaaattttcatggtttgagaagccttcgctttgaaacgaaaagtcctaaaagtaaaaaaaccccccataaacctggaggggttaaatggatgcccccccccctcccccccatttgaaaaacccggatacataaaatttagccaaaaaaggaaggaatcgaaccccccaaaagtggtttcaaaccaaccccatggcccccaagactttttcca

SEQ ID NO: 565448 - DNA, 156 bp, Homo sapiens
cactcacagaacaggtgcgattctgacaccacaggtttgaggtcactgcacgccttctttctatcaccagtgagctagcagacttcggcacccagtaggtgctctcagatgcttgttgaatgtcaactacattatacgctctaagatgggtgccgt

SEQ ID NO: 565449 - DNA, 967 bp, Homo sapiens
gaggggtgcgagcagcggggtggggaggctgcatggactgacgaggaggagacgtaccggtctggaaaatccgaaggaccatcatgcagctgtgcaacgacgccgtggttatcttgttggcccagggactgtgcttggaccagaccttgggggatgtacaaagcccattttggtggacacacgcctgcattgagggggcggccggggcgcacgggccctcaacccggtgcttgtttgcccacaaaatgatgaccccacgggaccagattgtttgtggtcttttcccaggatggagcccaatgggtgggctttccaggacctttcaaggttggtctctgccagcgccttgcagggagcggaggacatcattcacgcggggctcttcattcggtgggtggcccgccagggatttgacaccctttcggcaagaggccagtcctcgtggttcggatattggccccccagatggtaattccgtggaggcccggtttcttggcggggaagggggtggtcattcaaccttcagctggggcacggcgcttagttccctggagcactgtcgttcgtgccccaaggcggggacggttgaccagagtcttggtggcccggatattaagcctgcgggagggagaacccaggcttgcccaggatcccagggcggggcgacccttgtgggcgcgctacttgggagtcaaggctgggggccgttgttgcactcatccgggccctgtgagagggtggcagggtacatcactaacgggtggtgcggagtaccggctgaggccctagagggggaaccggtggccccatcctgggtgaaagcctggctggcagattctgggcccaagtttcaggtgtggctctggctccaggggtggtgtccccgtccgctgtgggggtttgtgcccgcatctgtgttgggagtgaccaaggagccgggctggtgtgggttcacacgtcttgttgg

SEQ ID NO: 565450 - DNA, 190 bp, Homo sapiens
aacgtcatatatgcgttaagtgaatctagaacaaggtgaatgtgaaattccctccttccttcccccttcctgtggggttcattgtgtgcatccccagcgagagggacctggccccagggtgtgatggcagattgggaatgaccaaatgtgagaaaagtggtgggggcctccccaggacaatcatgcagca

SEQ ID NO: 565451 - DNA, 121 bp, Homo sapiens
tcagatgtccacgtcccgcacgtctacgactggagagaagtggagatcctgatgtttctcagtgccatcgtgatgatgaagaaccgcagatccatgttcctgatgacgtgcgggacgtgga

SEQ ID NO: 565452 - DNA, 394 bp, Homo sapiens
aaattctatgattagaattagtctaaacagaaaaagaggggaatgaaaggaaataaaactgtaattcatgtaatgtatgttaaatagcccaaagagttgtttctgagctttgaaacctggggctgagaacatagcagaacagaccaggacatgcccgggcaagcccatcgcctccctagctcccacccctctgacctaagttaaatgttacaggctgctgatgtttaaatggaccaatcatgtgaaaccgcgccaattcctcccccaagccccactccttttctataaaaccccctaagcttccaagcctccgtggtcgaatccactggtctcctgttgtgtgagataccgtttcgacccggaagctccgcccattaaaaaaccctcttggttg

SEQ ID NO: 565453 - DNA, 269 bp, Homo sapiens
ggggtttttttccccccccttttttccttggggccttttttaaaaggggaaagtttggaaaggggatttggggggccccaaaaggggtccctcccccgctccggggggaagggggggtttttttcgttttttaccccctttggggggggggggtttttcaaaggggtttttttccccccccttaaaaagaccccaccctttggtttttgggttttgggttttggggcaaaaattttgccccccccccctttttaaaaggggggggggga

SEQ ID NO: 565454 - DNA, 479 bp, Homo sapiens
cattccactgcccaaagtttattctggtttctaatttcaaaggacaaggctacatatattcagacttttatgacgatgaccaaagctagcttagggtctcctctgcatgtagcctaaggctagccttcagcctgactcatatccacgacttcttggccaccgtcgcaacgcttgttctttaaaaaagcggttctacctctctatgtgcctgagtgatgatacaatcgctgtgagtactagatgaacaaatccacagaatgggtaaagagtagaatctgaatatatctgaaaatatgattcgaaactgtgaatgtaaatatatacagtatgtatattgtttaaaagagattgcttgcaatgaccttataagtgacatttaagtgtcatagcatgtaaagggttgtctggggtaagtaaaaattatagaatctgaagagacacggggcggggagaaggatgaggagcaggcaaagcagcag

SEQ ID NO: 565455 - DNA, 344 bp, Homo sapiens
  misc_feature (15)..(15): n is a, c, g, or t
  misc_feature (67)..(67): n is a, c, g, or t
  misc_feature (72)..(72): n is a, c, g, or t
  misc_feature (75)..(75): n is a, c, g, or t
  misc_feature (134)..(134): n is a, c, g, or t
  misc_feature (149)..(149): n is a, c, g, or t
  misc_feature (210)..(210): n is a, c, g, or t
  misc_feature (239)..(240): n is a, c, g, or t
  misc_feature (242)..(242): n is a, c, g, or t
  misc_feature (248)..(250): n is a, c, g, or t
  misc_feature (253)..(253): n is a, c, g, or t
  misc_feature (278)..(280): n is a, c, g, or t
  misc_feature (337)..(337): n is a, c, g, or t
ctcctacttcccggngctccaagtctccagccagctctcccgggggagggaggagacgctgctagcncgagngtntgggtgtcacagggagcaaagccctgaccaaggccctaacctaagactgagggcagggnggaggggccccaggnggatgaagggagttagctgaggtacttgccccgggtttaaaaaaataaaatttctagattntaagttaaaaaaaaaaaaaaaagcattanngncattgnnnccngccctccacccagggcccgccctgnnnctgtggccacctcgctcagccagttcagagctgcgtgttctcctcctggctctccgngtgagcg

SEQ ID NO: 565456 - DNA, 872 bp, Homo sapiens
ttgaactctgggagcatagattcaagttgccttgaatgtacactttaattagcagcagttacaagtggatttacaaaggcaaaagagagggacagggagtggactgaaacaaagttgtttgtcagaaattcttcttgatctacagaaataacattgatgactaattggctatatatttttaagctgtgaggtattgcttgtaacatctagtgtggcattattaggttaatttatatctacttgtaggaatagcaaacagtttcaagaggtaaacacgtagctcaaaggaggcagtagaacataattatgttctcatttttgtgtccctccaggcctgataaaactaaaaggacttgcactcctcagatcaaagttattctttttcctctaatctcaagaccgagattcagaatttggtactgtagatttaggtcctggatggatggagaaatggcaggtgttaacctgcacattcatgggaatttgggaggaggagaaagaggaactttgagatactcatgtttactcaatgcacacatgtcaccctaattgttcttctgggcctaatagtctccaactcagtttcaggtctcaagacatatatgtgtcactgaaagacgtgacatggtcgattactgtcctgtgaatttttgtcaaccactttgtagaaaggcttaactctctatgaatggtttgtaaaggactattgattttgaacacggcaacgcacaaaactggcgccaaactagggggccacgtggccttggggcccacatgaaagggttatcggaagcctgagggaacagtctctaaagagaaacgcgcgcaaatcacattaaacagtggagaggacctcggcaatttagcgcaac

SEQ ID NO: 565457 - DNA, 389 bp, Homo sapiens
ccaaagtccatccatccatttgatttccttaaaaaagcgaatcccaaggttgtgcaattaatccatgaccacatacaattgatccgatgaactagataatgttaaatctctcaggtaacttgttaaatttttgatgtgtaggataaaaaaatacttcaggggtcctactctgaccacgtcccttactgatctgtcgccctggtgcttgggggtcatggaaagaaagagtgagaaaatgtcgagggagaaggataaggggatgagagtgagtaccccttagaagtttgagcccatggggtgggaactattcctcccccaatcactgaagctgtagtaagagcaaatcatggtcaattttacagtcatctctgggttagccacactaatgg

SEQ ID NO: 565458 - DNA, 546 bp, Homo sapiens
cccacaaaaccttataaaaggggtccaaaaataccgccacaaaatttgggacagggggccccccaaaaaaaccccggtttaaaaaaaaaaaaacaaaaaactgccccccccaaaaaaaaaaaacaaaggggcccccccaaaaggccgaaaaccccgcgccaaaaaaaaggggcgccctcccaaaaaaaaaaaaaaaaagcccccccacaaccccggccgggggaaaaaaaccgaaaaagggccatccggggaaaaaataccccccacccaaacaggtcaggccctacccaattctttgccgccccggtcccccaaaaccccgccgcaattatccacccgggcaacccggttacactctctacccggggggcgcgccaaaataaacttccgcccaaacttctgtgctcggcccccactctcctgcacaaaacacggaccgcccgccatattataataggcacaccaaaaaggcggcggcaacaccgctacaaagttgtcctcccgccaaaacagttcttctctccaaccctccccacacaatgcccg

SEQ ID NO: 565459 - DNA, 372 bp, Homo sapiens
  misc_feature (2)..(2): n is a, c, g, or t
  misc_feature (126)..(126): n is a, c, g, or t
  misc_feature (145)..(145): n is a, c, g, or t
  misc_feature (181)..(181): n is a, c, g, or t
  misc_feature (212)..(212): n is a, c, g, or t
  misc_feature (226)..(226): n is a, c, g, or t
  misc_feature (236)..(236): n is a, c, g, or t
  misc_feature (268)..(269): n is a, c, g, or t
  misc_feature (287)..(287): n is a, c, g, or t
  misc_feature (302)..(302): n is a, c, g, or t
  misc_feature (359)..(359): n is a, c, g, or t
tntagcaccagcagatttttcaagagcctcaacatctacttttagagacatactatctgccgatggcaagtctttactaagacctttggctttctctggatctacaagtgggttggcagaattaanctgtgccagggtgtgattntcttttggtttttttttccacagctgttgtaggtcnctatttgcctccttcttccgcccatttttgngtttgaagtttgcngcttctcttntcagggacaaatgggcgggggtttttggctgnnggttttgttaccactggntagcttgtgtgaggncctcattggccctatcaatatcttcttcatggctatacatggtaactaatgcagatnccatgcctggttt

SEQ ID NO: 565460 - DNA, 146 bp, Homo sapiens
aagtatgaggcccccttagtcatcagcatcttatatagtacaagctcatttgtacaaggtttataagtttatatataaaatgtgtatatatattgtatgtttccccttttagactttattttttctgtatgaaacccagcaaatcg

SEQ ID NO: 565461 - DNA, 223 bp, Homo sapiens
accttcaagcgatacatgatgttaacggtagatcaacgtaggtcttgagctcctgagctcaaatgatccacctgcctcggcatcccaaagtgctgggattaacaggcctgagctcccatgcctggccttttctggtcctatggttagtatttttcgtgacctatttaagaaaatctttgcctcgcccaagaatgttcactgttcttctgggaacgcctgtttt

SEQ ID NO: 565462 - DNA, 301 bp, Homo sapiens
actaaattcgcggccgcgtcgacggcccagtgcgaaaacaccttcgatgcgctcggccggatccgcacccagcgcgatgccacaggacacctaacacggttcacgtatctccctggtggggtaaccgtcgccgatgacgggcagggtcaccattccaatacgtggattagtgatgcccggggccgtaccgtcgggatcattgacgctgacgggcagcgcacttctatccggtatgaccgctatggcaaccttgtaggggctactgatcgagcgggcaaggtcgacgcggccgcgaatttag

SEQ ID NO: 565463 - DNA, 593 bp, Homo sapiens
tacagcgagctcccagctttcaagaagataaccggcagcgagcacccctacaacaacctccgcaagcgcttcgtgggctctgctctcagaccagtgacttcgacctcatgaacaagttcctgacctacttccccgggaggaggatcagctgctgaggactggcctcaagcatgagtatttcctgcgagaccccacctcccacatctgacctcctccatgttccccactgtgtgccctgcaagcagctgagcagcaagcgtgtgaagctgtgggcaccagcccgaggccccctgagggatggcctggtgctacatgccagcatggtgtgactgactgatcctgaacggagactggtgcttccagccttaccaccacgaaaccatgtggtggcctcctgccgctgggcaccctggcttcaatgcctcaatgttctcgaaggtcagatgtggacccctgtcatggggagaactcagcctgggaccacaggctgtgtgctactgcggcttggagctgcgatcgagactcggaactcctcgtcttactttgtgctccatgttttgtttctcgtatctcaggtttgtaaatttgtagaa

SEQ ID NO: 565464 - DNA, 1476 bp, Homo sapiens
  misc_feature (132)..(132): n is a, c, g, or t
  misc_feature (1153)..(1153): n is a, c, g, or t
gccttgctatgcggtcgtgagtgagtaaagatcatgtgcccgaagtatcgctaagcaagatcatccatcgtatctgtctacatagcacgtagaatgccctgttacaaatctgtgagtacagtcactcccacngtcgatacaagcagacaggactcttcgagaggtgaaggagacctgggacttgatggcgtgggaagggcgcaagcccgtatgctccatgatccataaggaatcaacaactgtccagaggccggttccacatgttagtactgggcgtagcactatctgtactaccggtggaagccaatcggaattctaataatcttcgtgtcagaggaaagcacgatggacggggtaaatgggtatacccataatggtgtaggctcacttttggattggcaccagtagcgcgtactcgtggcccaggagaactatgtggggtaaaaactagggtctcaaaaatcacttaatatttgaatttgaacttttcgtagcatatatagggctaagcttgttctccaaactggtgtggaccgaacatcggagatgttctttctttattcttcttaataacgttaagctttgaattacctttaaaaagtcaagccccggtaggttgtgcatataacttttttaacatcggaaacccagtttttttaagtctaaaattactgaaggcggaaacagatacggctgggagctaatttatgcaccacattgtttagttgtttacgccgcagggtaatcttcgttttctcacacatactccttgggctgggaaatctccattgggcatcgaactttctgggggactcaacatcgcgtcgcgaccctttgcggaatccccttgttctagcactatcttagttccactatgctttatcgtgtccccccccttggcgaacctgtttgggtctcttgcgacacgcaacagaagtggttaggtgacttatgcccggtgggctagccaagggaaagataggaatggctttcggacatggcgtggaaaccccactgtgttggaattagcaccctgtgtcgagtctccaaccgcgaaaggggatacttactctctaatcggggcagatttccattcaaacatgaagacaaaggcatggctctaggttcaaatttacaaagagtctgcgttgtnggcaggccctctgtccccatgtccacgggtcatgagggtgagatcgctgtcgggacgtttaccgagtgccggacttgtcccccttgcgcttttggcaccttctgtgcttgccgttctggatgtacccgggagaggggggctccggtgtaaccgggttcaggtgggacttaatgtcttccagagttgttctacagattctaccgagcgcgctgaaaggtccacgaaatcatccacggtccggaggttctgcgtgatcaccacagacgccgtcactgtgaggtagcccgcgcatttatgcgttcgctgttgcgtcccagcgcgag

SEQ ID NO: 565465 - DNA, 110 bp, Homo sapiens
tgatgattcgctacctgttaacacacttacatgctagagatacttataataacaaacaaggcactagcaagtgcgacactgctaaacccctttttttaaaaccctatagt

SEQ ID NO: 565466 - DNA, 288 bp, Homo sapiens
ctgcagtagctgtttatggcgaggcgctgtttccagagccatggagagagccagtctgatcagaaggccaagctggcagaagcagtgccccgggggaaacaaaaccgctatgaggacattgcagcttcataaggcgcgtgaaaggcgagagctctctgcgaacgaaactgctctcatactaaaacgtgtgggcggcagagggctgcctggagggtgctgtccagtattgagcagaaaagtcgaacgaggatgggcgtccggaagtgaggaaaggggggccccgaagag

SEQ ID NO: 565467 - DNA, 355 bp, Homo sapiens
  misc_feature (16)..(16): n is a, c, g, or t
  misc_feature (61)..(61): n is a, c, g, or t
  misc_feature (68)..(68): n is a, c, g, or t
  misc_feature (124)..(124): n is a, c, g, or t
  misc_feature (126)..(126): n is a, c, g, or t
  misc_feature (138)..(138): n is a, c, g, or t
  misc_feature (177)..(177): n is a, c, g, or t
  misc_feature (272)..(272): n is a, c, g, or t
  misc_feature (284)..(284): n is a, c, g, or t
  misc_feature (298)..(298): n is a, c, g, or t
cccccatgactccagngacagtgtgggagaggctactctccagggacatgtttttggaganatatggngaagggggcccaggcgaggtggctcacacctgtaatcccagcactttgggaggtcnangtgggaggatcncttgacgccaggagttcgagaccaccctgggcaacagancgagatcccatcactacaaaaattcaaaaaattagccaggcatggtggtgcacacttgtagtcccagctactcaggaggctgaggtgggagactngcttggccccangaattcaaggctanagtgagccgtgatcaccagtgcactctagcctgggcaacagagaaagaccctgtctc

SEQ ID NO: 565468 - DNA, 1273 bp, Homo sapiens
gggccagcgccagctgccagaccctgcgcgccgctgctctccgtgcccgtcgcctgccttgtggactcgcgagccctgcactccctgccctgcctgttctgctgccctgagtattggagcttgctgtagtttgctgaatgtgcaccctgtgcactgctgcccctggtgcctggtgcctgtgaccctgctggcttgctgtggtggaccatgctgttgtccttgcaagacgccttgctcctgccatggaggagctgctactggtacccctgctgcactcctagcttccatgtgctgtgcatgcgggcagatcaaggcctgcacactgctggaacgatgcttgtgcttactgggactgcgtggcaggtactgctgacgcgactgcagatcgctgatgagtgacgcgcacgtccttccacccttgtgccgatgacaccttaccctggcatctggctaccctagatctttgctgtcgcccaccctgaacaaggctgcaggtttgcatcgcttcctgggtgttgctgtgtcatagcattgcctgcttggccatccactgcgtgctgcgcagaccacgcccacctgacccatctgacaaacctggtgcactctacagctgaccacgctgtcatctccaccgaccagttagcgggactgtggaggtgctggtccatagggacagctcacgttgggacctgcgctgctgtgatagcacattgatactcatgcgccttcatatctgcaccgggtctctctgccccgtgaaccgacagggccttgcgtccacaaaggcattgcccaagacactttttgtgggcctctggtggctacaggaattataccctttgccactgtacccggcatgtcattgactcgacaccgtccacgcattgagggtctgacgtggcaaggcctgaggtgcctgtccaatgtacagaggatgatctaccagactttcttgcctgcgatcccgtcggcccgtcacgtggcactgtcctgcggcctgtcagagcccaacttgcaccggctcccggacaagccccagggaagcagtcaaaccacagagacaaggtgccgacagcccgagccctacctgcgggctgtccacagaaaacaaagggaaacgcacaccagtacccagacgactggtgactcccgcagagtggcgtcgcgacctgctaagtcaaacaagcaaaggtggatgcacacagggcggccacgcggcgtcccgctagtagagcatccctgatcgtggggagtagctctctgcttccggtca

SEQ ID NO: 565469 - DNA, 271 bp, Homo sapiens
taatttttgcgggaaaaaataaaagtgatggaatttggttaattatccccccgggtgttaaaaaagtaaaaagcagtcaattttcacttcaaaaacggttctaaaaagtttggttcggtccgggaattatttaagtaagtgggtgtctcagtaaatggtgtggacctggttggttttcccaactggtgccaaatttattcaccagctgaatcttcggtgcagcagtctcccttattaaatggcgaaatcaataaaatctcccaaaatattt

SEQ ID NO: 565470 - DNA, 202 bp, Homo sapiens
cttgaagaaacttcctcaattacgtaaaataaactttagcaacaataagatcacagatattgaggcgggagcatttgaaggagcatctggtgtaaatgaaatactgttctttagctgaacaacggaatttcttgcttttgatctgtccaattcttaagtttgccaggcggcgagggctggtgcaacgggcaccactggtctc

SEQ ID NO: 565471 - DNA, 231 bp, Homo sapiens
ggcttcatgatccatacctccccagcttctcccctagtgcacatgctacctatacggcaggctccatctcctcctccccagctcctccactagtgcacagatacctattggcaggctccatctcctcctccccagctcctcccgtagtgcacagatacctataagcaggcaccaatctcctcctcccacagctcatcccacgtagtgcgcggatacctatctgtcaggcac

SEQ ID NO: 565472 - DNA, 261 bp, Homo sapiens
acatgtttggcaagtctcttcaaaatcttcccaggaaagtcagtaatgatgtcttatattctcattaataaatgtttctgtaggaaatctgttatccacttagttgtgcccatgttggggttaaattttctttaaaaaataatgaataaaaacaaggataggcttgcttattagtttacttttcacatgttatatgctgtatccaacaaaggcttcactaaaagataaatggcttcctctagaatagaatgtacttacatc

SEQ ID NO: 565473 - DNA, 1041 bp, Homo sapiens
  misc_feature (424)..(424): n is a, c, g, or t
atatttcacgctccgctaccataattcagtcgctatccccaccggcgtcaagaggtattatacgacgtgtactcgccactacctctcacggaacgcacagtactgaacactgatcatgctcgctacgttcgcgtctgaggccctagcgattcactactttcttctgtgcaccgctacggtgggtcctgagcgtaggcctagttgtgattacgcataactgctagtctactgagtaccattcgttaggctaaaccgacacgtgacgtacgctctgtatgctcactgtccacttatgtaccctgatcgaagtgaggcagcgtgtgattatgcccgatctagtgagcgaaggctgtcactcttcgactgggactttcctcctaattcatcatggtctactaggccttatatcactaatagcatacgnccatagaattgccgagtttcagcgtattcgatgatgtacatcgagtcgcttaaaatgctgaaacttgtgctttgccccgacagaaacagactttgtcttgcggtccataatccggtaaatggtcgcccggaacgctttaactccgggacgttagcccccgaaatgacgatactactcacattggaaaactattccgtaatgcatcgtgttgagaggcatcatgtcgagttgtcatcttaaacaggcgagtgacactatttacactgaaattttctccagtggcaatttgtgacgaaaggccctttcgcattcggaaggcggaaaaaggtcccttaatagcgtaggaagggaaatcccttcgcattaaactcgtgggacggtggacttattagttggggaattggccccccgcccaaagaacccttaacaacaaccaatttccgggagaaggaaaaccccgtggttaagcaatataattcaagcgaaacccgaacatgggaggatgacacacaacccctgatcttttagcgctgcccaacattgggggctcgcgaggagaacacggctgttgtcaaggacgccattgtgggttaaggtagtctctacgggcgggacag

SEQ ID NO: 565474 - DNA, 475 bp, Homo sapiens
cacgaggaggttcggcagcagatcccgtcgagagctgaccgactcggcctggtcgtcgccgagcccggcacgccgtagtgcgggcaccgatagccgcgcccgaggaacgacatggtcgacgtggtggatgttccgggtgtccacgtgcgggaagagcatcgcgagcgaggcgaatgtccggcgggtgccgtacttcaggtcgagcaggtcgtcgatctcctggggcgtcaacgtcagcgacttgccgcgggccgccatccgctcctcgatctgcgcgaccgggaagccgtccgaagcgtgctcggtgatgacgtctcgcaggtcacgaagcaacgtgtcgagcccggaaccccagatgccctgtttgacgaggctgcggaggacccactgacggagtgcgctgcggtcctttctctcgctgggagcggtgcgataggtctcgtccaacccccgctggtagacgtagtacgcgacc

SEQ ID NO: 565475 - DNA, 488 bp, Homo sapiens
  misc_feature (61)..(61): n is a, c, g, or t
  misc_feature (450)..(450): n is a, c, g, or t
cttgtgtacattgacttccgagatgaagacggacttctcagacagtcaagggaagcagccnccatgggcttcactggtaaacaggtgatccaccctaaccagatcgcagtggtacaggaacagtttactccaaccccaggaaaaaattcagtgggctgaagagctgattgctgccttcaaagaacaccagcagctgggaaagggagcctttactttccgaggaagtatgatcgacatgccattactgaagcaggcccagaacattgttacgcttgccacatccatcaaggaaaaatgatctgttaaatgaaccctcctcaggcgggctgaatggatactgtgggcttcttaaagacaaaccgcagtacccagggcagcttgctagcatgctggatcaggacctcatttcacgttagtcacaacgccccctccccttgtatcttactgacncgctatgctaaaaataaactttcttcctctggagtcta

SEQ ID NO: 565476 - DNA, 255 bp, Homo sapiens
  misc_feature (192)..(192): n is a, c, g, or t
gtagatctctagcaggatccccgcacactttttgcatagaataatattttgttttgaactagtctggagaatgttactgtttcaattattataaactatctttgctttcctagaatactgctccaaatggctttgctgcctctactattcatcagccctaaatttctgtccccaaagtatgataagcagacnactagggagtctctttggccattctccttcattcagttgcattctatattaggatatctatta

SEQ ID NO: 565477 - DNA, 831 bp, Homo sapiens
  misc_feature (3)..(3): n is a, c, g, or t
  misc_feature (119)..(119): n is a, c, g, or t
  misc_feature (128)..(128): n is a, c, g, or t
  misc_feature (141)..(141): n is a, c, g, or t
  misc_feature (145)..(145): n is a, c, g, or t
  misc_feature (147)..(148): n is a, c, g, or t
  misc_feature (151)..(151): n is a, c, g, or t
  misc_feature (157)..(157): n is a, c, g, or t
  misc_feature (190)..(191): n is a, c, g, or t
  misc_feature (194)..(194): n is a, c, g, or t
  misc_feature (242)..(242): n is a, c, g, or t
  misc_feature (247)..(247): n is a, c, g, or t
  misc_feature (273)..(273): n is a, c, g, or t
  misc_feature (285)..(286): n is a, c, g, or t
  misc_feature (288)..(288): n is a, c, g, or t
  misc_feature (293)..(293): n is a, c, g, or t
  misc_feature (333)..(333): n is a, c, g, or t
  misc_feature (344)..(344): n is a, c, g, or t
  misc_feature (385)..(385): n is a, c, g, or t
  misc_feature (488)..(488): n is a, c, g, or t
  misc_feature (507)..(508): n is a, c, g, or t
  misc_feature (514)..(514): n is a, c, g, or t
  misc_feature (529)..(529): n is a, c, g, or t
  misc_feature (532)..(532): n is a, c, g, or t
  misc_feature (534)..(534): n is a, c, g, or t
  misc_feature (536)..(536): n is a, c, g, or t
  misc_feature (562)..(562): n is a, c, g, or t
  misc_feature (604)..(604): n is a, c, g, or t
  misc_feature (607)..(607): n is a, c, g, or t
  misc_feature (609)..(610): n is a, c, g, or t
  misc_feature (634)..(634): n is a, c, g, or t
  misc_feature (637)..(637): n is a, c, g, or t
  misc_feature (652)..(652): n is a, c, g, or t
  misc_feature (655)..(655): n is a, c, g, or t
  misc_feature (667)..(667): n is a, c, g, or t
  misc_feature (669)..(670): n is a, c, g, or t
  misc_feature (679)..(679): n is a, c, g, or t
  misc_feature (685)..(685): n is a, c, g, or t
  misc_feature (696)..(696): n is a, c, g, or t
  misc_feature (703)..(703): n is a, c, g, or t
  misc_feature (705)..(705): n is a, c, g, or t
  misc_feature (736)..(736): n is a, c, g, or t
  misc_feature (738)..(739): n is a, c, g, or t
  misc_feature (766)..(766): n is a, c, g, or t
  misc_feature (806)..(806): n is a, c, g, or t
ggnggctgcgaacgcggaaaggcgacgacgacgaacgcaaacaacgtcatggcaaacaggtggccctgaaccggacccaagtgtgcgggatcctgcgggaaaaacttttccaaggcgangccttccancaatcggatacanacananncancaacangggtgcatcgggtgacctggccaaaaaaaaaanntancccaccaactggtggctgttccgggatggccttctgcccgaaaaaaanttcancgtgggctaaaccgttcccgcctcanaaaggctgacanncncaaanaaaaaaaacccttcttcaaagccaccccaaaaaaaaaacncaaactggagnacttctttgcccgcaactcctatgtggctggccaatacaanaatgcagcctcctaccaacgcctcaacaaacacataaataccctccacctagggtcacagaccaaccacctcttctacctagccttgcccccgaccgtctacnaagccgtcaccaaaaaaanncacgantcctgcatgagccanatnanangctggaaccgcatcatcgtggagaancccttcgggagggacctgcagagctctgaccggctgtccaancananntcctccctgttccgtgaggaccanatntaccgcatcgaccantanctgggcaaagananngtgcagaanctcatngtgctgagatntgccaanangatcttcggccccatctggaaccgggacaananngcctgcgttatcctcaccttcaaaganccctttggcactgagggtcgcgggggctatttcgatgaanttgggatcatccgggacgtgatgca

SEQ ID NO: 565478 - DNA, 429 bp, Homo sapiens
  misc_feature (313)..(313): n is a, c, g, or t
  misc_feature (332)..(332): n is a, c, g, or t
  misc_feature (375)..(375): n is a, c, g, or t
  misc_feature (395)..(395): n is a, c, g, or t
aattcgcggccgcgttcgacatggaagctgttaaacaagttcagccacagttggtctgaaatcaaaaacttcatgcagttttggttgcattgaaaagggcgcaatcagagcttgcagctcatcagaaaaaaatctccatgttgacaaccatatggtatctcaatgcggggcttactgctgatgctagactgttatgtaatttatgcgtcaggagtgtttggattccagatttgtattcgatagaccactgcctgtgtctcgtcttgtatctctaatggaagcatatccttttatgtagcatttaagggatagnactttgaaagggtttgaanactggtgttaaataattaaggatataataataatatgacatangtaagatgtgacttcacctngatggcccttcatagccttatagccattatttgc

SEQ ID NO: 565479 - DNA, 200 bp, Homo sapiens
  misc_feature (68)..(68): n is a, c, g, or t
cccccctgccctctcccctctctccctccccctaactgcattacatgttaactgtgtgcccaggacanccgtggtggggaccgggtattccaactggaatgattctagaacccaaataaagttggggcaggaagagggggcttccagggaaccctgctcggccctgaatcaccttcgtctcttctctaggaaaaaaaaaa

SEQ ID NO: 565480 - DNA, 1146 bp, Homo sapiens
  misc_feature (235)..(235): n is a, c, g, or t
  misc_feature (1010)..(1010): n is a, c, g, or t
  misc_feature (1146)..(1146): n is a, c, g, or t
atccagagacaattggcccctgtatgggatggagcccgagaggcgtcatcagagagtaactgggaatgagattgttgacagcattatgatgacatgaacctctcggagtccctttctccgtggacagtctacgcctagtgggtatttgagaagccctcatgccagtccagcagcgagccattctaccttgtactcaaagggttatgatgtgagttgctcagagcgcgcaaaatcntgggagcttgggaaagagcggccacagtttgccattatctcgagttcatgcaagcaagatgtgacacttaggactcctaggaaggcgcatgcgcatggccgttggttcccgtaggcacgcctatcatcgtacgaattgggcgtctagcaagatacaggaacggtggtcatcggcgactagcgagactacattgggctgccttcctgtcatcgcctgtatccgggggcaccaacggtgcgtgctagagagtgcataaacttgctagatggaagctccccataatcatcgtgggtacccctggaccgtgtgtgagatattgcttaagccggagatagctgtaaccccaaataacatcacatgatgtttggtactgggatgaagctgatgaaatggttaagccgtggcattcaaggtaccagatctatgaccattttccaaaagcttcaagagaaacaaccaggtagtatcgctgttgaggcacaatgcgttctgatgtgcttgacgtgacccatgaagttcatgaagggaccccatttcggattcttgtcaagcacgcagaattgaccctgggggaatccgcagtctacattcacgtgtacgaatggttgaactgtgtacacgaatggaccttttgaaccctggaccacacccaggggggccttaattagcccgagggaaggggacggggtcaccagaaaatttctgctccagaatacggactcccatgtatgaatttggcccccggcacagcatacgacagcagctgtctacacanagtaacaccacgctgtcacaacattagagaatataacaccaatcacccgaagccaccacaccgagagcgcagccttataacaacaggagacacacctagagtcaactgtcatgctcttatcagaacatgagagggn

SEQ ID NO: 565481 - DNA, 207 bp, Homo sapiens
aatcgagctcggtacctactacagctctaattttttttttttcatttttggtagagacaggtctcgttatgttgcccacactgattttgaactccgtggcctcaagcaatcctcctagctcagcctaccaaagggctgcgattacaggcttgagccacctcacctggcccctcttctttcttaatttatgatagctgttgtaactgg

SEQ ID NO: 565482 - DNA, 135 bp, Homo sapiens
gcggccgcctactactactactactgctcgaattcaagcttctaacgatgtacggggacatggtggctcacgcttgtagagattgtgccactgcactccagcctgggtgaaagagcgaaactccgtctcaaaaaa

SEQ ID NO: 565483 - DNA, 1401 bp, Homo sapiens
actagttctagatcgcgagcggcctccttgaaaaaaaaaaaaaaaaaaaaaaaaaaaaaaaaaaaaaaaaaaaacagggcgccggcgccgccagaaacaagcaaccccacacaaggcggcacaacaatcgcccgccgcggcacccgcaccgcgcgcgctgcaccaccagcggcgcacaccgactgaccgaggccagcgcactactgcaacacggcacacacaccacgacgccccacctcaccaccaccacccgcgcgcagcacggggcacacacaacgcgcgcgcacccactgacagcactctctcttcgcagaacaacgagcacaccttatcacctatctgaggtgcgcggcgcgcacgcacccccatgccggcggacaacacacaacgaccccagccaacaacaagtatctaaaccaccacactaccggacaccactactcccaccccacggccacagcagagggcacactcacggggcagaacacaacagacgcacgcgacacaacgcgcgcagcagccccgcacgccgacacactccgccgcgcgccacgcagagcacacgaaaccacaacccacccaccgaacacacgccacaccacggccaaacctacatacactatacaatcaccaacacctaccaccacacatctacaccactcacccccactccatcatacactctcctcctcccccccaccacacacacatcacaattaatacatcacctaatacacaaacacaacccctcatacacaaccccaccccaccccaacttcacaccacaacacactatcctcctcacacacctcacgcggcggaccgacgcccacgcacacaccagcaagctagcagcacgcagcacacggccacgccgaaccaccggagcgtccatcacggggcaggactagggcgccgcgcgccgccccacctgcccacagcgcgaacacccgcccccggccggcaccggcccggcaggacacaaacaccgaccgcacaccgcgtacgcggcccaccgggcacagccccagcgccagggccaatacagccgcacgcccacacggacagcccccgggccggcacgcagcaacgacgaccgcgccaccacccggcggcccgcaaagaacaaagcacgccgagcccgacccacccgcccaccacgcatccaccgcacagcacccgaggcacccacacgccgcgaggcaccgccgcaccacagcacgcccggaaccacacagcgccgggcacgcaagaaggcaaaccgaacggccgagcgaaacccacacgcccaaacggagccacaccgcccgccgacacctcgaccacggagccggaccgacccggcagcacgccacagacacgagaggcccacaacccgggcggaaccgcggacgcgggccg

SEQ ID NO: 565484 - DNA, 157 bp, Homo sapiens
gcaccccctcccttctaggaaacaagaagagataaacaggaacctacatttttatgtactatgcaaaatcagacatcttttaacatagtcctattactatggtaacactttgctttctgaattggaagggaaaaaaatgtagcgacaatttttaagc

SEQ ID NO: 565485 - DNA, 172 bp, Homo sapiens
ccttctacaaacaaaacccagacccaggactcatcgtggcggaggctgaagcacgacgcaacagtggacagcacttggaagggagaaaaggtgagcttcagagctggttgtcgctgccggttcaggaggccatcctctgcgatctcttggagcgaccaggggtcccgagctc

SEQ ID NO: 565486 - DNA, 498 bp, Homo sapiens
ccagtgctacttccacaaacaggcatttgtttacttgtaagacgacagaacagaatcagcacctatataaaaatcacactgacaatatctaatattttgagaaaaaatgaaatctgatggtcctgttaacaatcatggtattttctaaacccctgcctccttttttgttgttattttttgtttagtcagggtctcgctctgtcacccgactggagtgcagtggtacccgcatagctcactgcagccttcaactccggcctctgcctcctgaccctactgcctcagcctcctgagtagctaggaccataggcatgcaccaccacacccagctaattttttattctttgtagagaaggagtcttgctatgttacccaggttagtatcaaactcttggactcaagcaatcctcctgccttgacctctcaaagtgctggcattacaggtgtgagccaccatggccagcctatgaactgtttgtggaggtagcactggggatc

SEQ ID NO: 565487 - DNA, 198 bp, Homo sapiens
  misc_feature (148)..(148): n is a, c, g, or t
  misc_feature (190)..(190): n is a, c, g, or t
gtggcaaaaactgacttggcattgtgtatgtgccagggggcatgccctggcaattgtttcacttgcagatctgcggaacagcagaggtgtgtgcgttaaggcctgccatggcagctgacatagaaaacattaatgagtgtccattgcntgtttcctcgttttgtaaaactgtggcatatctagaatccgngtgtattc

SEQ ID NO: 565488 - DNA, 136 bp, Homo sapiens
agtcccattatactcgctcttccacggccacatcgtagcactgaggtcatccgtgcgcgcctactctgtgtccatagacctgtcccttcctccgtcacagcatggtcattccaggatctggggacaaagcactcct

SEQ ID NO: 565489 - DNA, 662 bp, Homo sapiens
ccggctcaacttttcgtcacttgtgtgagattcagtctggccgaacctccagcatgaggttcaacgatcctgggctttaacagcaagggagaggtgcatgggatcaagtgtggacccaatggggtcagcattctgacggatgggatggtagtacgtgaaggacataggatgtggggtatagctgtgagaaactttttgaaatagtatagatgaatgtcctgaggggactgtgaaactatctctgaccctcttatgaaactcaacggggaatcaatctaaattaattgtacagacatggtggtcaatgaattgattaggaacggcgacgaggtcaccctagcggaatgtgtatctacggtcctaggggccaaacgtctggaaacggggtttggaacgtggtttaaggcaaggacggtgcactcggatgtgcccatgagtccgcttgaggtccagggtgtggtgaattacacgttgagctcaccggaacacgcaatgaaatgagatcatcgcttgaggagcaggtcctagacttcgagtcactccttttcagtacgaggcatggggaagtgccagccattaaaggtagcgcgtaacaagcatcgccactcgaatacctttgtgggcgcttccacgagtacactcaccttgggctcgcgaagctg

SEQ ID NO: 565490 - DNA, 210 bp, Homo sapiens
  misc_feature (72)..(72): n is a, c, g, or t
  misc_feature (98)..(98): n is a, c, g, or t
atgggtgctccatcccccgaggtgactgggctgagtcccgggagttgggaagaggtggcaggaaggggatcntgaggaggagaacaggggtcctggtnggtcttgtgtttcttcccagacacgggagctgtagaaggggagctcctgcagcagatgctaggggggccaggtagggccccatggccagtcttgggactatggggtccttgt

SEQ ID NO: 565491 - DNA, 545 bp, Homo sapiens
gagctggggcgggacgcgcggaggtgggcaataccgctaccttcccttgagcagtccacgccttgtggcggctttagcggagctgctgctttggcgggagttggaagctggtgtgatggtttctgtggcggagaaggagagtgccagaggtgactggcttcgtggttcttctagtgctctcatggccaccatgtatggaacggcagatgccaaactcagcccaaggtagcagcccacagtgtgccgagaggctagccttgtggtctgtcaggctttgggactgaagctggaggctagtacactccattcctggggaagtatcgcccctatatgtgggtacgctgttgccagacctgcacacccaagagctgggagtccctcttccacagaagcatagcagacctaggcttctgcaatgtgatcctggctgaaagcgcagctgagaaccacaacggttatcagggtgcttgggctggtatctggcaggcttcttgcttatactcctagttggtcccctggaagcaggcacattccacctattcgca

SEQ ID NO: 565492 - DNA, 268 bp, Homo sapiens
gtcgacctttaatctttctaggtaacattctcttcctaaatgatgaatttaactcagatctacagaaaacaatctaccccagaaacaaactaattatgagaaatgccaaaaaaattaaaacacaaacacaattataaacaaagtatgaattgcaaaaaataaaatatggtacagaaagttacatttttagtcctataacaacatgatgaatttccttcattttatgacagatgatgacattgttaacttctacatagacccgtcgacg

SEQ ID NO: 565493 - DNA, 525 bp, Homo sapiens
  misc_feature (433)..(433): n is a, c, g, or t
  misc_feature (468)..(468): n is a, c, g, or t
agcggccgcctttttttcggtgggagattttggaatatggactcaatctcctcactaaccacaatatagttctattcaaattttctatttcttagtgatttagtcttaacaagtttggtgtttctagaaattggtacacttcatctaggttatccaatttatggatgaacaatggttcgtagtattttttttttaaaggagtctcgctcggtggcctaggctgggagtacaagggcacaatctggggctcactggtaacctccgcctcctcagttcaagcgattctcatgactcagcctcctgagtagcggggattacaggaacatgcaaccatgtccagctcagttttggtattttcagtagagacagggtttcaccaggttggccaggagggtctcaaactccggagctcaggcaaggcacccacctcggnctcccaaagggcggagataacaggcgtgaagccantgggcccgaccaagggaacacttcttaagtctttctgtgaggcaggattaccctgat

SEQ ID NO: 565494 - DNA, 1009 bp, Homo sapiens
agataggctaggtagaggctggtgggaatcggcaccgaggaaagccatcttgcattgtctcatcgctcttgtcgcgggcgctcgcgcgcgctctccgccgcgggatccggagtttatgccagagtcctgaactctcgctttctttttaatcccctgcatcggatcaccgtggtgccccaccatgtcagacgcagcgtagacaccagtccgaaatcaccaccaaggacttaaaggagaagaaggaagttgtggaagaggcagaaaatggaagagacgcccctgtaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagttacgggcaagcgggcagtgaaagatgatgaggatgaccgatgtcgataccaagaagcaagaagaccgacgaggatgactagacagcaaaaaaggaaaagttaaactaacaaaaaaaaaggccgcgtgaaccctattccccctcaattttcccatttcagattctaaacgttggtccccttcgagtagaagaggccggcccgcacaccggggcagtgcccccgaagatgaaatgcgctctccaaccaccaaagcaaaaccatgagaatttgccacagcggaggcaaaaggaaccaaatttcaaggcccctggatttttttcttacacgtactttaacaggcaattgtgtgtgtatcttcaattacatataatattttgttacatttggtaagggccagccattttactgatctcggtgacaaccagcttcggagcgttctgcctaattctgacttacttgtgtgtgacctgtcattatatttcacaggagaaaaacttgttagaataacgaaagaaacaagaacaacaacagcgcgtgttggcgggacaagatagacattttatttcacaccttgaag

SEQ ID NO: 565495 - DNA, 273 bp, Homo sapiens
  misc_feature (101)..(101): n is a, c, g, or t
cccccaaatcctcccaacaacatttttagctgacatgcaatggcgcttacttggctcctgcaacctccgcctccgggattcaagcgattctcctgcctcanccttgggagtggctgggattacaggcatgtgccaccacgccctgctaattttgtatttttagtagagatgggatttctccatgttggccacgtttgtctcgaactcccgacctcagatgatccagcctccttggcctcccaaagtgctgggattacaggcgtgagccactgt

SEQ ID NO: 565496 - DNA, 149 bp, Homo sapiens
ccgatttgacactctaggcaagcgttagtccttttgtgttacctcatacatacaaatagaggctttatgttagcgtattcacgccacctaggatgttctttccttgaattctcacaagtgataggcccattctaacaatgtcgatcaga

SEQ ID NO: 565497 - DNA, 801 bp, Homo sapiens
aaataaagtgttattaagaaaatcagggccaggtgcagtagctcatgtctgtaatcctattgctttgggaagccaaggtgggaagattgcttgaggccaagagttcaagaccagcctgggcaacatagcaaaagcctgtctctaagaaaatcataaggaagagaaaatatatttactattcattaagtggaagtggattgtcatgaacgtcttcatcctcatcatttcacattgagtaagctgaggaagaggaggggctggtcctgtctcaggggtggcagaggcagaagaggtggagaaggtggaaagggaggcaggagaggcaggcacagttggtgtgactttaagaagacacatgtaatttctgtgtaacttttttgctttttcatttctctaaaaatgtttctatatgataacagtacttttccactatttgctttagtttcagtgctagtatcatataagggtctatgtcgtaaaaggagtcaaagcagtcttgaataataggaacccttctggccaggtaaggggtctcattttcataatcccagcactttggaaagctgaggtgaaaggatcgcttgaggccagaagtttaagaccagcctggacaacatagtaagaatctgtctccattaatcacaatagtaataaaataaatagggtacccttctggcagaatgtctaatgtcagtaggtttcaggcactgttcttctacatcttcttccccattctggcatgggtcacggaagcactcatttccatcaagcatcctctgctaatccgtgatgtagtatcat

SEQ ID NO: 565498 - DNA, 189 bp, Homo sapiens
  misc_feature (23)..(23): n is a, c, g, or t
  misc_feature (40)..(40): n is a, c, g, or t
  misc_feature (67)..(67): n is a, c, g, or t
  misc_feature (103)..(103): n is a, c, g, or t
ccgccctacaggccctagcaggnagagcgggaggtgagcncggccatcccgctcccggagttccggnatcctggagtccgtagttcgtggtccttcgccggtntccccggagcccagcggctgtggatggcagaagccagagtgggactggtcagctgcaggagcagaagaaaggtcttctgatagccg

SEQ ID NO: 565499 - DNA, 105 bp, Homo sapiens
aacacttctgtcagcctcccacaacacccatcttccatcccaactgcagctctgattgctctccccagccctctgtacaacagtgtcaatgtcacatgtccagca

SEQ ID NO: 565500 - DNA, 607 bp, Homo sapiens
aagcagtggtacaacgcagagtggcattacggccggggaaatttctaaattgtcaaaaatgtataccaaggaggttcaccagtgttgttgataatcagaaaaaaacgggactcaactgcaatgatgcagacagtgatggggatctgacagactggagtgcagtagcgggatctcggctcagtgtagccaagaactcctggcctcaagcgatcctgccgcctgggcctctggagtagctgagtagctggaacaacaggcggcgcccccccccgtcccgacccaggaatgttgctatagtgtgtggtagataccgggtttccctatgttgcccaggctggtctctaactcctggcctcaagcgatcctcccgcctagtgctcccacaagtgtcgggattacaggcgtgagccaccgagacccccaccttgccatttggtcgtagtggtagtgggaactatggtttacacacaagcaacgtgccaactatcttacatgtacacgcttatgtgaaccacaagcaccttcagataccagaacactttcagcacaccaagagtctccctcaggcaaaagaaaacagaggcgatcactgttctttttaccacca

SEQ ID NO: 565501 - DNA, 648 bp, Homo sapiens
cgggcgcggtggctccccctgtgatcccagtcgcttcgggaggccgaggcgaggtggggatcacgaggctcaagaggatctgagaccatcttggacaaatggtgaagacccgtctctaatacagatgcaaaagtaggccggcgcggctggatgagcgctgcatgctgtacactctccagtctactagcatagcgtgtgagagcagtgagaatggggttgaagtaccggggggcggaggtagtcagcgagccgaagtatcgctgccattgaattccatactctgtcaatcacagcgagattccgtctcaaacttcgcacttctcttggggtctaagatcagggaagggaatacgccgcgagtcatacatgaaatggatgccttgctcgtgcagggggcgcctgtcgatagctcggttattcgggtagccagtgcgccggtagcggcagggaggtgctatcccgtgcgttgcaggggcacgatggttgtccctccagctaggcggcggggctgggttagctagcctgcggtggcagggccctggtgtgggtcccttcctgtagccgtgtcgataggcggattgcactttcttttgcccacgccctttattgcgagggaaaagcgtgcgttaccggattagaaccccatct

SEQ ID NO: 565502 - DNA, 243 bp, Homo sapiens
gttggaatcttcacaagaggtgatgccatagtgatagccagaagatcgttgtgattgcatacaaagcatggattatagagccgatgacgtggtggggttgatgggagagctgggtaccatctcctccgatctggtgctctgtgttccaccgagagagaagccatctccttggggaggtcaggctggcccaggccccggaagctagggctcagcatctcaaatggtggcgaccctctgagtgca

SEQ ID NO: 565503 - DNA, 293 bp, Homo sapiens
  misc_feature (35)..(35): n is a, c, g, or t
  misc_feature (234)..(234): n is a, c, g, or t
catttaatgtatcccacactatcggactgatctgnacaggtcatgcttgtccttctaatatagcctcttctttgctctacatagagcgcatctatttgtgcatcacatagctgtatgtctccaaaatgaatcagtcttgtattctttgatatttttccggggtccacttatcttgcttctccattaaaaatcctgcactttatccatgattggaaggtttccgtgatcagctgnggggtagaggtttgtgtagtgggtcattcatgtgttgcgcgataacatgggtaccgagc

SEQ ID NO: 565504 - DNA, 766 bp, Homo sapiens
  misc_feature (766)..(766): n is a, c, g, or t
tatacggcccctttgacgttcttttggttttacacttacgtgagacagcacattacgtgggttcttacagagacttacgagactatgtgtgtgtgtgagacacatgttctcatctgtcacacgagactgttgtctcactctgtgtgtgcccacactgagactgtgtgtgacacacagcggtgatacgctcttcactctgtgtgtgtgtgtggctctacccgcaactatacagcgtgttgtacacacactgagacgagagcgtgtctgtggcgagtcatacgagagcgtgacctcatacacactgtgtggtctttgtgtgtctattaccggtgtgggggagaagaccaccatcatatctataatctgctgatcttctatgtggttatgtggtgatttggggggatccatatcctaatcatgtggaaggacagatgatctttggtgtgtggatcctatatcataatgtaggtcatcatccggagcccctgtgaactggagaacgttgtggacttacctggtcacaacatcagccggggggacaccagcgttgaccaccgccttctctctctctacctgtgtgtgtgttacagggagcacgccgggactctcgagacacacaacatgtgtgtgactacgggggcgcacactctgctgggacacacactttctcacatctgcggggggctgtgaacgtgtgtgtgggagaacagggtgggttgtttttacaccgggggggggtgtggtcatacgggggagtacctacacn

SEQ ID NO: 565505 - DNA, 584 bp, Homo sapiens
cgctacaaggaagtctgtttggtcagacttacgatctctgttttaacctaattgttcgctggttgtccaaactccaaaagggagcaggtataacgaggtatgtccaatctcctttctgtctgtcgtagcctggaaggtagttttccacgtcgctcccgggtctccttggacaagagggtgttagagtaggccactaggcagacatgaacagggcaggagaggcccccaactaggaatgtcaggcggtcatcaggtgatggtcaggcagttgtttaggtgtctctctaaaataataattggtcactgccagcaccagggaaagacagtctcacaacagatggaaaacacctaaagcttctgcatggcggaataaggaaaagaaagaaaacacctaaggctggtgacagcagcttccttagaggatctcaggagttgggtgaatgggctccagcaagcacactgaggtgaaatggtggtgtttaaccggtatatggccctcctctagaaacacttggctggtaagggaagaatgcctcaagtgagcatgcgcgcaactgagcacaaaccctcaaaaggagcttccg

SEQ ID NO: 565506 - DNA, 163 bp, Homo sapiens
aggctcgaaaagggggaacggcagacggatacttaagcgctaattttaacagattaaacaagattgtgatcaccatgataccagggtgttaatctttatgtgaaaaatctttattattgtctttatgattaacgtctccggaaagagttttctccatttggta

SEQ ID NO: 565507 - DNA, 573 bp, Homo sapiens
ccttttcccaggccctccccttcccactggttttggacctcgctattcttccccatgcctgcctacgccttccgctacattggcagcccccactcagcacctagtggagcccccccctgccatgtcgcccttgaccgtcccgtctgcccgtatcatcgtcaccagtccaattctctggctatcctagaatcctgtcgccctaatcccagcctacggtttcacacttctagtaagcctctacctgcacggccacacattaaaaaagacccagggctgatcaccggcaccacctcacagaagcgggcgtcccgtgcacgtgcccaccttacactgtcagggaagaagcgccgaaaactcctcccgcagatccggcttgccccgaaagagaagacagccctggaagtggaagccccttcaaagcccgcccggactagtgaaccacagctccaaaggccaaagaagaccaaagcccccccggatgtagaaatgaaggaccctgaagatgaggagctaaacctcttcccctagaagattttcaactggagcccgccttcagactccacgtggttgttt

SEQ ID NO: 565508 - DNA, 353 bp, Homo sapiens
tcactctatatgacaacctataagagcatggagaagcaagaaggaggatctggtatatatcttctgggcccacagagtctgcgccacctaaagagcaaaatgatttatagccagctccaaggacgccatcaagaagaagctgacagggatcacagcatgaatagcaagcaaactgctacgagaaggtcacggaccgatgcaacctggcatagaagctggggggcagtgccgtcatctccctagagggcacgcctttgtgagccccttctggacccctgcctggagcatctggcagacccacacctgcccttggcagtagcaggctgccaccttactgacagagcggaggggca

SEQ ID NO: 565509 - DNA, 385 bp, Homo sapiens
tgactcagtgtcgacgagagtaccgacgaaatcccacaagaacaggcggcaaaaaacggtccgtgggtcgctgtgtgcgtctcacgtgccattgaaatagtttgcctccgggtgatggactgacgaattgcgtcggtggactggccaggatgaaagcaggaacccctctgacagttgtacaccgaatcctcgtcggatcgagtagtttcaccaccttgacgcgatcttcgaggttcggacaggtggcgtaaccgaaacttgtccggctgccacgagaagtttgatgatcgatggcgccaatgcccagggattcaccgtcaaggcggcaccggtttccgaccccatgagcatggtcccagtaagcgtcgtggactccggaaatgac

SEQ ID NO: 565510 - DNA, 120 bp, Homo sapiens
tctcctcgcatcaaacttcgctcacattggacatcagctgcagagctttaaaaatgactgacgttggctgggcatggtggcttacacctgtaattccagcactttgggaggccaaggcag

SEQ ID NO: 565511 - DNA, 92 bp, Homo sapiens
gggtcgacacggccgtgtattactgtgcgaaaggatctagggatcatgcttttgatatctggggccaagggacaatggccaccgtctcttca

SEQ ID NO: 565512 - DNA, 282 bp, Homo sapiens
tttttgttgtatacaaagatgactttatacgctgctaacatataccaccattaaagtacatgtgaggtgtttcttttgggaatgaaaatggatttgtataaatcccttcttggtggcttctgtcataaatacatgtttgcaaaataactttcttgggctcgggtacaatctattgatactggattgaatgaagtgaagttgctcatgtgacaactgaacaataactttattctgatcagctccacgttacctgaataaatgggctggaactaagtataataa

SEQ ID NO: 565513 - DNA, 111 bp, Homo sapiens
acctgccaagctgactccacgaagccccacaaattgctctccacagaatcagaactctggctctcacatgttttccctccagatatcaggaagcactacgaggctatagtt

SEQ ID NO: 565514 - DNA, 240 bp, Homo sapiens
  misc_feature (75)..(75): n is a, c, g, or t
  misc_feature (178)..(178): n is a, c, g, or t
taattttttaaaatggatatgaagtcttgctatgttgcccaggctggtctttaactcctggcctcaagtgatccnccgggctcagcctctcaaaatgttgggattacaggcttgagccactgtgcccagccagatatttttaatggtgatattttcacctattttagctgttgtttcnagtatgatttttatgttgactctaacctgtggccttactaagttcattaattagttcaagtt

SEQ ID NO: 565515 - DNA, 118 bp, Homo sapiens
aaaaaaaccccaaaaaaaaacaaccaaaaaaaaaccttatttatgtaaccaaataccagctacctgttccccaaaatcctactgaaaattaaaaaaaaataaaaactaagaacaattt

SEQ ID NO: 565516 - DNA, 897 bp, Homo sapiens
cacggtggctcacacctgtaatcccagcacttggggaagctgaggcgggtggatcacctgaggtctggagttcgggacaaacctggccaaggggcgaaaccccgtctctaccaaaaatacaaaaactagccgggggtggtggcacacacctgtagtcccagccactcaggaggccaaggcaggagaatcactcgaacccaggaggcggaggctgcagcgagccgagatcgcaccactgcactccagcctaggcgacagagcaagactccatctcaaaaaaaaaaacaaaaacaaattagctgggcgtggtggtgggcacctgtcgtcccagctactcgggaggctgaagtgggaggatcactgtgagtcccgggaggttggcggttgcagtgaacctaaatttgcatcactgcactccagcctggttgatacattcgagaccctgtccaaaaaaaaaaacaaacaaaaaaaaaaaaacctgtggggggcgcccgtggcccccaaaaaaatttttcacaaccattcggtggggggcggggccccatgatccgcacatgagcacacggggactagcagtggtcgccaaagaaatcggggcccggaaccaagcggggggtctcccccccaaaaaaaagacgccggggggaccccgggagaggttgggaacgaaaccccagaggggttcgcaaggactgaagggtccacacaggctgtcccgacgacgccgatacatgcccagccgcggggggaagactaccacacggacgccactacgacagatcagttcacggagaacgttcgacagacgccaacagatctcgacgaaatcaccacccgctgaaagtgcgaaagacctggtaggagccacgaacaccattacaatcaacctagcaccaa

SEQ ID NO: 565517 - DNA, 336 bp, Homo sapiens
  misc_feature (6)..(6): n is a, c, g, or t
  misc_feature (21)..(21): n is a, c, g, or t
  misc_feature (67)..(67): n is a, c, g, or t
  misc_feature (74)..(74): n is a, c, g, or t
  misc_feature (319)..(319): n is a, c, g, or t
  misc_feature (321)..(321): n is a, c, g, or t
  misc_feature (326)..(326): n is a, c, g, or t
  misc_feature (328)..(328): n is a, c, g, or t
ttttanccagtactctgggtncaataaataatatgtggaaattttaagtcctccaattccagcattnccagtgngttttgacagtgtgtttatgtggaatgtttaaggatatacaattgtactttatataaattggttcttgttcttcttaaatgtgacatgaaataattgtgctgctacattatactggaaattaacaggggaaaagggaagacctcttggctcccttgagggttctgctagtggtgttagggagtgggttacaactgagcttttagtaaccatttaaccgtatgtagacttggtttctaattaaaanangaatntntttttcca

SEQ ID NO: 565518 - DNA, 778 bp, Homo sapiens
  misc_feature (719)..(719): n is a, c, g, or t
  misc_feature (750)..(750): n is a, c, g, or t
  misc_feature (760)..(760): n is a, c, g, or t
tatagataactgcattttattacaaattgaagctttgtggcaactgtgtcaaggaagtctattggcaccattttttttaacagcttgtgctcaattcctgtttctatcacattttggtaattctcacaatatttcaaaccttttcattattattatatcttttatggtgatctgtgatcggtgattcttaatgatactattgtaattgttttgggacgccatgaaccatgctcatataatatagcaaacttaattggtaaatattgtgttctgactactccaccaactggctgcttttttatctctttctctctaattgtgtgttcctgttccctgagacacaacaatattgaaattaggccagttaataacctaattaattggcttgattcaattaggcctctaactaatgatgatggtctctaactatttaagtgaaaggaagagtttcacatctctcactttaactcaacagccagaaagaattaagcttaatgaagaaggcatgttgaaagccaagatatgctgaaaactatgcctcttgctccaaacagcgaagttgtgaatataaggggttcctgacggaaattaaacgtgctactctagtgaacacatgaataataagaaagcagtacagccttattactgatatggagaaagtttgagtagcctagatgggagattaaaccagctacaacattcccttaagccgcctaatncacaggatggtcctaattctcttcatattangaaggctganagaggtgagggctacagg

SEQ ID NO: 565519 - DNA, 241 bp, Homo sapiens
agttctatgtcatcaaggatattggctgttgttttttttgttatgtcctttcctggttttggtattagggtcatggcggcttctcagagtaaattagggagggttccttcttcctctatcctgtagaatagtgtcaaaaggattggtaccaattcttctttgaatgtctggtagaattctgctgtgaatccatctggtcatggaatttttttggttggtaatttttaaattaccatttcca

SEQ ID NO: 565520 - DNA, 389 bp, Homo sapiens
cacataatacataaagcataaacattaggataaacacgtgcagtgacaacaatgacatcccaaaacaaatctacaaagtacgcacaaacggaatgatccagacattatccatagatagtaccttattatcacattcagcttatacaaataatgccaagtgcagtgaaaagttacaggatgtaccatccactgggtgatgtaggatgggagagtctcttccagtaccggtcatgtgacaattgcggaacatatacctactgactggagtccagttgggcttataccagacaaaaggtaaaccagggaaggtctcacttcctgaagagaatcacacttaggacatggcagagtctgcattaccttctagatacatgaacttaccagagctc

SEQ ID NO: 565521 - DNA, 97 bp, Homo sapiens
ccgcatctcacacgtgcatgtccccgccgccgcgccccgcagcgggctccgagtagcaggccgcctgccaggtactgagacgcctctccggtgcggc

SEQ ID NO: 565522 - DNA, 1440 bp, Homo sapiens
atctgctgcagtgctctgagccctaggtttcatcttctcttctctcaccgtaggctggccctgactggcactgctacttacgcaacactcactcacctagcacactcgcatactgacacgcacactgtacatacgcttgtagcaccaccttccagctactgctcctactcaactaggacgctgtactttgccactcactacggaggcattcatctcacctgactttccccatattcctcagcgctacaccccctagcacccaaacccatacgtccacaaatcccacttctcacatactcactacttcactcgcgccgctacacactcctaacatctctcttcccaccacacacctattactcggaccctactccgcgacactgcccccgcacgctctacctcgcgacctagccccgcactgacaatacaccccacactgcaaacccactccctactcactcctgctagcgcctcactctcacttctcctcctacacccagcccacgctcacctactctacacctacacctccctccacctgcactctctgcagcacacgccccctctccgccctctccgcacaacgccgcgcacacacacgcctccccctacacctacgcctacgccacaacgcacacccccctacccacctaacaacccccggcgcacggctgcaccgccacctacctgcgcactgtcgcccacccgcacccgcctaaccccaccacaccacatcaccggcaccacgcacaacgccccggcaactcacccactaacacacaccccctacgcaaccacacaacacaccccggcacaccgcgacacctcggaaacggccccgccctcaatcacacgcccgatgcgcttacctccaacggcccccaaacacaccgcccaactggggcccctcccacactgcaacccataccgcaccggccctggaaaccaggcccacattccgagggccccggagcaactgctcatccagccatcccaggcagagcacccccatcaacaacagcctggaatggcacctaccgaccacgcagcataacgctccatatcctcatcactgtcaccctggggcccgctgggcaagggaccaatactccccacgacaccactaacccctcccacacaacagaaacatccaagcgggcaattcaacccacccacccgggttccaacccccacacgccacacccccgcacacagtgcgccacaacgcctaccacacacactcgctccccggcaacacaggacacaacagcacagaaccaccggcagcgcacacaacacgcacccaacgtcccaacacaccactacgacacctctcgcagccccaccccacgccaccaacaatggtgcagcccgcaccgcaccctcacacacaccccgcggtgacacccaccacaccacacaaagcccatcccaccaaca

SEQ ID NO: 565523 - DNA, 398 bp, Homo sapiens
aaacgatcatcgcccgcagaggaaaattctcggtgtggataggcggctccaacctggcatcgatgtcaacattccagcagatgtggataaccaagcaggagtacgaagaggccggccacttccatcgatacaccgcaaatgcttctagacacaatccacatccagcaagcgacttctcaagacgacgaatcttctcaatgggggggaagctgagctcaagacaccccgcaatcactatctttgaaacaacttccgttgctgacatcgtaaactgacaaagtgtttataacgtgtacatacattaacttattaactcaatttgttataatacgaaacaaagacctgtggaagaaaatggaaaacttgaagaagcattaaagtcattctgttaagctgcg

SEQ ID NO: 565524 - DNA, 162 bp, Homo sapiens
cccttcagccactcgccggagctcaccacgaaattgcccgcgccatcgggcttgccgtagaggttgtagtcgtactcgcgcacgacgtccttgatgccggtggcgtcgcgcaggctgcggtccgtaaaggaggtggcggagtagagccacatcttgcccgtg

SEQ ID NO: 565525 - DNA, 107 bp, Homo sapiens
tcgttattactctcagcgttctccgtttgcggcctgacctacttagtattaccctttttaatcttgtcaaaaattacacagacagggccctgtcgggctagtcgggg

SEQ ID NO: 565526 - DNA, 182 bp, Homo sapiens
cgtgcatgactgctgtcacatatacatgcgggtctctcctaagaaccctcttgggccgggatggtagtcacacctgtaatcccaacaattggaggccaggcaggcggatcacttgaccctgggagtttgagaccagcctgggcaacatgaaacctcatctcaacaaaaaatagaaaaattag

SEQ ID NO: 565527 - DNA, 183 bp, Homo sapiens
ctgttcccacatccaagcataggtctttctgttacgctgtttgaacttgtttaaaacttgtggccaagcatggtggctcatgcatgtaatcccagctactcaggaggattgcttgagcccaggagttcaagaccagcctgggcaactgggaccccatctctacacacacacacacacacagga

SEQ ID NO: 565528 - DNA, 293 bp, Homo sapiens
cgaatgtacaatgttaagacagggaattttgtgttccattgacttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctc

SEQ ID NO: 565529 - DNA, 1505 bp, Homo sapiens
ggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgtgcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcccgcccttgcagtccctatttcaaaataaaattagtgtgtccttgcc

SEQ ID NO: 565530 - DNA, 213 bp, Homo sapiens
ctggaacgggggagatgaatagagacgaccgagatcatgttgaaggattatgcggtgcattcagacacacctggacggggtgcttcaccatccccatttgttggggtgctgcctgggggagctggatctccaggttctcggacgcccggctccctgcctctggtcttggccgcctctatgcctttgactcgtcgggcgtggcgatcaccttcg

SEQ ID NO: 565531 - DNA, 805 bp, Homo sapiens
  misc_feature (46)..(46): n is a, c, g, or t
gattcggaacgaggtgaattcctctctgctgggcggccttgcacgncacttttctcagcaagaattcccaaagtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcccgcccttgcagtccctatttcaaaataaaattagtgtgtccttgcc

SEQ ID NO: 565532 - DNA, 1749 bp, Homo sapiens
ggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgtgcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcccgcccttgcagtccctatttcaaaataaaattagtgtgtccttgcctgtctgtggcatatttgtgcatgggacagggcctgtggtggggtcacttgagttgagccggagcacatgggggaaggggtgggcagtggggcaggaggggctggcctgcctgagtgggaagcacgcccttgggctcacactctcactgagccttgctggtggccccaagacacgcaatgtcaggccatggctgggtcaaggcagaaggccttggtgcacacccaggggccatagtcaacgaagc

SEQ ID NO: 565533 - DNA, 973 bp, Homo sapiens
  misc_feature (23)..(24): n is a, c, g, or t
atgctgagacactctcttattanncaccgctacagaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcccgcccttgcagtccctatttcaaaataaaattagtgtgtccttgcc

SEQ ID NO: 565534 - DNA, 881 bp, Homo sapiens
  misc_feature (213)..(213): n is a, c, g, or t
  misc_feature (243)..(244): n is a, c, g, or t
  misc_feature (683)..(683): n is a, c, g, or t
  misc_feature (752)..(752): n is a, c, g, or t
caaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccacctnccattatcaagtctgtgacacaatggtganntttcgctttaatatgatttgctagggccaggactagggtgaggtgagcgaggcacctagggcgcaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggntcctccctctcctctttctgctccatctcctaaaccttgcttcccagcaccaactttttttaaagcctnctactttcttcttctcctaagaaaaacctgctctcaagaaagggataaattcatttcctttgagaatataagggttaatggctccttttttggggggcaggtgcctttttaccaggggaaaagccttaa

SEQ ID NO: 565535 - DNA, 1299 bp, Homo sapiens
ggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgtgcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttgtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcccgcccttgcagtccctatttcaaaataaaattagtgtgtccttgcc

SEQ ID NO: 565536 - DNA, 265 bp, Homo sapiens
tgatctaccgatcttcaaacacgcaactgcaggtacggagtgtatccagccttggagcgtgctgtcaggagcaggcagcacttgactcacagctgtgtgtgatgcttgttcgctcagcttctccatttatgagatggggagaatagtcacagcctcctcaaagggttgtgcaaatccaatgtgataatttgtggaaaagccttaacagtggcctggcgcaaaacaaatgctcagtggattgaagcttgctattattattgtcgtt

SEQ ID NO: 565537 - DNA, 232 bp, Homo sapiens
  misc_feature (3)..(3): n is a, c, g, or t
  misc_feature (113)..(113): n is a, c, g, or t
agnaacaatgtattttattgtttgaccaagctctcttcagagtacgtgagttatttctctttataaatactatagcctcctattcaaaatgaattactttatttttagcaagncttatttttataaacaaattaaatgtcatgtttagatgcattttatattcatttccacacctttttatactttcttactaaagcgatgatttagtttcttacccagttcgtccctgtac

SEQ ID NO: 565538 - DNA, 158 bp, Homo sapiens
gtacgacgtagcgtaaattattggtgagtttagaggggggcagctcattggaagccctcatgagtgcagggcccgccacttgtccagagggccacgactgggtgatgtacttgagccccacaggccatctggtgatgagccgcgttttcagtccacca

SEQ ID NO: 565539 - DNA, 150 bp, Homo sapiens
gcgaggagaaacggaggtccatgagagatgacacaatgtggcagctctacgaatggcagcgcctcagttttataccaacagagcaccctccctcgacacagactttgagagtccaaaccatggtaaatatttcgaccagacaatgactta

SEQ ID NO: 565540 - DNA, 126 bp, Homo sapiens
cgcggccgtcgggtgtgagctgcgccgaccgctctgagggctcgtggcccaaccgcgccttcgcggtccctgccgcaacagtccaacggttaaggcgttttaagaaaaggatagttgggtcggaac

SEQ ID NO: 565541 - DNA, 451 bp, Homo sapiens
tatcacgggcaagaggcgtgacctccaagagcagcaactcttgaacatactcagacttgtgaccagagaattatgcggtgactgaacagttgcaccagaagcaacagctacatcagggttgatgctcttatgcagtgcttttcccttgaagacagtcttgacgccgcttctgcatctatgaggatacgagtagaaccaccaaccaggacaatatcatgaatctgtgacttgtctagtcaggcatctcgaagggcttactctactgagtccagggtgccacggaaaaggtcagcatacagtactatccaatcgggcacgggtaatgcaggtatagaaatcgattccttcatagagagcatcgatctcaatactggcctgggtgctggaagagagggtacgctatagcacgttcaccagcagtacggaggcgttttacagatctcttgtactc

SEQ ID NO: 565542 - DNA, 404 bp, Homo sapiens
gagagagagagagagagagagagagagagagagagagagcgagagagagagagagagagagtagacacagactgccacttactcttacagtcctcgaaaccttcctcgcacctgctcgtctgctcccggtggcctgccgtgctctctctcccgcctctgctgtccctgtctccacagcacatccttgtcccgacgtgcactttctcgccctgtgcggctactttccagccccctatgtgtaccttcctcacctgcgtggtgtctctgtgcgtacctggctatgcctcagctgctcttgcccactgccttctcgtctattcttctctccatgctctatggactctctcgctctgtctgtgactgccctgcatgtgtgtcacgcttctgccatcattggctctgcc

SEQ ID NO: 565543 - DNA, 1552 bp, Homo sapiens
taggggaatgcaaaaactttattgaaaggaaagtgcaagtgaaacattgtggtggaaacctttaaagaggggaaaactttagaacacccccccctcaagcgcgaggaccagagtgtgcagaaggtggacctctttcgtggagtgtggtagctcagcacgaggggtgcgctccatctttccaggctgtggttctcccagagacaaagagaatcaaaccctctgtggcgtggactcgaggaagggaagtgcctttccttgatcgtgggaactcttggcctttgaacaatctctgcgaagtgggtgtccacgtgggcctccaccttcgagagagaggtggagtggctctttcaccagagtctcagagggcgctctctctcacacgcaaagaactctgtgtcaattccccgacacttctgtgagagacacggggagccactcagaggggtgtccagggcgtgtgagacacactctatttctccggtggacagtgtctgtgcctccagcctcccagacacagagggggtgtagccggctcccaaatcttctcccaccagactgtggtatctctccccggagccaaaagatactacaacccctcagtgccaggagtcacccaagagggaaggcgaagtggcctctatcctgtggggcaccatggggacactcttttggtgcccctgtgagacagatttctctcccaaagggggtgtggctccaccactcgggggacacccccccaacgttggccgcagagagtgtgcacaggggctccttataacccccaaggaacaaggggcgcaccgcagcacagcggaaaaaacactccgctggaccagtccccgaaaccgtcctcgaaagagacccgggacgacaccccaggcggtgcccacgcgggggggaacgaccccataacacacggggagcacgctcgagaacaccctccacgacacagagagtccgagcggaacccacataccatcccaccaaacccctgaatgacccccccacgaccaagaggaaattcaaccgcccccatgcccggtcgccaccgacggaggaggacatgaccccacgccccaagagccccccagcggaacatcaccaatgccccgtgtgaacacaacttcccccacagggcggacgcgccaacacatgcaggcgaccccacaccacaccgaagcatacagcgccggccacaaccccacagaccggggcgacatcagcgacaaaaaatcttggcggcccccaccagcttgaaacaacgagcgcccaccgccgacaagcggacgaaacccccaccgggcagacgtccgaacacaaacagagcggcgagccacccctcacacagaggactacccagcgcagacaaacacccacctagacgaacaagaagcacgaccacaaccccgtacatctcgacaaccagcagggcagaccccaccagcacggaagcaggcggcacccgccaccgaacagaggactacagcacaacgatcagacacacgactcccaccagacagcacaagacactcgagtcaccgcccgccatcaa

SEQ ID NO: 565544 - DNA, 801 bp, Homo sapiens
ggttgggggacggttgtatatcaaggtactactgcaaacatattgcaagaagctgatgtacctcttctatcaaatgagagatgccaacagcagatgccagaatatacaactattactgaataatgatgatatgtgcaggctatgaagcaaaggaggaatagatctcttgtcagggggattcaggaggaccattaatgtgccaagaaaacaacaggtggttccttgctggtgtgacctcattgtggatacagagtgtgccctgcctaatcgccccggagtgtatgccagggtctcaaggtttaccgattggatactatgttttctacattagagcatttcttaaactaaacaggaaagtcgcattattttcccattctactctagaaagcatggaaagttaacgtgtttcgtacaagaagctcttcaccaacagtgaccaaaggtttttattcttacctatgtcaatgaaatgctagggggccagggaaacaaagattttcaaaaactacataacaattcacccatagcaatacagaataactttaaaaataccattaaataacattcgtattccatggtgaacaggtatttcttcacagatctcattttaaaaaagttcttcactgattattcttcattaacttactggtggtcacagggatggttactttcaaaggcaataccatagattagaaatttgacccgatttaacacaggaacgccactcactggtttccccagcatttcctgtcggaataacgggcaaaattctagaccgatattggcgcttgaaaccatggc

SEQ ID NO: 565545 - DNA, 139 bp, Homo sapiens
ccttgggtcccttttttcccccccccaaaatgttcccctgggccttgccccccctttagggaaaaagtcccccctgggcccaaggggggttttttgtttctcctaacctgcctttccataaaaaccttttttcggggga

SEQ ID NO: 565546 - DNA, 1033 bp, Homo sapiens
  misc_feature (22)..(22): n is a, c, g, or t
  misc_feature (24)..(26): n is a, c, g, or t
acatcgctagggtcgaggctgngnnnaatcggacgagcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcag

SEQ ID NO: 565547 - DNA, 278 bp, Homo sapiens
gtgtggttttggttttaaatctgcaaagtccttggcacaagtctcccaatcgggttgggagtcttcccttctgaggtttcccacctctattctacgtagaccctgcgcttctcgtgccaggcgtggtaccactggatgaagcgctgggtgctctgcagctgggggtgcaggcagtgctcctgacctcggtaccgggacacgctctggggggtgatgataaccatcttctccgtcgcggggcgggtacttgggctccattcccagttggctcagagggg

SEQ ID NO: 565548 - DNA, 484 bp, Homo sapiens
agatggtgtttcactttgtcccccaggctggcggggactggtgccctctagggtcactccagcctccggctgccgatgtgatgaaagtttcgggactagacattgcgagtgcctgggagtacatgggctcaccgccagtcttgatgatggttcatttaaagatttggtaacctttgagtacgaacggagtgaacctggggtgacaagtctggcggccgccgcaggtgatactagctacacaacataccgtcgccttaccagtgacagaacttgccaggtggagctataagtgagacctgaggtgccatgtctagttgctggtgaaaacaagactcagacttcatctgacgcttaacgaaaacagggatgaggccctagccctgcccgactggtgagcgcagagttgatgtgctacggctgcctatatgaacagaggagacgcctgtgtgcgatccctatatgaaagtgccagcgacatccctat

SEQ ID NO: 565549 - DNA, 1359 bp, Homo sapiens
  misc_feature (22)..(22): n is a, c, g, or t
  misc_feature (24)..(26): n is a, c, g, or t
  misc_feature (1057)..(1057): n is a, c, g, or t
  misc_feature (1060)..(1060): n is a, c, g, or t
  misc_feature (1062)..(1062): n is a, c, g, or t
  misc_feature (1075)..(1075): n is a, c, g, or t
acatcgctagggtcgaggctgngnnnaatcggacgagcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagaaaaaaaaaaaaaaaaacaaaaanaananaaaaaaaaaaaanaaaaaagggggggcgaagtaaaaagagctcccacaagagggacaaaagagtgcaggaagaccaagatagatggacaaaagggagacccaaaagagggcgaacaaaacagacgagaggcgcggcgcagagacgtaaaccgagcgggacacaacagggaaaacacaggagaaaggaagcacacaagaggagaaggacacacaaaaagcgaggaaggaaacaacaagaggaaaacctacacgagcgagaatgaacagaccaagacgaaaaaaaaagaaaggacaccg

SEQ ID NO: 565550 - DNA, 969 bp, Homo sapiens
  misc_feature (22)..(22): n is a, c, g, or t
  misc_feature (24)..(26): n is a, c, g, or t
acatcgctagggtcgaggctgngnnnaatcggacgagcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccagacaggcgccagtggagtgttgggaaatgctggcagcaggggcggaaggcggaagactatgtggggagggcggggggtgtgctgtgaggccgaagcccagaggcccggaaggcccgggggtgaaaaacggggc

SEQ ID NO: 565551 - DNA, 1172 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagcatcccgccgctgttgtccgctggggattttgtggttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaa

SEQ ID NO: 565552 - DNA, 372 bp, Homo sapiens
cttaacaggcttgtgtcacaaattgtctgcagtgaagcctgatcactactcaggcctactgccctgtgtgtcagcagaaagtgaaggaggacctgtgcttccatgctgagtccactctcaacctggacagtctggggccatgccaagaaacgcatccatggccccctaagcttgttctactccaggatggcctggctctcaggcaggttctgaccctgtgagagaccccaggaagggctcttctttgccatgtcccaatcccagtctccattgctctggcccatcccagccgcacaagcccatctgcggagaccacttgtcaatgacaagacattctggggggcccccacttgctgaaggaggccaatccag

SEQ ID NO: 565553 - DNA, 2927 bp, Homo sapiens
  misc_feature (1725)..(1725): n is a, c, g, or t
  misc_feature (1729)..(1729): n is a, c, g, or t
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccggctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttnacgnggctggagtgcagtggtgcgatctcggctcaccgcaacctctgcctcctgggttcaagtgattctcctgcctcagctcccgagtagctgggattacagtcgcccaccaccatacctggctaattttttgtgtttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565554 - DNA, 406 bp, Homo sapiens
ggacgcgtgggtcgacccacgcgtcgggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcag

SEQ ID NO: 565555 - DNA, 2658 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccggctcaggagttcaagaccagcctggacaaggcaacatagcgagaccctgtctctactaaaaatacagaacttagctgggattacagtcgcccaccaccatacctggctaattttttgtgtttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565556 - DNA, 813 bp, Homo sapiens
aagccagtcggcaggaccagcgggcgggggctcacgacaaaagctggcaggctgacagaggcggctcaggatggacctactggctactgaccgtttggctgtggtgatcccgagattgtgtgtaggtgtgagatcaggcatgagttccgtgggcccggtgtgaacccaaggagagtttggctgaacaccagaagtgggctggttccgcaaatgacaatctaaagttgcgactctagtattcagaagaggagagcgatcctcgcgacctaacaaggaggccttgccctccgacgttcctgagaaagctagcttgcctggaaagtgcccaggaacccgctggagcctgggggaacgaagatccgaacctatcgaaggcttctgtcatcactcaggtgttccatgtacccctggaggagagaaaatacaaggataatgaaccagttaggagaaggtgaactagcaaaaatctgccttgagatcatgcagagaactggtgctcacttggagctgtcttatggacaaagacaagggctctccatcatggtgtcaggaaagctggatgctgtcatgagaagctcggaaggacatcgtttgctagactgaagaatcaggcctcagcaactgttgccattccccaaagaacagccatcgcttcgttgatggcaaacaatggagagaaacgggaggatttggagctaaacactgggagcaaaaatccaatccgccggccagagtaaccgggcattcggttaggatcaggggccacaaaggctcgaacagcgcggctgaggttaaccatctgcgagagaaact

SEQ ID NO: 565557 - DNA, 198 bp, Homo sapiens
aagtcgcggtcaccgttggggtctgagtgggtccacccgaggactaggacatgcgagggtcatcgtcacttagggcttctcgagttggtccagcatctgggctccagcgacagatgaaagggtcatctattacttaggaacctaaactggtaccccacagagacccaacattcccaacaggtgaccggctgacttcgc

SEQ ID NO: 565558 - DNA, 761 bp, Homo sapiens
  misc_feature (459)..(459): n is a, c, g, or t
  misc_feature (462)..(462): n is a, c, g, or t
  misc_feature (464)..(464): n is a, c, g, or t
  misc_feature (477)..(477): n is a, c, g, or t
ggacgcgtgggtcgacccacgcgtcgatcaacctcgtccaggcaaagaagctggtggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagaaaaaaaaaaaaaaaaacaaaaanaananaaaaaaaaaaaanaaaaaagggggggcgaagtaaaaagagctcccacaagagggacaaaagagtgcaggaagaccaagatagatggacaaaagggagacccaaaagagggcgaacaaaacagacgagaggcgcggcgcagagacgtaaaccgagcgggacacaacagggaaaacacaggagaaaggaagcacacaagaggagaaggacacacaaaaagcgaggaaggaaacaacaagaggaaaacctacacgagcgagaatgaacagaccaagacgaaaaaaaaagaaaggacaccg

SEQ ID NO: 565559 - DNA, 2826 bp, Homo sapiens
  misc_feature (1725)..(1725): n is a, c, g, or t
  misc_feature (1729)..(1729): n is a, c, g, or t
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccggctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttnacgnggctggagtgcagtggtgcgatctcggctcaccgcaacctctgcctcctgggttcaagtgattctcctgcctcagctcccgagtagctgggattacagtcgcccaccaccatacctggctaattttttgtgtttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgttttttta

SEQ ID NO: 565560 - DNA, 761 bp, Homo sapiens
  misc_feature (2)..(2): n is a, c, g, or t
  misc_feature (19)..(19): n is a, c, g, or t
  misc_feature (30)..(30): n is a, c, g, or t
  misc_feature (459)..(459): n is a, c, g, or t
  misc_feature (462)..(462): n is a, c, g, or t
  misc_feature (464)..(464): n is a, c, g, or t
  misc_feature (477)..(477): n is a, c, g, or t
ancccccttttccggtttncccccaaaggnggcccaaaaaaaaggaaaagctggtggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagaaaaaaaaaaaaaaaaacaaaaanaananaaaaaaaaaaaanaaaaaagggggggcgaagtaaaaagagctcccacaagagggacaaaagagtgcaggaagaccaagatagatggacaaaagggagacccaaaagagggcgaacaaaacagacgagaggcgcggcgcagagacgtaaaccgagcgggacacaacagggaaaacacaggagaaaggaagcacacaagaggagaaggacacacaaaaagcgaggaaggaaacaacaagaggaaaacctacacgagcgagaatgaacagaccaagacgaaaaaaaaagaaaggacaccg

SEQ ID NO: 565561 - DNA, 2807 bp, Homo sapiens
  misc_feature (1605)..(1605): n is a, c, g, or t
  misc_feature (1609)..(1609): n is a, c, g, or t
tggaatacaccagcgcatgctcctcccaaatagtctaacaatttggaaataacgtcttgtagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccggctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttnacgnggctggagtgcagtggtgcgatctcggctcaccgcaacctctgcctcctgggttcaagtgattctcctgcctcagctcccgagtagctgggattacagtcgcccaccaccatacctggctaattttttgtgtttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565562 - DNA, 269 bp, Homo sapiens
gaggctactccagaaccacggtgccgcccacctttgatggccgctgctcctcatatgtcgcacggcacagaccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcag

SEQ ID NO: 565563 - DNA, 2471 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccgacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565564 - DNA, 622 bp, Homo sapiens
agcgggcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacaccctgccagcctcgacgactacctcaaacgaaataatacacaaagagcagcgcagcagtgtcgtgatcctctttgccctcatcaccatcctcatcctctacatccaacagtgccaatgagtcccattacggctccatgcggggcgtagccgcgactgtcaactcaagaagtgagcatcactgacggctatgtccccattctcggcaacaagacactgccctctcggtgcacagtgtggatgtcagcagtcagcactgctggcacaactgggcctgaatcgacggctgagtgtcaaccgatatgatgcaccacatggtatcagtgagtggcaacaaacacctacgcgtgtggccatcagtgtgtccgcgtgctgagaggcccggagttgtcacagaccctgaaacggtcatctctggggccccgacaagatgcaaagc

SEQ ID NO: 565565 - DNA, 212 bp, Homo sapiens
ccccccccccttaggatttattcccgttgattgattttttgaggggctcccaggaaagcgcctccccccctagcaaaagtgcaaaatggggagtgaaaggttgggaatggaggggcagagccaggaagttcccccagaaaagaaagctacaaaaaaaattggggttcctccagggtggcagcaccaataaatagacacgcccggcaccccca

SEQ ID NO: 565566 - DNA, 923 bp, Homo sapiens
  misc_feature (23)..(23): n is a, c, g, or t
attgcatggtcgaggcgggtgtnaatcggccgaggcagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggcctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcag

SEQ ID NO: 565567 - DNA, 2838 bp, Homo sapiens
  misc_feature (1636)..(1636): n is a, c, g, or t
  misc_feature (1640)..(1640): n is a, c, g, or t
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccagcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccggctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttnacgnggctggagtgcagtggtgcgatctcggctcaccgcaacctctgcctcctgggttcaagtgattctcctgcctcagctcccgagtagctgggattacagtcgcccaccaccatacctggctaattttttgtgtttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565568 - DNA, 444 bp, Homo sapiens
caagtaaaatagatatgtatattagagggtctgtacacggtaagctagataaggtcatagcttgtatggaggaagaaaaaaagaaaagaccggtgggaaaccaggaaggagggttaaggtggagaacattacaggcagggccccaattctgtcattacctagtaatatgttttaatacaattcattggaccaggctgcacgtctcaaagacctcatgtccaaaaacagagggggactaggcaattggccaagaccaaaattctagaaatagatcctttcctttatttcaatctaattgggccggagttctattcctaaggtggtcttccaatgggtgtatcccttttttcattctggggcccaacctttaagctccataatcactcataagactatcccagtagatcccaaacttcatctcttcacggagggtctccctcttgg

SEQ ID NO: 565569 - DNA, 131 bp, Homo sapiens
accgcgcctggcacgaatgagtatattactgatatttaccacaaactgacagtaatttttaaacagaatttaaaaatgtgtctgctggctactgtgtgtaagactgaatgtgggtaacgctgggtattccg

SEQ ID NO: 565570 - DNA, 944 bp, Homo sapiens
  misc_feature (22)..(22): n is a, c, g, or t
  misc_feature (24)..(26): n is a, c, g, or t
acatcgctagggtcgaggctgngnnnaatcggacgagcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcag

SEQ ID NO: 565571 - DNA, 2347 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565572 - DNA, 1091 bp, Homo sapiens
tactcgacgagaacacgactgaactgtgatctcgtatcttctcgtttcgttcttggacgagttttctaggcgtcgtcttggttagcatcttgtacgttgctcatcgctgctttgaccctttctcgtgctttatgctggtggtcccccctttgtcgccctgggcttctcccactgtcttcctgttctgctgtgtccgacctccggttcttgtcgtaccccccttcgtcggttctttggctccctcgcgcgtccattccactgggcctcccgtgcctgacccttcaggcacggtcactatgttcagagggcttctttccaggccctgctggggctctgcgcctgaggctcgttcccacccccggtacccttgcggacttgcctttcacgcatccttccggaagtgagcctctccatccctggcgcgcctttattggcctccctggcctctgtccccctggaagactcagtccgtgcccccgacctagccttaggcctgtgccgcccccctgggagggctcctcagagtcaggcctggactggtctggggcccgcttctcccccgggctccgatgtgggcggccctggatgagccgatgctgcacggagggcactcccggcctcgcttcttgacgggcccgccccggatcccccgagcgccccctggctgtcccagtcctctgtctcctctctgcggctgcacgcacgctggaggcgccactgggcttccctatcggagccacggcgcgtggtggcacctggcacgcccaccacggccgctttgtgaagggttcccgctgtcacctcgttggttggaggaccagtgggccctgagaccctggtgacccctggaaagggtgggcctgccccctccgagggtcctgggcctccctagccccggcacgagagtggggcaccacggcacggcccctgggtgctaagggctgggctgcactgtgggtatgcccgagctcctactctgttctaacgagggcccccctggggagcccggggcacacctctggaggccggagaggcccccccgcctgctgccctagtacgtgtttagaataaaaacccgtttgtttttccca

SEQ ID NO: 565573 - DNA, 2172 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccgacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacggctcaatcttagtttgcctccagttaatcttttatgcttagggattaaatgtgtggtttttttttggttttttttttgggagacggagtctcgctctgtcactccagcctgggcgatagagtgagactcagctcaataacacacacaaagacaacaaaccttgcgccagggtgaggacgaggtggcgcccctataaatccccgagacatacagcaagcgcacgcggcccacaaaggggcggcacaccctggaccctgggagcacacaggtaacatcgacgccaacgggcccacggggcactcagcgtggccaacccagacacccgattccactttaacacaccg

SEQ ID NO: 565574 - DNA, 201 bp, Homo sapiens
  misc_feature (8)..(8): n is a, c, g, or t
  misc_feature (10)..(10): n is a, c, g, or t
  misc_feature (18)..(18): n is a, c, g, or t
  misc_feature (28)..(28): n is a, c, g, or t
  misc_feature (48)..(48): n is a, c, g, or t
  misc_feature (78)..(78): n is a, c, g, or t
  misc_feature (85)..(85): n is a, c, g, or t
  misc_feature (98)..(98): n is a, c, g, or t
  misc_feature (102)..(102): n is a, c, g, or t
  misc_feature (113)..(113): n is a, c, g, or t
  misc_feature (122)..(122): n is a, c, g, or t
  misc_feature (150)..(150): n is a, c, g, or t
  misc_feature (152)..(152): n is a, c, g, or t
  misc_feature (155)..(155): n is a, c, g, or t
  misc_feature (157)..(157): n is a, c, g, or t
  misc_feature (176)..(176): n is a, c, g, or t
ctcgtgcngnaaattttntacagtacangacccggatgaactcaatgnatgatgactcttcttatcacactcgcaaangaatgcntttcaaacatcgngacngctagaaccangcactaccngtatctccatccttaaccgtccagtccngngangngggaagttaccttttatangacaaaatttaatcgcgtaaccgtt

SEQ ID NO: 565575 - DNA, 414 bp, Homo sapiens
  misc_feature (15)..(15): n is a, c, g, or t
  misc_feature (20)..(20): n is a, c, g, or t
  misc_feature (70)..(70): n is a, c, g, or t
  misc_feature (410)..(410): n is a, c, g, or t
gtttgttttttgttnccagnagaaaaaaggcctttttaaaatgaaaaggtttccaaaagaaatatgtccnctgtaagtttatgacctgttaaaatattcctagaaagggaaagcctataagaataggactttgggctggatgcagtggctcacacctgtagtcctgtcactttgggaggccaaggtgggaggatcacttgagcataggagtttgaggccaccctgggcaacatagtgagaccccatctctacaaaaaatttaaaaattagccaggcgtgatgccgagtgcttgtaatctcaattacttgggggtctgaggtgggatgatcgcttgagcacaggaggtcaaggctgcagtgaaccatcattgcaccactgcactccaatctgggcaacacagtgatacctncaaa

SEQ ID NO: 565576 - DNA, 1939 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccgtcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 565577 - DNA, 110 bp, Homo sapiens
caggttagttgttcggtagttctcaggcgggcgtctcagagctgttcagagtcacgttggctgcgcggagaccacggtcatatgtaccaagtgaccttgaatgctggtca

SEQ ID NO: 565578 - DNA, 259 bp, Homo sapiens
acccctttttttccaaggcttaattttaaaccccgggttaacctccatggtccgaggttgcctaatttggggcttttccgggattgccgagaaatgcctttttccccaaaaccaaatggtttttttggtttctttttccctttggcccctgtgtttcctttgccggaatccggtttttaaaggccgatgggaaaagccccttaagtccctgaaaattgaaatgttattttttacttttcccattaagctggggggggga

SEQ ID NO: 565579 - DNA, 783 bp, Homo sapiens
  misc_feature (168)..(168): n is a, c, g, or t
tgggagcctgtacctttattcatgcccccctgaccaattgcagtgaaaagacaaggcccttgccgaaaacaattccaggggcctgggactctgggtcccctactgcaagacactttcctggtgacgccaaaatgttgtttaaacgtgctggttgttgtgaccatcctntggggagaaggtcaaaagggggcaaagatccccagggtgccctgaggaagggcaggccataggctgtggtctcccagagcgctggatagtgcgagggccctgtgtgccaccaccttcggggcttaaaaacacaatgtgcagtctccttgggcaggagggaacgtgaaaatgtgggacgcctttcagcttgtggacgcccttaaggagcgttggggtttgttagggggcactcatctacgtgatacccccgtttttaaaccggccacgagggagccactttgtacgcacacaccgctgcctttaggagagacactctactacaacaaacctgtgtgacaactctccccccatctagaaacacgcatgcgaccaaatgtcgacagaacccatgtgagacgcaccacaacccaggccagactgccccacacattcattcaaacaacaccacccccccactctacactccccactccctgttaagcacagtaggacactagcatctctacatccagcgagaacccccacagagagcaactgccacgtcgcacggggatccccaacccattgccccccgcgccacttcccacaccaccacccggaaaacgagcgccctct

SEQ ID NO: 565580 - DNA, 561 bp, Homo sapiens
tcttaggtataaacattagaccggagctcggccacacagtcgagtaaccatgaatcatgctctcgtgtcttgattctgcaagatattgttgctatccgcatcccgacgtcgtcggatacccgtggtacacacatgaggatttatatgcgtgggcatcatcctctgaggcagagtttcgtaattatgctcgagacggtcgtcgagcgaaagtctaatagtgaaaacctcataactgggtgatattggatgcccccacctacacacattcgaagaaccgtatacataaatcagacaggaaggaaggaatcgaaccccccaaagcggtttcagccaaccccatgcctcatgactttggcagaagaaagacagagaagacaaaaaaagtgtgtgggggccggtggggcccggagagttgataaaacatgatcggagcgcgcccaccaagtagggacaaaggggacagagtagtcggggaacgggccagacaagcggggatgcccgcagaaaacgcgggggaggacctggtatgacaaaccagaggcgtaaggggatagacgggcc

SEQ ID NO: 565581 - DNA, 606 bp, Homo sapiens
tcagcgaccttctcaagagtactcaagtgatccgtccagctcagccccaaagtctggggatcacaggcatgagccccatgcctggcaacctagcagtatgcttttatggttcttactttatgtgtgtgtggctgcatagctgatttctttttattgctgaataatattcccttgaatgaatgtaccatggtttggttatccattcacttgtagaagagcatcttggttgcttctattttttggcaattcatgaataaagctgctataaacatttctgtgtaggcttttgtgtggacctaagttttcagctcatttgcgtaaatacgtaggagagtgattgctagattatgtggtcacaagtatgtttagctttgtcagaaactgccaaactgtcttcagacgtggcaggaccatttttgcattcccaccagcgtgaatgagtttctgttccacatccttaccagcatttggtgttgtcactgatttagattttagccattctaaggtatcttatagttttaatttgcaattccctaatgacatacaatgtcatcttttccatgtgcttattagacatctgcatctttatagaggtaatccgtgagg

SEQ ID NO: 565582 - DNA, 599 bp, Homo sapiens
aagaaccggggctgcgtaagcgatcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgcggagcggcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattaaaaaaaaaaa

SEQ ID NO: 565583 - DNA, 104 bp, Homo sapiens
ggatcaaagatacaattgtctctactaagagtaactaaagtctgacattcttgagtccgttgaacatgaggggacaacagggactttccataacctgttgacac

SEQ ID NO: 565584 - DNA, 379 bp, Homo sapiens
tactaagaataacttactacctcattacattaaaaaggaatatagagattgatgtgtaaaaaaaaaaatacgcacattgtccaatccagtgatttgactcatacagttggactgggcacacttaacagctgctagtgaatatatagctatatacaggacttgacactgattcggatttgtgcactctaataaaaaaatatattgatgctctatagtgcagtagcatttcatttaagataaggctcatatcgtattacccaactagttgatcaatgtgattatgtggtaccttggctttaggtttccattcgcacggaacacctttcgccatgcttcccttcctggtaccaccttcagggtcccgagctcgactacgtcg

SEQ ID NO: 565585 - DNA, 172 bp, Homo sapiens
ctttgggcaaggtggacttttaatgtttattatttttttttccgcccaaagttaagggcctaattttgggtattctgggggctgctttcatggggtggttaaatgttaaacaaaacttttgtcaacgttgaaagggttaactttgctggaaaactttttaaggacctttgga

SEQ ID NO: 565586 - DNA, 325 bp, Homo sapiens
ctctctctttggggcccactacgggcgggcagtgaggatgtgtttctatacctgacgagacctgctctacccctgcgcacctggacctcgccaaggcttcccaaagaggctcaggctgcccaacacaggctggtgtgcatgcccatccccagaggcagccgggtagcccggggcaggggccgaggacgagcagcagcagctggcggtcaaacggtacagcctggtggagaagctgggggagctgtgtggctgggtgcccacgcactgggtgagggccagttccccttccccactgctctgtcggccacccccacagagagagcgt

SEQ ID NO: 565587 - DNA, 246 bp, Homo sapiens
gtagctgggcaggcgcctgccaccacatccaactaattttttgttgttttttggttcttttttttgaaacggagtcttgctctgtctcccaggctggagacagaggtgccatcttggctcactgcaacccctgtctttggggttcaagggattctcctgcctcagcctcccgagtaactgggattacaggcgcctgccaccacgcccagctaattttttgtatttttagtagagatggggtttcac

SEQ ID NO: 565588 - DNA, 162 bp, Homo sapiens
cccatcctcctccctgggggggtgcctgattatccctcaggcagggcctttcagtccttgtgggtttgtgtcccccccatttcagttttggcctggctataaggggaggaggaatgggaaagggggctcaggggccaataaactttcccttgagtcctccta

SEQ ID NO: 565589 - DNA, 81 bp, Homo sapiens
  misc_feature (37)..(37): n is a, c, g, or t
  misc_feature (54)..(54): n is a, c, g, or t
agataattatgttcctgaggtctcagccttggatcangagattattgaagtagntcctgacactaaggaaatgctgaagct

SEQ ID NO: 565590 - DNA, 105 bp, Homo sapiens
ccggactccctgcatcagctcctcgacgcttctcgcgagatggagcagcagcaaactttctgcggtggccctgggcggcgtgctactggatggtggccatgcggc

SEQ ID NO: 565591 - DNA, 144 bp, Homo sapiens
gcagacaagacacaagtttcatgaaaagattggcacagctgtatcggcacatatatttgggtgtaagaggaggcacgttcagaaactatgacctactatatcttctttgctttatacctattgactggctatgagagtagttat

SEQ ID NO: 565592 - DNA, 400 bp, Homo sapiens
ggatgttcctttgtctacaataacagtttattagccataaagtctagaagaataattctgttagccataaggtatttcatatatcataccctcctctatctccgttttcccccagttgagttcttgtgaaggagaagggactttaagaacagcaggtcattttaaaaaaatgaacttactctcaccagtaggtaacactgcagtagcaagttcaaatcccaaggcagtgctcaagcaatggccaagtcgtggcttgcttcaaaccaccacccggtcttatcggcactcaatgcatttcaacatccagccagtcacagcaacattcgtttcttcatgcagttccaaactcattctcacaacatccaaagcaccaaagggcaaaccaccgggtcacccgagc

SEQ ID NO: 565593 - DNA, 375 bp, Homo sapiens
acactcatcatgctctcagtaactaagactcttcacacattccacgaacactgtatttaggaggagggtctgttctgtgccaggtgctgggaggcagaagtaaccaggacagggtccttagagagacttactctgcattggaagaggcaaagcaggaccatggtagcaagcccagagcaaacagaagagcagggctattttcacagagcaagctgggcgtggctcacgcctgcactcccagcacttcaggaggctcaggcgggaggatcgcttgagcctagaagttcgaggctgcagtgagctgtgattgtgccattgcgctccagcctgggtgagggaacgagaccctgtctctcagaaacaaaatggcagatg

SEQ ID NO: 565594 - DNA, 195 bp, Homo sapiens
  misc_feature (16)..(16): n is a, c, g, or t
  misc_feature (55)..(55): n is a, c, g, or t
gaaacaaacattagcngcccgaacaactggattgcagatgattacaattgtccantcacagatggcatcacctctactattattaatattagttttaattgccaaatcataattgtatatatttgtagagtacaatgtaatattttggtatatgtatacaatgtgggatgattaaatcaagctaatatatccagc

SEQ ID NO: 565595 - DNA, 370 bp, Homo sapiens
  misc_feature (12)..(12): n is a, c, g, or t
  misc_feature (132)..(132): n is a, c, g, or t
  misc_feature (156)..(156): n is a, c, g, or t
  misc_feature (163)..(164): n is a, c, g, or t
  misc_feature (170)..(170): n is a, c, g, or t
cgacacgatgcnagaagacgacagaaggggatgcgataggaatcatgtctggtcgcggcaaaggcggaaaggcggggagggtggtgctagcgcctcgtaagtgctccgggataactccgggcttacaaaacngctatcccgccgggctcggcgcgntggcgtnnagcgcntttccggtcttatctatgaggagactcgaggtgtgcttaggcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttca

SEQ ID NO: 565596 - DNA, 306 bp, Homo sapiens
  misc_feature (274)..(274): n is a, c, g, or t
aagggcaaaagcttcaagacattggatttggcagtgatttctcagatatgacaccaaaagcacagacaaaacaagtagatcaattggacttcatcaaaatttaaaacttctggtctcgaactcctggcctcgaacgcctgacctcataatctgtccgactcggcctcccaaagtgctgggattataggtgtgagccaccgtgcccggccctaaatttttattttccactctgttgcccaggctggtgtgcagcagcatgatcacaactcactgnatcctcaacctcctgggctcaatccatcctcc

SEQ ID NO: 565597 - DNA, 710 bp, Homo sapiens
tatttggggagatcacatgcggtttaataggtgggaggctgagagcagcatttttaccaaatgggtgtaaaaatgaacggggttccagacgtgtacactgacagttacagataaattttcaaaatctccaagcagcaatttgtgaactcattttcgttgaaaaacaaacacagacaaacaccaaacatgtggagttgtgggtgcccggcgccgggcaataagggcagcaccccagcgggtgtggcgtgctgcgggggagcccgcgtgggtgtgtgtggccggggccctgtggtggtgccgtgttgcgaggggctccccagctctcctctcgagggaactgtggccccagcgaacccccccacactctccaggcgggctgtgaagcccaaagtgcctgtggcccgaaaagaagagagagtagcgcccaggcaagccacagtagcaagtggcctattggagagtgagagcatgtgcgctcgtgggaggcccccgcgcgagggggggggagcacactcttcgtgggggaggacacaatgtgcgggggcggcacatagagtgtgccggagagaacccccaaacaacagcgcgtgtggcgcctgaggagagagaagagtctctcatgagagccaaggcgggtgtaggaaacaagagcgccctgatggggggaggggactcctcaataccacaaaagcgcaaacgtggcgaaacat

SEQ ID NO: 565598 - DNA, 170 bp, Homo sapiens
acacgtcgtaccgcgacctgtggactggtggggactgggtgtgctgctctacgagatgcaggttggcgagtccccattcccaggggatgatgaggaggaggtcttcgacggcattcgtcaacgaccgagtttcgcttaccccgcgcttcctgtacagcaccttcaagtgg

SEQ ID NO: 565599 - DNA, 118 bp, Homo sapiens
  misc_feature (96)..(96): n is a, c, g, or t
  misc_feature (99)..(99): n is a, c, g, or t
gcggccgcctactactactactgctcgaattcaagcttctaacgatgtacggggacatgccagataccctgcctgatacaggggaccaccagactnatnagtttaaaaaggaaaaaaa

SEQ ID NO: 565600 - DNA, 800 bp, Homo sapiens
tggaaagatttggttttggtttccacttgacacagtgaaggaaaaatatatttataaatccgcactggagggaagaggtctttggaacacctccccgcctgggtggggcaagaagacccaaaccagccttgctgggaatgttggctctgggacataaatggttgggaactcctacccccagtagctcaatggcaaccgagactgtttctgagacgcccccaagaatctggatccaaatcccgggacattataaacgagaccgccaaagaaagacagggggctggtctctaagcacattctctcagaggagatgtctgtggggccccctttccacagaagcgccaagcgtgcaaagaggagagggcataagcgcccagtggcgcgggccccggggttataactttataatattccgaaacaagaggtgcagcggacagcccgtgaagcgtggccacgtgggaagtgcacacaagaacggtgtctcgtggagaagcgggtctcaagcgggggaaccgcgccgggcgggaaccgtgctcgcggcatgggactctccaaggccgtctaaccaaaccggcgggaaatgcctcgtgcaagtctccgcagtgggtggccgccttcttttcctcccgccgcaagagttgggcgccgacaagggaccttggacgttggagagacaagctgtgaaagagacgcggcattgtgagagtccaagagcccggagtccattggcgcaccgaaggccaggagactgggcgggccagggacgggcagacttgtgcccgtccaggggggcccccgcg

SEQ ID NO: 565601 - DNA, 244 bp, Homo sapiens
ggtggatggcagccagggggaagcccaaagcacagatatggctgtttatttttaaattttttttgagacagaatcttactctgtcacccaggctggagtgcagtggcatgatctcagttcactgcaacgtccgcctctcaagtccaagcagttctcctgcttcagcctcccgagtagctgggactacaggcgcccgccaccttgcccggctaattttgtatttttagcagagatggggtttcgc

SEQ ID NO: 565602 - DNA, 1802 bp, Homo sapiens
  misc_feature (22)..(22): n is a, c, g, or t
  misc_feature (61)..(61): n is a, c, g, or t
  misc_feature (92)..(92): n is a, c, g, or t
  misc_feature (98)..(98): n is a, c, g, or t
  misc_feature (175)..(175): n is a, c, g, or t
  misc_feature (182)..(182): n is a, c, g, or t
  misc_feature (397)..(397): n is a, c, g, or t
  misc_feature (399)..(399): n is a, c, g, or t
  misc_feature (414)..(414): n is a, c, g, or t
  misc_feature (570)..(570): n is a, c, g, or t
  misc_feature (862)..(862): n is a, c, g, or t
aaggcaaaagagcttaacatgnaaatgcacttggccgggaaaacagggcaagccaaggctntcctggcccggctggccttcatccggaaacngcgggnggaggctgcccggaagaaggaagaggaaaggaaagcaaaagacggtgccacattttcaggaaaacaaaagaaataantctcccngaataagtaactgcaacccgtgggagaagatgccggggacctgggccgcgctgccaggacatctgctatatctcgcccaccctgtgacctggcgccgctgcaacagcccctcatggccaggagccccccatgcctggggcctcctcttcatcttggaacagaaattgtttgggggatggggggggggactgggggaggggtagctgctatctttnanacagaaagatgcagnacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctnacaggtttgcatacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatattnggcagattaaacttgacattatcgtaaaaaaaaaaaaaaaaaaaaaaaaaaaaaaaaaaaaaaaaaaaaaaaaaaaaaaaaagaaaacatatagaaaaaaaaccaaaaaaagaagaaaggcaaataaaaaaaaaaaaatggcgagagccaaaacttacattactgagacaacaaggaagcaaaaaaaatggaggaaaaacaatttaataaaaaaaacatatagcaacactaaaagagcaatcaataaaaaaaacaagataaaagagaaaacacaactcctagccacaacttaaaaacggaaacaaaagcaggagaaagcacacacaaacaaaatatagcgaaataataaaagttgtacaagtaagatagaataataaataaaagaattataatatgtggttaataataaagctatattacaatcagaagattagattaaaaagttaatgagagcaagaaaaaggatataggaaataagacgagatactaaggacaaaaagaacaggatcagaaacacacagcatattatatagacaaatataataattgaataaatttatggaaagtaaaataataaaacaaacacaaacaaacaaaaaaaagtaaaaaagagaaaaacaaaaaagaaggaaagcaaagcgagcgaaggataagagaagagcagggagacgaggcaaaagaaaggagagacaagaaaagaaaagaagataaagaaagaaacagaaaaagcaaagcagaaagaaggaagaagaaacaaaaaaaaaagagaaaagaagaacaagagaaagagaaaggaaggaaaaaaagaacaaagagaagcgagagaaaaagaaaagagagcgagagaggagacaagagagaggagagattaacgagaagcagcaaaagaaagcaaaagaagacggaacaagaaagcaagaaatagagacagacaccgaag

SEQ ID NO: 565603 - DNA, 1855 bp, Homo sapiens
  misc_feature (22)..(22): n is a, c, g, or t
  misc_feature (61)..(61): n is a, c, g, or t
  misc_feature (92)..(92): n is a, c, g, or t
  misc_feature (98)..(98): n is a, c, g, or t
  misc_feature (175)..(175): n is a, c, g, or t
  misc_feature (182)..(182): n is a, c, g, or t
  misc_feature (397)..(397): n is a, c, g, or t
  misc_feature (399)..(399): n is a, c, g, or t
  misc_feature (414)..(414): n is a, c, g, or t
  misc_feature (623)..(623): n is a, c, g, or t
  misc_feature (915)..(915): n is a, c, g, or t
aaggcaaaagagcttaacatgnaaatgcacttggccgggaaaacagggcaagccaaggctntcctggcccggctggccttcatccggaaacngcgggnggaggctgcccggaagaaggaagaggaaaggaaagcaaaagacggtgccacattttcaggaaaacaaaagaaataantctcccngaataagtaactgcaacccgtgggagaagatgccggggacctgggccgcgctgccaggacatctgctatatctcgcccaccctgtgacctggcgccgctgcaacagcccctcatggccaggagccccccatgcctggggcctcctcttcatcttggaacagaaattgtttgggggatggggggggggactgggggaggggtagctgctatctttnanacagaaagatgcagnacagcatttcatatgtaaccatttgaatgtttttgctgtttttagaattcagagcccatggcctggggcctcctcttcatcttggcacagaaatgtttgggggatgggggttgctggggggtgcctgggagatggggtaagaagagctttcatttgtctggtagatagatagcatgtaagggggtggttgtcccaggaggcagctgctnacaggtttgcatacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatattnggcagattaaacttgacattatcgtaaaaaaaaaaaaaaaaaaaaaaaaaaaaaaaaaaaaaaaaaaaaaaaaaaaaaaaaagaaaacatatagaaaaaaaaccaaaaaaagaagaaaggcaaataaaaaaaaaaaaatggcgagagccaaaacttacattactgagacaacaaggaagcaaaaaaaatggaggaaaaacaatttaataaaaaaaacatatagcaacactaaaagagcaatcaataaaaaaaacaagataaaagagaaaacacaactcctagccacaacttaaaaacggaaacaaaagcaggagaaagcacacacaaacaaaatatagcgaaataataaaagttgtacaagtaagatagaataataaataaaagaattataatatgtggttaataataaagctatattacaatcagaagattagattaaaaagttaatgagagcaagaaaaaggatataggaaataagacgagatactaaggacaaaaagaacaggatcagaaacacacagcatattatatagacaaatataataattgaataaatttatggaaagtaaaataataaaacaaacacaaacaaacaaaaaaaagtaaaaaagagaaaaacaaaaaagaaggaaagcaaagcgagcgaaggataagagaagagcagggagacgaggcaaaagaaaggagagacaagaaaagaaaagaagataaagaaagaaacagaaaaagcaaagcagaaagaaggaagaagaaacaaaaaaaaaagagaaaagaagaacaagagaaagagaaaggaaggaaaaaaagaacaaagagaagcgagagaaaaagaaaagagagcgagagaggagacaagagagaggagagattaacgagaagcagcaaaagaaagcaaaagaagacggaacaagaaagcaagaaatagagacagacaccgaag

SEQ ID NO: 565604 - DNA, 552 bp, Homo sapiens
atcctgcagctagcgtcgcaccaatacgagacacggcccagtccactgaacatcatcgagacacggcctcctctacaacctctatctgtgtgtgtgggcaggtgctggctgggcccgggagctctgcagagtgacctgtgtcaggactggttccatgggcggtgtgtgtcagtgcctcgcctccctctagctcgtccgcaggcccaagtccccacctcatccccactgctgggactggctgggaaatgggaacaatctgtgtcatgtgtatcgctcagcgcccggctggaacatcctggactgtggtagcctgcagaactgctgtgcgctgccgggcgagcctcgtgctcaagagagggcacactgcaggcggccagagcctggctctgagtgtgatgtctttggaggtgctgactccgcaagtacggtgaactaactgagggctctaatacctgagcctgttgaccctcaaaggatggagtatgctaagtcagttctgaaatgacagtacgctgaagaccgagagtcagtaaaattgtggcttgcatatgc

SEQ ID NO: 565605 - DNA, 977 bp, Homo sapiens
  misc_feature (93)..(93): n is a, c, g, or t
  misc_feature (456)..(456): n is a, c, g, or t
  misc_feature (463)..(463): n is a, c, g, or t
  misc_feature (469)..(469): n is a, c, g, or t
  misc_feature (486)..(486): n is a, c, g, or t
  misc_feature (488)..(488): n is a, c, g, or t
  misc_feature (495)..(495): n is a, c, g, or t
  misc_feature (508)..(508): n is a, c, g, or t
  misc_feature (511)..(511): n is a, c, g, or t
  misc_feature (540)..(540): n is a, c, g, or t
  misc_feature (542)..(542): n is a, c, g, or t
  misc_feature (562)..(562): n is a, c, g, or t
gtctcctggagagacaggaaggcaattgggaaggcgtgagcagacagaaccacagactccacaattgcctcctggagagacaggaaggcagcnggaagaggagccgatgtacttactgggaagcagaaacccctagattccatcctggctgctgctgtttgcaagtgtcaaagatgggggggcgtgtttatattttatatttctaagatggggtggcataggaaatagggaacagatgtgtaaaaccagatgggaaggacagtctgtgagaaaggagcaagcagttgctgcaggtgtgggagagcaaagcccttctccacgtggaaagagcccagatggacgctaagcatgttgggcacctgtaaccccgcactcgctggactgacggtgtagctcagtggtggagctagtacttggaacgcctaagactctgggttcagtccttggggggggggnatgtgtnattganaggaaggtgtacgtacngnaggtcanaggacagcttacnggngttgtctctctccttcagctgtgagtccngnggaatgacctcaggtgtcanagtggggggcaggtgccttgggccagctgagccatctgtgctgtctctgctttaatttaaaaaaaaatgaagcacaaagggggggcgcgccaccgaaatatccccgccagggggccacaaaacagcgcggcccagagtttcgtggtgaaacgtgggcccaaaagagagcggaactacagactagacacgtgccgccgtacacacgccggtgaacggaaaccagcgctacttggaaacctgggagaggaaccataaccgtgggggggcaccacactgtgccaaccacccacggagatacaaggcaccggaacataaaacaacaaggcacagtgggcaccagacgcactgtttgggctcaaccatgctcgcgcctctatgaatacgcgcgtcatatcacagaccccgccaacacaca

SEQ ID NO: 565606 - DNA, 400 bp, Homo sapiens
tgagtaccgatgccacgttgctttatgaaaccgagttggcaggatgtctgaggatccaacggttatgatcactacctcccgataccgcagttgccgctcaagatgttgctaaggagctgatgtgttgtcccgggcgcgcagtgaatgaaccgagttcgacatgaagtgggggcactggtgcgagcctgcaaagccaatggtgtcaccgatctgctggtcgtacacggagcaatcggggcaacacctgtggggctcatcggtcagccacctgcccttcggtcctactgcctacttcacgcttgtgcaattgtggtcatgcggcatgacatcccaggagaggaaggagcggctgaggcgcgcgttgaaagaaaaccgcctgattcccactgagttacgccga

SEQ ID NO: 565607 - DNA, 264 bp, Homo sapiens
ccccccggggccaaccccggggtgggggtatttaaggcccaaaaaaatgggtcccaaagggccccctttgggcccccccccctttttgggaacaaagggaaaggttttcccgggttttttttttaaaaaaaaaaggcctttttgggcccctttttttggccccccttttttttttcccccccggggggggggggggcccttttccccctttttatttttttcccttttccccccaaaacccctttaaattttgggttttcccca

SEQ ID NO: 565608 - DNA, 613 bp, Homo sapiens
cgctttccgtggagacttgtgagtcgaaggccgtgagtcagccataattggcatggtgaagaaattaatgaagactatccagtagaaattcacgatgtattttgtcagctgtttgagaattccattggttgctgtggatgagattgctgaagacatgatgtcatgtttctagaaatgagttgtatgcatgaagttggatccaacttgacacaatgcaaaagtggattttggtttcttgcatacacattacaattcactgtttgtgggttatattttggcaacccaaaggagttaattcctaaagtgaacatccagtaagaaccatggcactttggaacagaatcaacgacgtatactatagaacaggaagtcaaggacacatacacaagaccaacgaacagaagtgctgggcaaagctcgccacagcatgttgcacagcttcaaggacttagtgtaaaacaacattggcccctcctggcggacaccaacaatctgaagcaaatgcacatcaaaatatgttgccaataaaggggaaaacacgttacaaacagttaccataatgtgcgccaatgactgtacaacatattcaaaaaacagtacaatctttacccca

SEQ ID NO: 565609 - DNA, 277 bp, Homo sapiens
ctgacatctgatcggccagagcaatgatcaatgcccactacctaaaagaaaggctgagaaattgttggggctctgcccttatgcccttagctcacatcatctttctctaacctgctgtatggtcccattggatgtaactaatgtatccatcatcaaactatggagcagatgccaagagaatctgaggcctcacttttggcaatattaatctgctgagccaatactagcaaccactactgtacaggttccacattacacgagagactagctgaggcca

SEQ ID NO: 565610 - DNA, 248 bp, Homo sapiens
  misc_feature (149)..(149): n is a, c, g, or t
gcagtcctaatggactgtactttgtctgcatttttgaccgcatgctcaagaaacaaatctgtgagtttacttgattcctgggacagccctttgatttttgcttccaaccgttcattctcttctttgagctgagtgactctctgcagtgngccttgtgctttctgcttgcttttcaaccggctctttttcacagccatgttgttcctctctcggcggtccgatactcgtcactgtttcgatccatgggc

SEQ ID NO: 565611 - DNA, 343 bp, Homo sapiens
tttccccccccccctttttaaaatttttcccgtttaaacttggccggggggggaacccccccagtggtttcgttttggggggtttcccccaaggaaaatttttagtaaacggggggatttgggccaaaaaggtttttgctttttttttgtttttttttttcccccccaccggttaggggggaccctttttttttttgtgggcccaatttttttttttttttatgtttttaaaaatgccccttttttgtttttttttattggggggggaaaaatttttttttttccccggttttgaaaaaatgggggttttttacccggaaaaaacccttttgggggggtttta

SEQ ID NO: 565612 - DNA, 394 bp, Homo sapiens
  misc_feature (33)..(33): n is a, c, g, or t
gaaccggcccgctatccggttcaatgattgtgntcccacaagaatataataccatatttttactgtaccttttctatgcttagatacaaaaatagctgggcatggtggctcacgcctgtaatgccagcactttggaaggctgaggtgggcgaattccttgaacacaggagcttgagaacagcctaggcaacatgacgaaactctgtctctacaaaacacacacacacacacacacacacaaacaaacaaaaattagccggttgtggtggtacgtgcctgtagcctcccaaagtgttggcattacgggtatgagcttccacacctggcctccaagttttggtatagtttttttgtgtgcccattattgaaccggatagctcgcgggtaccgagct

SEQ ID NO: 565613 - DNA, 251 bp, Homo sapiens
ggggaagaggccggcgactgggacgatgggctccaagggcaaagaagcgcgtgctgctgcccacccgcacgcccagtgacaactggagttgcggtcgcgcaagtcagtgtcacatcctggcccgaaaccccagtccttcagatgatgaggtgcgagccggggagcagctctacacaaagcggctacgtgtgcaacacgtgacagcggcacgtgctgagcaagtgtgactctgcacgagcgcgagactgacg

SEQ ID NO: 565614 - DNA, 102 bp, Homo sapiens
ctaccgacggggtggtaatctcacgacaccatactgagtgtatgctcactccccttccaccctcagcggatgataatctcaagacacctcccgagtgtcagc

SEQ ID NO: 565615 - DNA, 243 bp, Homo sapiens
gagctttaagaggcaccaaggagggtggcgtgatcttagtgactgcagccttcacctcccaggtcaaacgattctggtgcttcagtctcctgagtagctggaattacaggcgcgcaaccactacgcccagctaattttttgtatattttagaagagtcggggtttcaccaatgttggccaggctggtttcgaactcctgacctcaagtgatccgcctgcccgcctcagcctccttggtgctgg

SEQ ID NO: 565616 - DNA, 893 bp, Homo sapiens
  misc_feature (314)..(314): n is a, c, g, or t
tgtccatcctgggcgcagctcaacgttgatgacaagatccagatcatcaataatatgctgcacaaaggcactgagatgattatagctgagtggaatggcttaacacccttccttaaggtgctcaaggacatggagattggcgacttctctgtttgatgacaagaggtgagccgcgattgtcaaagagctaatgtccaaagctgagaagaatggtgtgaagatgtaccttgcctgtggatttggtcattgctgacagagtggatgagaatgccaagatggacaagtccaggtgattgattctggtgatacctggntgggtggatggacttggatgtggtcctgacctcagcaagaagtatgctgaggctgtcactcggcgctagtcagatgcgtgtggacatggtccttgtggggagtatttgaatgggaagcttatgtccggggaaccaaagctctcatggatgaggtggtgaaagccacttctaggggctgcatcaccatcataggtggtgaagacactgccacttgctgtgccaatggaacacggaggataacgtcagcatgtgagcactgggggtggtgccagtttgagctcctgaaggtaaaagtccttcctgggggtggaatgctctcaggcactattcaataatttcctgcttttaattccgggggcaaagccctaagtcaataagcactttcgatctcactggggcgtaggttaaacctccaggagatcagctatgcaaaagttgagggcgacccctaaagtgcacgatacagaatttaaggccgggtggacacttacaaccctgattttcggcacctgcgccagggctttttgcggaaaagagcgacctggagtatagggcaccaaagaacatgggacgcatgga

SEQ ID NO: 565617 - DNA, 692 bp, Homo sapiens
tgggccgggtaggataagagggttttaactcattctaaagcttggaatttaacacttgggtaacaaagttatgggtttttttaaacaatggcttggtattcaaattttatcgtggtctcatagagataacataggtagactttctccaagagggttttcaaaattcaaattatattatttcaaagatcttccaggggtagagcgcaatttagggaatttggaaacaagcgccattggagagaaaagcgcagagaaatatttggggagggataatatcctccatggcgcttttctttataaaaggggagagaagggggccataatctaaaacagggttaaacagagaagaccacaaagaagtttcaaaagtgttagattttacccaaagagaaagtgtcccactattcgtgggtgaaacccttctctttcaaacatctgggggggaaagcacccaggagacatcgtcaacgggggagaggggccattcacagggggcgacaaatattatctccagtttagcgcaaggcttacaaactgcgtggggaaaacgagaaagaagaacccccagtggttcccctttttcacaaaaggccctttcccctttcggtgggccatttcaagcaatgtggggcgccttccctttttcccacaggggggtccaaacaagatgtgggccctatttcacatgtggc

SEQ ID NO: 565618 - DNA, 730 bp, Homo sapiens
agcagaatagtcattcaccccgctggataatcgtcagcatactgacattaaacaccaaagcataggcggggatcaagcaataatctgcttcaacgttacgattcggtggggcggggggggcaacttaattctatatacggcgttcgtatgcaccaggcggggggggtacgggtcccccgcttaaacacctttttgaaaggggttacccttttggccccggccgttgaccccgggcaaccgccaaaaaaggtggacaaaaaaccccccctccccccagagctttttttttttaaaagaagctttttggaaaaaagtcccccctcgccctctttaccacctttaaaaaaaaacggcccaaattgtttttattgccgggacagaaaacaactctttaaccacccccccccttgttcaaaataaacacccgggtgccaccctcccccctgtaaaaaaaacgggaacgcccggaaccaactcattttaccgcctattacaaaacaccactttttccctttttgaagggccggaccccaatattcccggcggcaccccctcctctctttttttatcaaaaaacaaggtgttttctaccccgggcctcttttaaaaaaaaaattttctgggggggatgtgggcgcccattcccacacctttttggggggtttcaaacccccggcccgatgtttattcttgggtgtggggggcgccccattacaagaaagaaaaaaat

SEQ ID NO: 565619 - DNA, 235 bp, Homo sapiens
gcccttgggtacgccaatgtctagaaggccctttccaatgttatcttctagactgtttatagtttcaggtcttagatttaagtccttaatccatcttgagttgcttttatataagattcattctcctacatgtggctagccaatgatcccagcaccatttgttgaaaagggtgtcctttccccactattgtccactgtggtcaaagatcagttggctgataggtatctgagtcta

SEQ ID NO: 565620 - DNA, 194 bp, Homo sapiens
gtataagagatcaggtgcgtccattcagctgttggtgtatgtgctatcatccgtctggaggtcagtttgattagtcatggctgggtggtgcctggccggtcgctagatgagatatttggaggtggggatcaatagagggggaaatagaatgatcagtactgcggcgggtaggcctaatttctctcggaccaatg

SEQ ID NO: 565621 - DNA, 119 bp, Homo sapiens
accgccatccctcccaccccataccaagcatgggggtgctgtgcaggcagcagtgtggcatgacagttggtaccagtcctgatgtccctcggctgagaataaaacccatttctggatga

SEQ ID NO: 565622 - DNA, 212 bp, Homo sapiens
  misc_feature (24)..(24): n is a, c, g, or t
  misc_feature (70)..(70): n is a, c, g, or t
  misc_feature (72)..(72): n is a, c, g, or t
cagaaccacaggcacacagtgagngggcagtgtggctccctgcctgtgttgtccccatgccccgtccgcngngttaagctgctgctgtgatgtccctgcgatgggagtcttgtctcccagcctgtcagtttcctccccagggcagagctccccttcctgcgagagtctgggaggcggtgcaggctgtcctggctgctctggggaagccgagg

SEQ ID NO: 565623 - DNA, 497 bp, Homo sapiens
  misc_feature (59)..(59): n is a, c, g, or t
  misc_feature (62)..(64): n is a, c, g, or t
gatatcaactaaatagtgtgtgaatactgcactattaggtctaattatcatacaattancannngaaactaaaaaggtcagaggagaagaggaaagtgcttaatcttatttggttactatgttacctgttattcagcaaaatgttagaacacttaatatcccgatgcaggaaattctttttgtgacagtattccaatccttccattagctgtttcatgaacgacttgatatggtcctcagaaaagtgcaccaaaccagattctagcagtcccattaagtcatggtccatatactcaaatacaaggtaaaaggcacctacataaagacgaaaaaaaattaaaagcaagaaaaaaaaaagaatgctgaaataacaatgcctcaagtcctaatataattttggagttgaccacaggttctctagaaaaaacccttgaattttacagatgaagaaactgaaacgaagagtagttgaataattagtccttcctaataataac

SEQ ID NO: 565624 - DNA, 871 bp, Homo sapiens
acggcttcctctgaaaactctggtgcaaaaggtgagagacagatctggacctgcaagggtagtcccgccagcgaacatgacgtgtttgaccctgtctctgtggcgtggttggcatggcgatggaagagcatgagttacacgttagaaggtgtgatggccggtgtaatcgcaagtacgagacacctatactcattctggcggtgcctgcaatcaagttcctccaagacgcgacgagatcgcacccaacattgcccctgtccttgaaagcgattgtgtataactaataacagacacactcttctcttaataataaacatgagaatatgatacaagggagggggcgaagcctcataccacatttatccaccactttgagggcgtgcccatgctctactgtctttgtcaccagagttaccttgtgtgaaaaaaggcggtccccgtttcctgtacggagccttgattaagaattaacgtaataccgtaggtgtccccgatcgcttcttcctcttgtgtgaggccatagagcgccaaaactcttgtttgccatggaggactactatagcgatttaccagtagaccatggcagggctacctaggcggatgactaataatcctggagttggggccttttgaaacccttggtaaggactctgaggaagcctgtagggaggtggattaagagctggactgtgctttctgggtctgatcatccagttctgactattactgccttgccatgataagattcggaattccgaggataataaggttctgaactcattgtattgttcacgcggatgtccgcgcggttaaaaatttggtgttcaattaacacaaattttgtaagtgaacaaaacaacaacaaatacag

SEQ ID NO: 565625 - DNA, 223 bp, Homo sapiens
gcctcctggattcctgaagtttaggaagaaataaggtagccaagggcaaccacaatggaaggttgtgaccagcctcccaagcggccgcgcccccttttcgtgtgtgcccggtacctcggcttaggagttgcccgctgaccaccttgaatgaaggaggtccccttgccagccagcaggccgagctccaggagctggaggagcggcctccagctgcaattcgagg

SEQ ID NO: 565626 - DNA, 1262 bp, Homo sapiens
agtgagccaaggtcgcgccactgcactccagcctggccacagagcaagagtccatctaaagaaaaaaaaaaaaaaatcggtgaaaaaaaggtatcgtattcttctaacacgtttgggtgagggtttacaacaggtttttcatctataaaagtaatgaaaaaagtggtatccctttcttaagaaacattgggtcaggaagtggggtatttaaatttcaattcaagtgtgtgttttctgtggggagtgcactcagtggcgtgacctagtgggtttctcatacattggacccgtggttaacatagtgggtgacattaagatattaacgtgaccattattcactcgaatcattcctttcaattccaaaatcttatatttggggtggtatacactttatagattgtgggtataatttctcttaagggacttattgggtggtcaaatatttcagaacagttcaaatttcagtggtgttggtacactagtgcttggcgcagtgctaactaatatttctcaaaatattggggtgcctatctcttctcattaccattacaatattggcggatagaactttcacagtttcatattagtctctgtgtgtgggacaacatcgtgaatggggcataacaggatttatctgggcattggcgcatgagtgatgatgatgatgatgatgtgatgtgatgatgatgatgatgatgatgatggtgatgatgtgataaaaaagaagagggagaaacagagcggctaatgagatcaacataacgaagatcaggaaggacgcacgaataaaatcatactcacaagaagcactaggaaagtacaacaacgacccataggtagacccccaggggcgaggaaaaaccacaacgaagtagcagacacaagacacagtgagaaacaccacgcgaacaaaacacctacacaaacggaacaccaggggcgcaacagagagaacaagatcaccgctcagaggggcacgtagagggaccgcacccaaggaaagaaacgaccagcggcagcaaaattaagacaggagcaaatataaaacaaaacggacgacccactgacaagcaagaaaaaagacagggagacaacaaagaggaacaagcagaagaggggaacacacaccacaaaagggaaggagcaaaggaggaaggcaaacaaacagtcgaaaggcagccacagaggagaccggcgcccgccgccgcggcccccacaagatgcatggagaaaacaacgagcacgacgaacctaaaacacgg

SEQ ID NO: 565627 - DNA, 525 bp, Homo sapiens
atatccccatcccccaccagaaaaaaaagaaattagtatattgaagagatatctgcactcctatgtttgttgtagcactgttaactaagctaagattttgttacagcacagtttactaagctatggaaacaaccttagtgtccatcaacagacgaatgcataaacaaaatgtggtatttatacacaatggagtactattcagctagccataaaaagaatgagatcctgtcatttgcaacaacatgagtggaactggagattattatgttaagtgaaataagccaggcacaaaaagacaaacattgcatgttttcactaatttgtgggatctgaaaatcaaatcgattgaactagtgaacatagagagtagaaggatggttaccagaggctgggtagtgtagaggggggttagaaggaggtagggatggttagtgggtaaaagcaaacaaacaaaaatagaattaataagatctactttttgatgtcataatagggtgactatagtcaatgataatgtatatttta

SEQ ID NO: 565628 - DNA, 905 bp, Homo sapiens
ggagagaactagtctcgttttttttatgtgtattataaacgtaacggtttcctttatatttaaaagatcattcacaaaataccatatccataaattaactttctgtcatatagctcgaatgtgtaaggtgttgggaattccattcttacatttaaaagtcaacgggattgcccagcagtttaaatgcatgtgtctggtccttatatcttatccacatgtgacaaatgtacagtaggctcatctgaaagcactcgggttggattcacgcaccaacataaagtgcagtggtctttctccttgaacgctttaacgctgtgtggctgttatacacacaagtgggcttcatatattctctcagaaacaggcagaacaaaccttgcaccaggggtggaaacggaaacgcgaaacgaaacacctcactctcctgcaggcaacttggacgcaacaacgtgcgcctgtgttaagaaccaacaggaccacacccggaaaagcagaaagagagcacacaaagcgcaatcaacccacgacatgagcggagcacccaaaaaccagtgctacaacacaccaactatcaccaaagcgtgcaatagaaggacaccccccaagcgaggcaaaccccagacgggggcacacaagaaaacgacacccacccgtggtagccaacagggcggcgacacatccactataacacccccacgggaagataccactgagcgtgcacacacgaacctccccagaccaccatcaaacaaaacaccaagcacagcaccccacaaaccacggggcaccgcaggacaacatatgggggcaaccactccgcccgccgtccaacgagaaaccagaaggcaatcaatcttcaacgacaacacagcaccactagaccaaaacccagccaccagaacgaa

SEQ ID NO: 565629 - DNA, 1632 bp, Homo sapiens
  misc_feature (774)..(774): n is a, c, g, or t
tggcactatctagtcagagggatatatctacgaagcgggtcactattagaagggggggcgccattaacaacaaagcgcggcgacaagcgtgtaatagggtggacgacagaaccacacttgccgcggctcataatagagtcgtcgcggctaaaacaatgggtgtgatgaggaccaccacttggggggtaataactccccggcgaatggtggcgaccagaaggtgatggctccccaacaaccgccatctttttagtagcctgcacaacatgggggcaaacacccctaaaaaagccttccgtccccccccgctagatagtagtgagagcgtgttcgcacgaccgctcagaaacgtcgtcaaaaaccgtgtcgggtgatagataaggggaaacaagggggtgacgggggaacaagggttgttcatttaacgaccccttttctgcgtgtttagacgcgagaagaaagagaggtggtgtgcccgcaacatgtgtgggtgtctgtttaagagcccccacaatgtcccccgttgggggtgttggaaaaatattcgtttgttacgggggggatgattggtgcaacaccacgctggttttcctttctccagaaaggcgcttcctaacttttacaacacgctagtgttgcactaggtgacccccactactcttgggggttaagatttggggcccacaccttgtagtaatgaaaagccctctttgtcacaacgggggacatcgttcgctgaagatttttgtttgttggacccctcggaaatttggnttctcgtaaaagagattgtcacctgatactgttatatattgtatacacaaaaaaataagatatgggtgtccacatcataaagggaggttccccaacatatatggttaatggtctctaatatagaggaacacacaacatccacgcgggtgtgtttgtgttctttatattaaaaaaaatgggagaagacaaatgtcatgggtgggcgtttgtttgttaaaaataacttgggtgcgcataaagagacgtttccacacagacaccgtgggtggagattacttctcgcgcggtgttaatatctgttaatatggcacacacccctttgtagagacctcccacacccttcttgccaacagagggtgtgttttttctctgctagagattaaaaaatataggggatatatataatgtatatataagccacaaatttctacagagagcacactcttgagagtatcctcgatatctgtataacaaagagtttatatctcttgtgtctcgagagaggtggagagctagcactccggagaaacattttatccgagcacacaaatagttcttctggggacacacaaagagagagagtacacagaagagaagagagagaagcacacaaaggagcacactataatttcaatctgtaaatttactgttaggtaaaacctagcacgtaaaagagagacacattggtcacacattgctcttgagaccctgagtgagaattattataaactgaggaatcacttgtcgtttaatgctctgcacagaatgttaaaatgggaaagattaaatatgcataaacctttttttcctggatttggcagatatgtataattatcacttcaaatggttttagcacca

SEQ ID NO: 565630 - DNA, 488 bp, Homo sapiens
gagaaaacttataacttatataaattcgctaattgtagtgccctttctgccatcaagttctttcctagagtaacttaagataaaatagatatgccaatttttcccaatgaactaatttattttgggaattgcctcaaagttacagagactgtaattttcgtatagtgaaaagttaaataaaagctggggggggggggagtgcaagaaagaaagagatggagaacgagagcgagctggagatgaaccacctgcgatgagtaggccgtgtctggatcctgaatcgaacacaccaactgtaaaaatatgtttaagacgcatcgggaaaattgggacacggattcgatatttgatgtaaattagggaattgatgtcagtctttttaggcgtcaccgtagtcttgtgattatgtttgcaagttatccttttttgtagagacatgcgaaattatttacggattaaataatgtctgggattggcttttaatttca

SEQ ID NO: 565631 - DNA, 136 bp, Homo sapiens
gaagtataaagcgtgagaagtataaagcgttagaacgtataaagcgttgaggaagtataaagcgttgagagtataaagcgttgaggaggaagtataaagcgttgagagtataaagcgttgaggaggaagtataaag

SEQ ID NO: 565632 - DNA, 671 bp, Homo sapiens
ctatcatatagtaaaacccagcccatgacccctaacaggggtccctctcagaccgctcctaatgatcctccggcctagccatgtgatgtcacttccactccataacgctccttcatacatacgtcctactaaccaatcaacatccataacctatatattcctaatgaatggtcgcggaaagataacaacgagaaagcacattatccatgggccgaccatcaatacctacctgctccaacagaaggcccttcgactacgggcataactcctaatttattacctgcaggaagttccgtattcccttcgctgtggactttcttctgtagcctgtttcacccactcgagtcctgagaccttagacctcacaactgagtgacgggcgcgtggcacctcctaaaaaggccataacactcacgttcacataccctagcataatacacacctgcgctaaactgcagtacctgtatgactgctgcgattcaagggagatgatacgaaatctaccctgatgtcggtcagcatcagatctcagatatgaataatataaacagtaaaacaagaagtgatttcgaaagccacctggtgtcatgacaactaaacatgggtctctatttgatgctccctaccggccgtcagagtacttcgaagtctcccttgctcattgtaccgag

SEQ ID NO: 565633 - DNA, 667 bp, Homo sapiens
  misc_feature (437)..(437): n is a, c, g, or t
  misc_feature (471)..(471): n is a, c, g, or t
  misc_feature (522)..(522): n is a, c, g, or t
atttttttcaccctgagaaatgaggtcctaaggaagctagagccttaatggtgtggtaaggtagaggtggtgattgctttcagagtcctgtccttgaaggactggcaaatgagaacatggatatattctaaaggtgactttttctaggctactggagaagaggcaagaatggaatcttttaaggcaatgatcaacaagttagaatgtcaaagacttgggtgccctggtaaaatgtaatggtctgtataaaatcaaaatgtacaaaaacacacagcctttctgatggctgctatatagagatacttggaggttaaattctgtaccaaatttcaaaacttaatagctgcttttgcatgtgtaaaattagttttcagtatgcaagaatatgagagactagaatagtgtattattgtcatatcataagggctttataattntgcaaggtattttatgtaacctttttggttcagnacaaacataatgctaagtgcgattagaagattattttcccagctagcgtgngggaggtcatgcctataatctcccaagacttttgggaggccgagatgggagaaattgtttgaggcccagcagttagagaacagccctgagcaacataatggaaatcccatctgtgcccaataattttcattgccggcttcgggcg

SEQ ID NO: 565634 - DNA, 1653 bp, Homo sapiens
  misc_feature (67)..(67): n is a, c, g, or t
  misc_feature (671)..(671): n is a, c, g, or t
  misc_feature (1336)..(1336): n is a, c, g, or t
gtcgatcatctaagccaatggtgatgtccaccccacacaccatgtggatattcatattgatcgtatnatcacgcccgtgatatatatatggtgagctccaacaacgatcctcgtgtctccttgatatatccacgctgcttgtgccacccaactagattatgtggggcgactccacaaggttgcttacacactttgtcgcggctaattttccacacgaaatgagctcgttttctcaagacgagtgtctcgcccacatacttccactacacctccaccacaacgtgtgttgtatatgcacaacaagggagatggttgtgtttttataaggatgcggcttgttcaatgttataaaactattgtctgtgtgtgatcttgttcggcgatcattaccaaaaatattatttgggggcgggctcagcaccttttatgatccactcgtcgttgtcgcccgcagtgagagagaagttatttgtctgtggtgattgtgtggtgttggaaattacatccgcacacccctccgcacagatgaatgatgtgtttgtttggtggaaaaattggcggtttcttctgtggtgggaatacatagaaatgttgtatagtgtggacatgatgtcgccccgtcccggcagagagaactgtttcgccaccgacgagaacgcgggttaatctantccgtgcgtgggaagaacaaacaatcggttgaatggtaatggctgtagcagaaccaatgaagattttcttcgtctgccccgcgctttgtgctcccacattatatatcgcgccccacaatgttgttatccttatatcccacagaagaaatgttttccccccccgcccacattaatttgtgaaacacaccccttcgtagagttataatatcgccccccacacacctccgtttgggagacctcgcgcaccgtctatgttgtaacacaccagctttcctctttgaaattcttgtggttcctctttttttgaagagttttaataccccccatctagattggagatgatcccgcactctgtccctcggatatgaaaggaagacaccacatcttttaatatttgagcccacattatagatacgagatatccccctctcacgcgagatatatccacagagctgtccccctctgtctccaccaccgcgttggggcacatctgtgggctcgcggagacataaaaggagagcacttgagtctcgctcgtataggtcccacacaatgggggtgagaatatacctctccccacaaatgtgcaccgctcgggcaccactgtacacacttttcaccacacattggtttctaagccgccgctcgtgtccacgcgagaaggngtgttcgcactccacaatgggtggagggcaccacacgcccctcgagaatgccacagagaagcgcgctctccacgctatttctccccaaggggtgaccctctctcacggccacagcccacagctgtgacacctgctcttataactgccactctttttctatattgcgctataaacccacgatggtttcctaaggaaatcaccacggctttctgaggcaccacagctgcacttataaacccacaaggaaatttctccctttgaacttgtcccgaattccctcttgtaaaggatattataatgttgcctttaaccctgta

SEQ ID NO: 565635 - DNA, 113 bp, Homo sapiens
ctggaatactgctgagtggtttgctgactcatatccaatcaatatccaattgccctgggacagcgcgggaagtgcgattccagcctcccatttattctttcacctatttggat

SEQ ID NO: 565636 - DNA, 266 bp, Homo sapiens
aagaatctctctggctcaagttctaagtaggttggattaccggtgtgcaccaccatgtcctggtaattttagtatatctttttttggtagagacagggtttcacccatgtctcctgagtagctgggactgcaggtctgtgccacctggctaatttttttttcttttctttttcttatctttctttttttctttctttctttcttttatttttttttttggaaaaaaatttttgctgtgttcccccggctgggttaaagggccttgc

SEQ ID NO: 565637 - DNA, 275 bp, Homo sapiens
  misc_feature (164)..(164): n is a, c, g, or t
  misc_feature (269)..(270): n is a, c, g, or t
ccatttggctggctgcacatccttcacctgaagtcagtgcttcagcccggagctgccccttgaccatctcttctcctctccacgtgccatcctcactccctgggccagcctcttctccaatgccaattcccaactcctctccccttgactagtcctggtgtccntctacatgtgtcacgttccatttgtcatctctcactcccccatctctgtccccaaccacacttccgtgcccctagcctcgtgctccacttcaccaatcccctatnnctcag

SEQ ID NO: 565638 - DNA, 163 bp, Homo sapiens
gcggccgcctactactactactgctcgaattcaagcttctaacgatgtacggggacatgagaatcgtttgaactcaggatgtggaggctgcagtgagccgagatcacaccattgcactccagcctgggcgacacagtgagactctatctcaaaaaaataaaaa

SEQ ID NO: 565639 - DNA, 469 bp, Homo sapiens
  misc_feature (38)..(38): n is a, c, g, or t
  misc_feature (64)..(64): n is a, c, g, or t
  misc_feature (67)..(67): n is a, c, g, or t
  misc_feature (73)..(73): n is a, c, g, or t
  misc_feature (77)..(77): n is a, c, g, or t
  misc_feature (79)..(79): n is a, c, g, or t
  misc_feature (108)..(108): n is a, c, g, or t
  misc_feature (127)..(127): n is a, c, g, or t
  misc_feature (136)..(136): n is a, c, g, or t
  misc_feature (140)..(140): n is a, c, g, or t
  misc_feature (185)..(185): n is a, c, g, or t
  misc_feature (192)..(192): n is a, c, g, or t
  misc_feature (218)..(218): n is a, c, g, or t
  misc_feature (226)..(226): n is a, c, g, or t
  misc_feature (259)..(259): n is a, c, g, or t
  misc_feature (303)..(303): n is a, c, g, or t
  misc_feature (345)..(347): n is a, c, g, or t
  misc_feature (350)..(350): n is a, c, g, or t
  misc_feature (360)..(360): n is a, c, g, or t
  misc_feature (364)..(364): n is a, c, g, or t
  misc_feature (461)..(461): n is a, c, g, or t
cccctcgcacagcttggacttacaggccactcacctcnaacaggggagatagttacccatgtantgnaaaaanaggnantaccggaagcagcctagggcccagaagtntggaagcctggagtagagntgggtcggnggcnaggcttgctgcactgtgccgactgctcccagggtgacggcctgtncccagtncggaatatggcccatagagaggatgntgttaggnagaggctctagcatctggcttttattggttgcntttcttaaacccagcattttttaaaaagttacctgaggtggtantttagtcagggctggagataggggtaggtcagttgtcagttnnnagntgggtaccgntgtngcatgatgggtgctttatatgtagtaccaggccaagatttcagcagctagggccacaccagcggccaggatgaactggaggctgggcttcctcagcncagccata

SEQ ID NO: 565640 - DNA, 316 bp, Homo sapiens
tgacttccgtgtcaacgcgagaacctctctgcgtttggcgtgtgtcctctctgcgtttcaaacgcagagaggatcagcaagcaggagtattccttggtcaacgcgagaacctctctgcgtttgacgtttgtcctctctgcgtttgaaacgcagagaggacgttccgttgctactcttctcactcttctttgcgtatgttagccgccatatatgcttaatcgctactgcaacctcaccacttacccattccttacccattaagctttgctagtcttgaccgttccgttgctactcttctcactcctctctgcgtttg

SEQ ID NO: 565641 - DNA, 190 bp, Homo sapiens
  misc_feature (141)..(141): n is a, c, g, or t
ttgagggtcttagggaccaaagctgataaaatcagtcacgagtcccacggtgtttagtggtgtctttcgactgttataattttctacttctttatcttaagtatgtagaaccagagagagacagtgcctcttttatgtttnctggtgtttgtagcacatttcggtttgttcatggttagggtctacgctg

SEQ ID NO: 565642 - DNA, 356 bp, Homo sapiens
  misc_feature (315)..(315): n is a, c, g, or t
gggcatcactgggtggagggctggggtttctcctaaccagaacagagtgcagtggctggcatggatctgtggttacctctgggcagagctggactcactcaatcctcttgggatgtgaggtgagctcagtgaccctcactgagcagggtctgagcaggtgaggccaaccctcaaacaggtggcactcatctcctttagggctgggaatgaggtgcaccaggtgctccgagtgatggggcatttgtgccacaggaagcctcatgattccccttctcaggtatgtgactcagatactgattcctcttcccaggctgngagattaaacaaactttggtttcacatgatgcccaacatgg

SEQ ID NO: 565643 - DNA, 138 bp, Homo sapiens
ggacccacttgaggacatcagaagagtctatagagttaccttactgtgctggcttgaaacatcgtcaagacgtaagagatcctcttgccaggattttatgttgatccaatgacttgctaacagacacaagattcgaga

SEQ ID NO: 565644 - DNA, 1169 bp, Homo sapiens
  misc_feature (1169)..(1169): n is a, c, g, or t
gggatttgggctgagtgaaccatctagaaaaagtagagctttgagtattatcgattcctattatagaaacggtcatcttgctcggtctcccaggctggtacgtactagtggctacgatctccgagctccttgtccttgcaacctctgtcagttcccatggtaggaatgtgacatgatacccaggcaggctggcagcttgccatgagccaatatgtcgcacacatgcactccagcctgggtagacatgagagtagagtctggttctctaaaataaaacacataaatacacaaaagacatagggcctaaatcggtgcgccaaacagagtctcataattaacgtgagcgcagacatgagcatgaacatttccacacaaaaaaacactaatattagaagtccaattatcaatcacaacacgcagcgagggcgtatttatcatgtaaggcgagtcgataccccggcgtgactgaggtctcttcaaaactcaaaaagtctaatcatacaacgcctattttagggctgtttcgccgcggaacctttgcagcttctagcgaagaaccccgcgggaatctaacacactcaactttccatacattgctttaaatctgaggactgacaaacttctttaaccccactaaatataaggcgactgagggcaagtactttaacccatctctcgttatcaagtcacgagacggagggggcaaactaattccagcgcagacccaataagacgggtcttaccccgtgcgtcataggtagcaacgtgtcaaaccagggggacccttggaacctcccagggagaccaccccataatccaacttttccaacaaggcccccacatagaaaaaaaccgcgtatacgtacgcaccaagacgcgcggaaataaaaccgcaaccgacctccgcgcacgcagagcaaacacaccaggacagtattaccccagcgcaataccgcgcgggggagaaaatcccaaccggccgaacctggaggggggaacacccccaaggcaccatacatatccggggcggcaagaaaaaacagccatcatgcggctccaccacaccacgaccaaaacacccatctacacaacgcgcgtctaacgaaacagccgccaaccacaattacgcgccgtacaccacccactaggtgccacccgagcgctgacan

SEQ ID NO: 565645 - DNA, 243 bp, Homo sapiens
ccacctcagcctcccgagtagctgggactacaggcacgcgccaccgcgcccggctaatgttttgtatttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactggaaaagactaatttggg

SEQ ID NO: 565646 - DNA, 1013 bp, Homo sapiens
gagtgctcggcggcagccgggctcgtagtgtacgtgccactatgagggtccgtccaatgaacgcatcttctggagatgaagtgatggctggccgggacgacggcgtgagtgtctggcaaccggggcgtgccaccgtttttatgccgcctgcggcaccgggaacacaaaaaaacaccaatgcacccggaattggcgggcacacgtgcgcgagctacgcccgaggtggccgacaccgcacgggaacgcgttaagcccggggaaaccgtttgagggccgaagccggcagggccacccgtgggccgtgtccagccggttggtgcccagaaagtcccttgagggccccgggcaccatgccagcgcccacctgggcgctgtaaagactggccagtcccctagggtcataggaaggccccctcccggaatgacggcggaccgatgaaacgcgggagaaagaaacgccggcgaacgtgcaacgggcctaaccgaaggtgccccgggattggccaaaggtgttccaagagaacagtatagccttcagtgccgaaattgtcccttcctgtccaagcctcaaagccatttctgaacgggtcaggtaaccttacccccacgagacgctcccagggggtgccaacaacggctttggggagacccttggcacatacccccgtttggggatggcgataaagttggccccatattccacaggcaaacgtgggtaacgggccggtagtcaacaccaagcgtggagaaggaggaaggtccccacgggtggccacccgacgctagtgaagctggctacgactatcagcacccctttaggtgtggcccacatgggctcggacgccatgcagggcaacaaacggtgccaagccatgctgccggggttcacgcaacatgccattgcgccgggcactgtgaccacacagagacagcacaacggtccgcaccactggcgtactgaacaccccaaacaaacagccctggggcgaggcacaccaccttccatccgtgac

SEQ ID NO: 565647 - DNA, 238 bp, Homo sapiens
gagtggggagatgggcaaaaacggggactgtttcagacatcggattggcagagactagagtcggtggcataggtcagcgtctcgtgtgcagggggcggcagatggcggcccttagcaggaaagaactttgaatctcttcccttgtactgagccataagaagcagtgagtgctcccaggcataagtcccctggctctgctccgtaaaaatgctctctccccaccacgcagctcgcccct

SEQ ID NO: 565648 - DNA, 150 bp, Homo sapiens
  misc_feature (1)..(1): n is a, c, g, or t
nagatgccccagaccggtcttgaactcctgtccaagtgatttgcccacttcagcctcccaaagtgctggcatttcaggcgtgagccaccacgcttggtcttgctctagctattctaaacatgaagaagtcatatagcttccttggtgcgg

SEQ ID NO: 565649 - DNA, 134 bp, Homo sapiens
gctaatagtcgctctggtacgaacacttcccttaagaaagttgtgaaggagacctcctacgagatgatgatgcagtgtgtgtccgcatgttggccaccccctccagcccaagagacccaagagcgactgacagg

SEQ ID NO: 565650 - DNA, 401 bp, Homo sapiens
tgagatcggcccttatgccagctccctgtgtgctttaagtccacattttcttccacagccatattaccccagtgcaagagactacactgactcgggtcatgctgggtgatgcgtccggaacgggctgtggttctcataatgtacttaaaaagtatcctgactataggcaggcacatctctgaaaggcccataatccagtaggtcctcagagcgcgtgaggtaccccagctaggtgtagctcaccacattccgagaggcaagcttcacacgcatggttagtagtcttcgtaggatagggagagtagaaataatggttcccctcaaacaccacaaactgtttctctgactgggatgatctgggttggatatggatgaagcaccgataatagatgagcaggtgg

SEQ ID NO: 565651 - DNA, 842 bp, Homo sapiens
ggcccagcgaggtgcgcagctacgcgatgagcgcagtcaccgacgagcgcctcagctacactgcagctgctcagtgcggtgccgtcgtgacgacggcaaccgtgccagctgctcctgccagctgtctggactgcccgcaagctgaccttccgtggcctgcggaaagcagatcaccatggaggagctggtgcagctcgcagggtcatggactgatgccactggcgctgccaggcttgcgaggagggcctgaccttccatcgaggagggtcaggcgaatgaacgtttgcaggaagttccttggacagggcaccaggcttgcagtctgcatgactagtcattccgttggaccgcaacccaatgtggaacgggcatcatcgtaatagtaccagtgccacttgaaaggaacgggcacttcattctcatggcccgggacaacagagtcccttttgaagccttcctttggaaggggacgcatgtggtgtgcccaactcggtgattaaccgtccattcggactcccacaatcagatggtggaccttgaacatcgttgcacgtgatgggaagggaaggggcttgtcgccggtaatctgggcgccaattttgggtgagggacacccccccaggaagggtatcccaaaaggtggactcaacaactgcacctttgcagttcgatactagtgcccggaaaggacccgcatagacctatgatcacaccatttcgtgaggttcacgccaactggggcacccccccataaacattgcgtatgggctacaaactgtggctcaattactttcccccttatctttttcgcaatggggccacaagtagacagtcaaacaagg

SEQ ID NO: 565652 - DNA, 274 bp, Homo sapiens
gcgatctagagatccctcctcaagcaggaaaagataaaggctgctacactgagacaacagtgttgcctgcagacccagctgttctccctacaggttctctgatgcgtagcattggttgggcctggcagctttgaatgagtattgtggccttagactgcatgaattctctttctccctaggaatgcccttcaatcagctgggcaccctggcaggcagcaagtactataatgtggaagccatgtattgctacctgcgctggtgagtatttgccagc

SEQ ID NO: 565653 - DNA, 1385 bp, Homo sapiens
tacacagagagtgtaagcccaatgctatgatcccagtgatggtactcctgaagagcgtaaataagagtaagaaaaatgtcctcaggcgaaagcggatatgtggcgtccaaatgcgctccagtcttatcagacggggctaggcgtgagcagggattcccttcgaacattcgtgctcgtggtattcatccccaagactaacagatgtttgaagatacagattacacttatcaagacaaagcaacaacaggatgatagcacgggatcgaggcttgtagagaactccatccatgacggaggtacccccgtttgagaggtatcaatcaccttgttctacatatggaagcctggattgaggcgcagtatgggagtggaatgccctatatcgtgaggctaaagcaaggacagtggttgacatgttgaatccagaggcgtaagagcatgaagaaagggcaaacaccgctcgaggaataaccatggggacaccttgattgcggtgtggaatggagtcgcctcttttcacaatgtccgaggagtcatagtaactcagactttttacgtaggaaggcagaccccaacctgatacataggcagatatagttactacacttcccaatggcataggccgtgcgatccttgttgcccgccatgtggccccccaggcgcgttcagtaacgttcgtcgtttaatacaagcggacacattgagactaaccggatcctggacggtggccttataggataattggtcaagatagatactccgcccaattctggatcatccttcatagggagcagcttagatttcacacctatcaagggtgacaccgacgggggccatatcataggcattgtcaacgaccctggtgccagtaaccgtggtcaccgacaatttggtgggcaagacgctgggaaccaggaggtaaccccctacgtttcgatagccccctccgtgttccattgaactggtgcatgggtaccccaagagccaaccgcgagggacatcccccaattggaagtcgtcaacgcatggggatccgttgtgggacaaaccaagacgtaccaacctatcatagttataagagtcgcttataccctttatggagctttggaacaacggtcacagtctaccgctgggcaaggtcacacaaaacaggccccaaatggtatggaataccaagagcccaatacctcaacaggcccatatgaaacccaaagaggaaccttggtaggaacccagaaaataacacatggaaggtgccattaggggaaatacacaaaggtgtccaaaatacagctataccatcaggagccacaaagagaacagaggaatgcagaaaaaggtgaggcaaaaacatagcaaacggaggccaaagagaatgacaacgt

SEQ ID NO: 565654 - DNA, 130 bp, Homo sapiens
gccgtgctgatagcgtccatggaacgcgtgaaattgtaattatatctaacggaatctgtatagatagaattctgtatagataagagagtgttgaaacggataatttctatgctggatcagcggatcgagt

SEQ ID NO: 565655 - DNA, 315 bp, Homo sapiens
ttgtatgtggaatcaccaaaaattatacaattcatagcttgtaaatgcatatgtattttgtgctatcagagcagtgtaaactctgcacaaaacaaaactattttgttttcccttcttgatatgcacacagtatctaccaatctccaattccttctgcttactgatgagttacacggggaaggatgaaggaaaaggtggacgtgctgagttgccccctactttccctttaatattacccctttgtcatcatttgtggtttaaaaatggttggctaatagctgggtacagtaacacatgagctaaaagggaaaggga

SEQ ID NO: 565656 - DNA, 179 bp, Homo sapiens
gagtagctgtgatgtctacacagcttcaaccttgacaacagctattatctttcttactctttttatcatgggagacagagtctcgctctgtcgcccaggctggagtgcagtggcacgatctctgctcacttcaacctccacctcccaggttcaagcaattctcctgcctcagcctcccg

SEQ ID NO: 565657 - DNA, 391 bp, Homo sapiens
  misc_feature (284)..(284): n is a, c, g, or t
  misc_feature (332)..(332): n is a, c, g, or t
ctccctggagcagcccccagcagctcatgtccttaggaacaccccgaagccaggcagaaagaagtaaggtcctgtctgtggggccgtggactcagttgttacccgggtcaggccatccaggggataacagggctcctgcctgtgctgtgtcccctcaatgggcccggtgtgctctccccatgcctccactgccagcggggtgtcaagagtaccacaaggaggccagggcagggtgtctcacggctgtaatcccagcactttgggaggccgaggcagggaatcanctgaggtcaggagctcaacaacagctggtcaacatggtgaaccccatntttattaaaagtacaaaaattcgttgggtattattgtgcacgctttaattccagttatt

SEQ ID NO: 565658 - DNA, 117 bp, Homo sapiens
agatccccgcgtacagttggcggccagccgctcgcgccagctgacgacagcttagagcatcttatcgaagtaggatcggcttgcgcttcccttactacattgtcagcatgcagaggt

SEQ ID NO: 565659 - DNA, 234 bp, Homo sapiens
tacgatcccgttaaatcctcctcctcctatcaccagatctagtgaggggagatggagacatgacagcaagaaaacaccatgaggcaatgaatctgtagacaggccatggtttcttgagcaatgaacttgatgctgggtgtgtccctgcatgcagttgtggaacaatgtgagttttttgattggtattggttgtagtgttgagtggcttggcttgcagtagtgaatggatgtgat

SEQ ID NO: 565660 - DNA, 270 bp, Homo sapiens
  misc_feature (181)..(181): n is a, c, g, or t
  misc_feature (243)..(244): n is a, c, g, or t
ggagttcgagacctgccttggcaacatacggagaccccgtctacaaaacaacagcaacaccaatgtctctggcattttcatgagtatattttcacttttctcacaaagcagtaatcaatagagagcaggtgaattgctcagggttcctggtaaaatactagattagtattctaaatctttntggatttcacatccatactcagggatgtcttccttatcttaaatgactcttttcttagctgnngtatctactgggtatgatcttcctga

SEQ ID NO: 565661 - DNA, 226 bp, Homo sapiens
ggtcgtccacagtatggaggatgcttcgtttaccatttccctacaccctgattcccaaaagctatttgcttatcacctggactgaccctgacaccctccagtcacaacaactcacatggactgtcctccctcagggcttcagggatagccctcatttctttggacaagctctagcccgaaagctcacttccttaaacctgtctcccagtcatcttcaatatgtgga

SEQ ID NO: 565662 - DNA, 128 bp, Homo sapiens
ccacgtatatgtacatgtagtctgttccagcttgtgctctgtagtgcactgcacgccaaggtgcaggtgggtgcagggagcgaggactgaagatagcattaaaaagttgaatttttcagcttccttcc

SEQ ID NO: 565663 - DNA, 447 bp, Homo sapiens
cttccacagcgtaagcactggcacaacagtgtaaagcctattcggacattcgttaccgctcatctccacggtcaaatgaggtcactgtgttcgggtcacagctcgagtcatccgtaggttggtccaagcgttcgaggacagtgttggccccgatgacaacctcatccggaacagtatgcctctgctggtctgtcagtgcctccgcatatgatgacgtagatggcacctctggtgaggcatgtcagagtggcactggtagaagttccaggaaccatgaactgcaagggttcttcatcagtgcctgcagtatgccagctaatgatgctctcataagtgtcgtggaatcgggcccataagttggctgtctgagagaaagcttcttgtcctgtagaggcactggaatcgagtagcggtcagtgtgggcacaggcgatagtatgcatgtagc

SEQ ID NO: 565664 - DNA, 372 bp, Homo sapiens
agatagtagatacggttattcttggagcatgctataatcggcttcctatgaagatgtctgtgtacgagccgttcaataagggaaattggattacagatatcgtgtcagacaccaaagaccaacatcgccatcttctgtgagaccagggccgtgtggataatagctgcacaggcgtgtataatgtatcagtttgcagtgtgatgacagttatatgccagtcgtaggaggtccagccagtagtgcatgcattaagatgaaacagaggtgaccaacatcattactagtaaagaactcttacaaacaaagttgaaggatatagtttctttggtcccacgcctgcggcacatcatcactgttgatggaaagccaccg

SEQ ID NO: 565665 - DNA, 108 bp, Homo sapiens
tgaatattatgcgatccgaatttgggaatgccttaaagcaagttcataaccctatcgcactctgaataatggaccatttatgtgctcctggtctcacagaagatattg

SEQ ID NO: 565666 - DNA, 324 bp, Homo sapiens
gaatttatcgtaatctgggagaggtctcagatgcctgggttctgatggcaggtctggcacgactctgagtgagtgaggtgggcggagggtgagggcagagggaggtggtgcagctgttgagccttccggcctgagggagctaggatgcctcgcctcttcctttccctccccacttcccctttcccccatggggtcgctaatggcattgccgcagtccaagggctccttcctgttactgactcactgtgtgaatggggggtctgcagcaggatggagggagtagagctgtagggtgggctggggccccctacccaaaaccacctg

SEQ ID NO: 565667 - DNA, 192 bp, Homo sapiens
tttttaaaaaaaacccacccccccccccggggggggggggggggcccctttcccccccccccccccccgtggggtttttacccccgggggaaaggcccccttttttttttaaccccccccaaattttccccccccccctttttctttttggccccaaaaagggggcccaaaaaatttttcccccttttttga

SEQ ID NO: 565668 - DNA, 489 bp, Homo sapiens
ggatccctataactccccactcagacgtgttcccaaagtcacagctggcacaaagtcacctccactcatggaggacattggaagtggggacagcggtgaaggaagggactgcaagtgatctgaagagcaggcagtcttgctggttggaaaccaataccttgctggtagaacctttgccaacatctacacctgcagagaagagctccttctctggccacccagataaaggtctctgaagccttacaaccacccctcccttatcttgcccattgacagggcactggggcttactcctatgacactaactctgtaggcgtttctgccatgcaccacccccacctcatgtcagcctctacttttaaaccctctctgggtagtaataatggtggaacttatagagggtcagctgcatgcagggaattgtgcatgggtaatgaaatagctgattagtaaggttccggtcactgcaacctctgcctcctggaattc

SEQ ID NO: 565669 - DNA, 221 bp, Homo sapiens
agtctgtcgacttctgtctctctgacctctcttgtgtttcacgtgctgtgtctgatgattccaatgagtatctctaagttctagtcttacctttaaaaattgtctaaaatcaaagttactttccttaaactctaccttttcttactagccctggcttaattgtgttcaggctgctatgataaacctaaagtacctgagactgggtaatttggtaaaacaat

SEQ ID NO: 565670 - DNA, 147 bp, Homo sapiens
ttgcgtgcatgtctgcgcatatgcaatggatggtcgtgcggaactgctccagttatctgatcaagagtgaataatgcagacctacatgcactgagcccaataacttgaaggcctgcaattccttcctgctacaactgtgacttgatt

SEQ ID NO: 565671 - DNA, 474 bp, Homo sapiens
acacatagtgaggataggggagtgggtggggacctggggctgggggtacatagttgcggtggggcatggtgataacagcgcggggtgggaggtttccgtatttagtggatagatgctttggagaatagtgagtggaggggggggggggaagtagtctgacggggcggctgccgggggcacgtttgagaaaggccggggggcagcatggcgataagggggcgtttgggacaaccgggagctgccgggaggtatggggatctagatgagggagacaatggtggtaaggggcggggcgaccctgaggacggacggtgggacgccggagcaccagcgggggggagggggtgcgcctaccctgtgcacctatgactaacaggatttgctgttaacccgccttggccaccggccgtactaacgctctgccgcaatgcattgcttaccctggtgacctggggattgcatatagtttggggg

SEQ ID NO: 565672 - DNA, 83 bp, Homo sapiens
  misc_feature (8)..(8): n is a, c, g, or t
  misc_feature (10)..(10): n is a, c, g, or t
cgactatntntgtgcgctgtttagaagttgtgtgattttttggcatcgttgataaaaatgcaaagtcaaataaaaggtgtctt

SEQ ID NO: 565673 - DNA, 380 bp, Homo sapiens
ttttttttttttattgatggagttttgctctgtcacccagcctggagtgcagtggcgtgatcttggctcactgcaacctctgcctccaggattcaagcgattctcctgtctcagccttcatgagtcactgggattgcaggcatgcaccaccacgcccagctaattttttgtctttttagtaaagacaggatttcactatgttagccaagctggtcttgtgctcctaatctcaagggatccacccaacttggcctcccaaagtgctgggattacaggcatgagcaccacacccaaccaagactttcttaaacatgtttaagctaagattgtagacaaaaagaaaacagaaaagttcacagaactttgactaagccctgctg

SEQ ID NO: 565674 - DNA, 625 bp, Homo sapiens
tagtaaagaaatggctaaattttcgaggggtgggaatcgttatttcacagatgattccgaattcaccacaaaaaaaatttagccattctttactaaaaaaaccgaaaccaatctgttgtagtaactcacagagttattatagcacaaagttgtctggtactcaggaagaaatacaaatttggtcatgtttctcaagcagttttctctgagtagttcctgaggaggaacaaattacaagtgtacccaataactgaaaatgtttaactcactctcattggtaagcagctccacatatgtagacaaggggtttccaagcttgggcaaggtacattgtaacttcagataaattcaggtttcccatcatgtatggtgagtgttacactgtgagccacacaacaaacaagggctcgaaactggtgtacatcacaatgtgatttggaaaatgaacaccttgaatacgcacctaatactaacatggggggtcattatcctataaccaaaacaagtcagctcttaggaaaagaggttcaacttgatcgtcaacgaccattgtgagacctccgacactctcgtggcctaatatttctcaatacagctcaccagtagattaattcttgagacatcg

SEQ ID NO: 565675 - DNA, 218 bp, Homo sapiens
tcattgtacgggagaaagtatttatcgtgcatgaatgttgcacctgcccagtgattggctatgagggaagtacattagtttaattagcttaacgttctctctgactggactattccccgtacttctagttacttgggacagtttttatgcaaggagactaatttccaaagttatttaggcaatgacaggtaggaagattggtctgtgctggtgggaag

SEQ ID NO: 565676 - DNA, 124 bp, Homo sapiens
tgtccgccgcgccacggtgcggtccccgcttgacgcgcccgccccaccgccgttccctgtgtttccggctgtgtctcttcggggactcctctacgacgtcgaccctgccggcatgacacgcttg

SEQ ID NO: 565677 - DNA, 709 bp, Homo sapiens
gaaatcatggatgccgctctggtcctgaacgtgagaagtgggtccggaaaaccattctgcagagggagagcacggagggagctcccaaggttcatcaccggatcgcgagtgatctttcatttccggacctaatgaacatgtgattaggagcggacagatcatttgcacgacgacgtccgtcgaggttggggcccagcctcattgtcacaagtcagtccagtcggggaaaagatgttaccaacgccttcagtagagtcgtgggtggagatctcggtgctttaggctcaccattgcgcggtgtcacgacaggtgcgcctgagatccggtcggagcggacattacattcaccactagcgtgtggggtctgagcccccaaataggtatcaccagggaagcacctaagaagggcggagaatataggcacccgagggggcacagaaggggaattcgcctagcgaacgcagggtgggccagcatgtatgcgaacaagcggttgctggggcattaggagtgcggaaggcaattgtgcttgccaagccgtaaacgaacgaacaggcattcgtggggtctccatggcaggagaaccacttggagagtctaggaaagctcggagatacaaaggcgaggcccttccatgggccgtacatagcgatactaaataggtgcgaataccggatagcgtggccttggcatggggtaacgattgcac

SEQ ID NO: 565678 - DNA, 267 bp, Homo sapiens
cagatctgtgacaatctctgtggacgtgacaaaggcatgaaactcggggtttgcgtcgttgcgcaccgtgaaggtcctgttgtagaaggtgacgattgtgttcttctcccccttcttgatggccttcctgtcccactggccaatgcaggggccacaagcattgtccaggacaatgccacccagatccctgaagatctgtgcatagccggcccgctcaatggtggcgcggatctgctcggaacctgaaatggccattcaacgcctccg

SEQ ID NO: 565679 - DNA, 399 bp, Homo sapiens
tttcctctataccacaatactctattagaattttaaatttttttaatttaaaaaactataacggacagcgtggtggcttacgcctctactcccagcactttgagaggccgaggcagacggatcagctgaggtcaggagtttgagatcagcctgaccaacatggtgaaaccccatctgtactaaaaatacaaaacttagccaggtgtggtggcgcatgcctgtaatcccagctacttgggaggctgaggcaggagaattgctgaacccgggagacagaggtggcagtgagctgagatcgcaccactgcactccagcctgggccacagagtgagactccatctcaaaaaaacgcacgcaagcacgtacgctgggaggcagcgagaatctgggaggccgaaa

SEQ ID NO: 565680 - DNA, 562 bp, Homo sapiens
  misc_feature (214)..(214): n is a, c, g, or t
  misc_feature (216)..(217): n is a, c, g, or t
  misc_feature (219)..(219): n is a, c, g, or t
  misc_feature (267)..(269): n is a, c, g, or t
  misc_feature (407)..(407): n is a, c, g, or t
  misc_feature (488)..(488): n is a, c, g, or t
  misc_feature (500)..(500): n is a, c, g, or t
tcagcgggccccaagccagctcaggaaccacgcccagctcggtctctcattctctccaactcacggccacggcacccaaacggaccttatcacagtcagcacaggtggcctccacatcactaaacacaacagtcaaagcacagccccagtcttccttgatctatcaatagcatctaccgtgatggataactccctccttaaacgcctatatagngnntncaggaaactacattctggcagctcctcatctctgagtccacgtagtgnnntcccccagagttcagagctcaggcctctgccacactccctgggagagctcacccagactcaggacttttcatcgctgcctgctgacaacttccaaaggtaaaactccattcccagcctctcctcagaacccaaggctngcttccttgacatctccatgtggatgtctggtgaacaactcaaaagattcaaaaaaacaactcaatttaaaaatgtgcaangggtcaggcatnggtggctcacacttgtaatcccggcactttgcgaggttgaggtgtgaaaactgcatgaggcc

SEQ ID NO: 565681 - DNA, 334 bp, Homo sapiens
ccataaaaaagaatgagatcatgtcctttgcagggacatgaatgaagctgtaagcatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaataccttaattgcatgcagggcattaaaaccttaggttgatggggtttgttgagttgcagccaaaccaccatgggcacatgttttaccttttgttggaccaaaccttgccacttt

SEQ ID NO: 565682 - DNA, 188 bp, Homo sapiens
taataaaattattagttataaaaggggaaataggtaggagtagcgtggtaagggcaataagtgtggggaggaagtggggtgggtttggtatgtccaaacggtcatttaattttaacgtggttaaatatggggagtagtgtgattgaggtggagtggaggacgggggtaccgacctcaatatcgtaatc

SEQ ID NO: 565683 - DNA, 162 bp, Homo sapiens
ctttatcattgggttgtctatcacctctgtccttgatatttcatcttttttttcctcttttattccttttcctttggatttggggaggctctcagttgggcttctgtagctatcaccagctgatgagacctgtcttttttatagataaatcagccagttact

SEQ ID NO: 565684 - DNA, 418 bp, Homo sapiens
tcttagaggtgagtgaagctctgctcgagaatacagccagagacgagcatcagtgctgcagactatacaaggtgtgaagagtagaacacgtcttccaataatgaaggcacacatacataacagagctacatgagatgaaacactatcaccaaaaacttcctcttctccttccacggggcagtgtatttgcatcacaagtctggagttctggtgtgtctctcacattccacgtctatggtttagacttaaattcattagactctgtagggtaaccctttccctgtattctcatataaatcactaccttattctttcagaatgttcagttcataaaatacatggcgggactgttctgacaggccatgatatacaaactcttccttatagtacacgatactaaataatgctacatgcatca

SEQ ID NO: 565685 - DNA, 140 bp, Homo sapiens
tgttagagctatgtatctcattttacacatgtaaaatattcgcactcttcaaaaagaaacttagttcctgtgtaagacccttatttaaatattgctcacgatgagtcatgcttagctctcattgatacgcggggcttgat

SEQ ID NO: 565686 - DNA, 845 bp, Homo sapiens
ggaactcttcacactactattggatctagttaccagttggtggaccactgggtgatccctgccatctctgcagtgggcgacggcttgatgtatgggctatacatgggagaggactgaacacctgctcacaaggcacccgcaggaagagcctgctttggacaccggacaaaagaaaccattgctgactacttcgactgacagaagccttgcctcgagagcgctgagcgtactgcgcctgcgtgtttctctagcgacggtcgaaacaacacagcaaccactgccctttactgcccgacaacgtgccagtgcgcccttccatcggtccgctgcccgggggggcgcccctaaccgcgacgcacacggaccgcaggacccagcgtttcaagaaagccgatgctccccccacagtccattatggcccagatgcgccagcgcactaggatcggcgatcaacgaccactaccgtcgttacatccaacacgttccacaaagccctccaactctgcaacccaccctccccacactacgaacctcccacccccccactcctgctacacctatttctctcagacgaaccggagccgcagatccccgacgcccacctctttccacggcgtccccatctcggtatccgcacccgctgcaaatactaggcggatcctgagtcggctcggccccgggaacaacccgccccaccctcctataaaatttgtcaacaaccactaccacgcttcatcacaaccccccacccatgccctacccttctcacattacaaatccgggtagaaacgccacccctaagaaagctagagacaatgtaggacagtctctaagtagaaatgatg

SEQ ID NO: 565687 - DNA, 399 bp, Homo sapiens
ggtgtggtgatctagaggatcccagcagagactgttggcccgggtcgagaagaggctgctgggaaaggggacgtccaacgaagagaccacctgttctcgttcgagcaggtagtcaacaccgtcaccaccttggtgggagaacaagaaagctcagctggtggtgattgcacacgacgtgaatcccatcgagctggtggtcttcttgccgtgccctgtgtcgtaaaatgggggtcccttactgcattatcaagggaaaggcaagactgggacgtctagtccacaggaagacctacaccactgtcgccttcacacaggtgaactcggaagacaaaggcgctttggctaagctgggtggaagctatcaggaccaaggacaaggacggatacgaggaggatccg

SEQ ID NO: 565688 - DNA, 607 bp, Homo sapiens
  misc_feature (4)..(4): n is a, c, g, or t
gctncttaccacatctaatttgatcacccctgtgtgctatgtatggaattatctgggcatcgacgacgacgacgacgacgacgacgacgacgacgacgacgacgacgtcgacgacgacgatcacggacgacaatcgagggtatactcgacgacagaatgagcatctaacacagactctggggtataatcgaatcatatgacatcttctgtgggtataacacacactcttagttaagacaacccgatcgagtgtattcactagtgctaccggcaaataccgtatgaactcagcatcccacacatgtggtgtgtatatacaggtccataaacgcgcatcaatatatcaacgccactacttacctgcatactctcagtacctggcccgcacagcactggtggtcgtacaccgttcgccacgctttggtacgttgcgtatagatcactcctgacatagattcggctggtatgcgttgtggctctaacaggacgctatacaccaccgtcgtcatatactggacgaacacattagcgcgctcaatgcgctcagcgcactagtcatactagcaccatagaccatatttgatacccactgttctcacgatggcac

SEQ ID NO: 565689 - DNA, 216 bp, Homo sapiens
  misc_feature (150)..(150): n is a, c, g, or t
  misc_feature (193)..(193): n is a, c, g, or t
gattgttgctgactggaggcatacctaaagcggatctcaccgcaagttagggcggcgagggtccgagatcagcctctcctcgccagcgatggcggtatcaagcccctggggaccgggcattgaagaagatgcagacgggttgggacgacnaatattcgagggccatgtgcaagttgccatcagtggaacggcnatggacagcaacaatcccccgca

SEQ ID NO: 565690 - DNA, 277 bp, Homo sapiens
  misc_feature (20)..(20): n is a, c, g, or t
  misc_feature (24)..(24): n is a, c, g, or t
  misc_feature (274)..(274): n is a, c, g, or t
gggcgaaacaatttgaatanagtncatcaaagaatataaatggcaaataagcacatgaaaagatgcccaaagtcgtaagtcattagggaaatataaatttaaaccataatgagataccactgcatactccctagaatggctgtaatgaataggattagtcacatggtgcaagaatggaggatcatctggaactctcatacactgacgataggaatgtgaaatggatcaactactttggaagacaattgggcagtttctttcaaagtaaatgtgnaga

SEQ ID NO: 565691 - DNA, 228 bp, Homo sapiens
cactcatgcagagctctgccacccattagccacgcaggcgaggtcctgctgatccctgccgggccctgtgtttcccattagccatgcaggcgaggtcctgctgatccctgccggtccctgtgtttcccattagccatgcaggcgaggtcctgctgatccctgccggaccctgtgtctcccattagccatgcaggcgatgtcctgctgatccctgccggtccctgtgtt

SEQ ID NO: 565692 - DNA, 1100 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 565693 - DNA, 467 bp, Homo sapiens
  misc_feature (448)..(448): n is a, c, g, or t
tatccttttgaggccgactgtaaggtggtctacaaaaggcaaaggctgccactagaaagaggtgcttaaggagagcagctgtgagaaattgacaaggcatttggctccccatgaggactgccaagttaaggctggaaaccacatactggtaccagttccggctcatgattaactaatgctctcctataaaacagatgccaacactcagaaggagagaaaacacatctgtgtcctcaatacctagaacaactgttggcatatcaacaggccctcaataaatatttcttgaatgagcaaataaacataaagtttacattgatctagaactggggaggggtgaggtggttgggaccaaagaacaaaagacaaaggtaactgagggtgtggtaaaagtgtcttgaactcctgacctcagttgatccgcctgcctcggcctcccaaagtgcanggattacaggcgtgagtca

SEQ ID NO: 565694 - DNA, 125 bp, Homo sapiens
ggggaatgggcagactgaccagtccaggtggtgattttccaggacatagttagtgattaaaattctttggattcagagctctctagctgtattttgtatcttaataaataaaatcataccaggga

SEQ ID NO: 565695 - DNA, 609 bp, Homo sapiens
  misc_feature (93)..(94): n is a, c, g, or t
  misc_feature (131)..(131): n is a, c, g, or t
  misc_feature (143)..(143): n is a, c, g, or t
ggctgacttcctgttggtttgagcccctccgcaagccggactacaactaactcgtgctctcctcgctcaggcgtaagccaaggctgtgcaggnntggcaggaagcaggatgacagaaacccattctgaacncctagcaatcangttcactgtaatttaccttggagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 565696 - DNA, 843 bp, Homo sapiens
taaaactcactaatctaaccatagctgacctttgtagtagaattgacaatgttataattacaattgcacaatcttataattcacaatatgtatttatgtcttttgctatggagcaaatccaggaaggcaagagaaacgattgctttacctaaatataaatgaagaatctatcctttaaactcttccactagacgttgtaatgcacacttatttcttttcccaaggagtaaccaattactttctaaaacacatttaataattttaaaactattgatgaatattgatgaaagaagacataattcacacattaataaagcaatctcccaagtattcgatttaacgttcatttttctaagtaatcataaactatatttctgtgaccatgctaattgtattagttcaagatgtcacgtcgttagttcgaaagcctctcactaaggtatgatctatgctatattcaaaattcaacccatttactttggtcaatagttggatctaagttgcagtctttgaagtcctggtggtcttgccttctgattagacaatttgtatccttttctattaatgatatatcccgtcagtattactcttgcaatatgtattacggatattcccaagcaatccaaaaagggtataaacgctgcttaaacacgcacatgtggccacacgctgcgggctcaagcaagcacttgccctgtaagcccacagctcagaggacaccgtgccaacactgaaagggcaagggcacaccgggcagccaaaagaggagacctcagagagaagccggggctcgacacaaccgggcgaagagacaacacaaacaaaatgggcccggggcacacc

SEQ ID NO: 565697 - DNA, 1154 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
  misc_feature (615)..(615): n is a, c, g, or t
  misc_feature (619)..(619): n is a, c, g, or t
  misc_feature (642)..(642): n is a, c, g, or t
  misc_feature (644)..(645): n is a, c, g, or t
  misc_feature (652)..(654): n is a, c, g, or t
  misc_feature (660)..(662): n is a, c, g, or t
  misc_feature (664)..(664): n is a, c, g, or t
  misc_feature (696)..(696): n is a, c, g, or t
  misc_feature (701)..(701): n is a, c, g, or t
  misc_feature (703)..(703): n is a, c, g, or t
  misc_feature (718)..(718): n is a, c, g, or t
  misc_feature (725)..(726): n is a, c, g, or t
  misc_feature (732)..(732): n is a, c, g, or t
  misc_feature (753)..(753): n is a, c, g, or t
  misc_feature (757)..(757): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaacccccantacncgcccgcccccccaaacgccgcncnnaaccccnnntgcccnnncncccaccgcctcccagccccggaagccgacganacatncncccccaagagcccancgccganncccccnccccccacgccgatccacgcncccnccctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 565698 - DNA, 901 bp, Homo sapiens
gtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttggtcctccgggtatccctcagtctcttatattggggggttaaatttatccttatggctttagaagagcaggtaggttggccattgttgtccagcagggtgcccttaaagaaaattaccatcttctctaagccacgggaatttttactttacctatttttaacctttaacgggatgtcagggtcattcaacctcaagtctttacattatccatgtttttcccatatatttggtttatatagggcccaagttcccccttaatggggatctatatactaccagcacaacttcaaaaacttgtactggaatacttcagagctatatatgtaacggaaatgacggggtgaccccattatcatcatggtcggaatccatgttaagtaaaccctctaggggaccatagggcaatggagacccttaccgaaaatgtggatgccataagcatctgttttgccctcctcttgggccacatgcagtgggccttggtgctacagtggcattgttaaccagaaattgccgtgcttgcccaaaatccttgaacctggggctcagaaacagttttcaccc

SEQ ID NO: 565699 - DNA, 298 bp, Homo sapiens
aacgcaaattctgctgcctcagcttcctgagtaacttggactacaggcaccacgccagcacgacccgagctcattttttgtatttttagtaaacactgtgtatctccgtgttggccgggatcgtctcgatcttctgatcctcgctgattccacatcaccttggcctcccatacgtgctacgatttaccggcgttagccactgcgcccggtccatgtttacatacattgggtttataaggtaaagatcttttgttgggcctttagtgtgatgagatgccctctgaattgactagtgaag

SEQ ID NO: 565700 - DNA, 365 bp, Homo sapiens
tttaaacaaaaaacaagactttttttttttagagtggggccacctatgccccccccaacagagattttacatggaaaccgggctcagtgagaattgatttccggccccatatttgtctttggggggtctttagtgtttaattattaaggaataaagctggttaaacagttcaaggctttatgggttgtaaaggaacctcaaaataaccgttaagatagtgaaacacagcagcaggtttccaatgcaaacaggtagtttgcatttatgtaaaacattcagaaaatgaagttttgaatttgttggaacattcaaaggacttgagagcattttattgtaacttaaaaaaataaaaacaactgtcccca

SEQ ID NO: 565701 - DNA, 238 bp, Homo sapiens
gtgcacatacaccttaacctctgtgctctactttctcaaaccccacagtgagcaagcccgtatcgtcctcatttggtactccctgttgttccattgttgtcccgaaacgcggatgcctctcctggctgatgatggccccgggcctggaaactgggttcatcctgagctctgcgaggggcttgggttccatgcacagcaggcacctgcgcatccccctcccccatcccccttatccgag

SEQ ID NO: 565702 - DNA, 1202 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
  misc_feature (1168)..(1168): n is a, c, g, or t
  misc_feature (1170)..(1170): n is a, c, g, or t
  misc_feature (1174)..(1174): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagctcaaggcacctaaagagcctccccccagctcccatggacgacttcccagctcccttagacaacaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaaaaacaatnanaaanaaatcacaaacgcgagactagttctctc

SEQ ID NO: 565703 - DNA, 1094 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 565704 - DNA, 770 bp, Homo sapiens
gccggaactcggggcgcgcatccgcaagtagtgagcccggcggatcggatcccgcagatctggagacggggcctggagggtggctagtacgcaacagggtgtccctgtccctcaaggggtcatgggctccatgttgctgcgcccgagctgcgctgggcctgcaggcttccagctagcagctaccggctgctggtgcctggatccagacacattagatcaagctgcgagccgagaagtcgacgttgaagttgtgattagtgatggggcgctcgtgatgaagactggaagtcccatgggccataggatctcgggagttaatgaaacagcgtgaatatatattcagaatgcaagaggctgtgcattgtttcactgcaattacgaagagagccgaggcaattgacctggttgatgtggagcggcaaccgaatgctggatctttatgcccagatctcctctgtccccataggttacatgccatcccgacctgctgaaactcgatcctaacgagtccgtcaataatgcgagcatgtatgtcaatagacccggcctcggaatcctgcctccggagaactttgtggagaagctccggcagtccttgctctcggtggctcccaaagggatgtcccagactcatcaccgagtggcctgtcggctccgtgctccgaatgagaaacgccttagagaccagcttcatgtggtaccggagcaaggaacgagggcagaggggcttctcccaggaggagctggagacgtgcatgattaacaggccg

SEQ ID NO: 565705 - DNA, 724 bp, Homo sapiens
  misc_feature (208)..(208): n is a, c, g, or t
  misc_feature (211)..(211): n is a, c, g, or t
  misc_feature (698)..(698): n is a, c, g, or t
aaaccccggcggcaccgctagagtcggtcactcctctatagtccatggggatccatctcccatcaaacctgacagcagtgcgtgccttgggccgcgctttggcccagacaccggttcacagcaatagcacgacgggcacaatatttcctgacttgagtgttcccttctaaatgcgaacttttattcctcttaaactatcctcaaatanttnaacctttgtcttgatcttaaagatcgtgtagattggggttggggagggatgaagggcgaggaatctaaggataatgaaataatcagtgacgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaatnaattcctacaacttaattgaaagggg

SEQ ID NO: 565706 - DNA, 207 bp, Homo sapiens
ggaacgggctgtagaggtgaactggtcgaatgtaccccttttacagatggaaccctgaagctcagagacttgtaggtcccgggctttggttgtacaaccagtatctggtactgcttgggctaggaaagaggcttcgcgtccgagcattagggcctaccctgtattttgcgttttacgaccctgtaacccccaaaggtccgtgactga

SEQ ID NO: 565707 - DNA, 133 bp, Homo sapiens
gtgtgaacagtcagaataagaggtcacttgtgtgaagagcatgctttaaagggtgctagagtagcgagtaatacctgcctgagggaccaggacaggagaccgggatgagaagctttcaagaagcaggaactgg

SEQ ID NO: 565708 - DNA, 1029 bp, Homo sapiens
  misc_feature (12)..(12): n is a, c, g, or t
  misc_feature (98)..(98): n is a, c, g, or t
  misc_feature (122)..(122): n is a, c, g, or t
  misc_feature (173)..(173): n is a, c, g, or t
  misc_feature (220)..(221): n is a, c, g, or t
  misc_feature (270)..(270): n is a, c, g, or t
  misc_feature (272)..(272): n is a, c, g, or t
  misc_feature (274)..(275): n is a, c, g, or t
  misc_feature (277)..(280): n is a, c, g, or t
  misc_feature (288)..(288): n is a, c, g, or t
  misc_feature (381)..(381): n is a, c, g, or t
  misc_feature (428)..(428): n is a, c, g, or t
  misc_feature (484)..(484): n is a, c, g, or t
  misc_feature (493)..(493): n is a, c, g, or t
  misc_feature (504)..(504): n is a, c, g, or t
  misc_feature (519)..(520): n is a, c, g, or t
  misc_feature (1003)..(1003): n is a, c, g, or t
gctgagccagtngcctatggacaacttatttaaaaatatttcagatatcaaaattctagctgtatgatttgttttgaattttgtttttattttcaagngggcaagtggatgggaatttgtcngcgttctaccaggcaaattcactgtttcactgaaatgtttggattctcttngctactgtatgcaaagtccgattatattggtgcgtttttacatttanntttttgcaataacttctatattttaatagaaataaattcctaaactccntngnncnnnnccctttcnggaatttaaaattaagtagaacaaaaaacccagcgcacctgtcagaggcgtcacgcgctattggcatggggagcaatggtcattaaacgtgangcaggcggggctgtggcagggttttggggcagacacctgggcacagnaaaagcatgaggggaaaagagggcctgacgtgagtgggccttgggaaaggggaagngggagggcnggttaaggagnggaaaagaggtaagnngttgtcttgatcttaaagatcgtgtagattggggttggggagggatgaagggcgaggaatctaaggataatgaaataatcagtgacgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaatnaattcctacaacttaattgaaagggg

SEQ ID NO: 565709 - DNA, 234 bp, Homo sapiens
cagtcgtaaggcgcccccatgtcccagatagctgtctctccctagcatcgactacgcagagctgctgccgcactttgagaaggtccagaacaagcacctggaagtgcggcaccagcggagcgggcgtgcggaccaacctggaccgggaggtttgtcctctgaaaggcctgcacggaggagggcccaacgagtgttcccatgaaccactaagggtcgtcacgccctccccgagga

SEQ ID NO: 565710 - DNA, 888 bp, Homo sapiens
  misc_feature (339)..(339): n is a, c, g, or t
  misc_feature (441)..(441): n is a, c, g, or t
  misc_feature (444)..(444): n is a, c, g, or t
ttgtgttcaggtggtttttgttttggttcgcggtctttcgtctgttctcgcggtctcttgttgtttgttgttctcttgtggtttgtttgtctgctgcgtgttgtgctttgtggtggtgctggtgtgcatcttcgtatttttgagggttgtggtgttggtttatggatttgccgtgggtcctgttatgtcggttccttgtcttttgtcgttgttgctattgggagttcggtgtttatgatggtggttcttgccgtggataaccgcatatgttctgggctggcaagacagaccggggttcccgtgtgcctgagcggaccttcccagctagattcactccanttggacatgggcccagataccatgatgctgagcccggaaactccacatcctgtggacctgggccatagtcattctgcctgccctgaaagtcccagatcagcntgnctcaatcagtattcatatttatagaccaggtacctgtcgtcaacctgtgagagccacaagttgagctctaggggggtacaggccaggccactgcttacgtgatcagctaaaagcagcctgcagactgcgctctcccagtctctatcccaacctctcgcctaactataatatcataggatgctgcagcccccatgggaaccaggcaccgctccagaatgacctggccgacagtgaggacggattgagaaggagctgcccaggaggggcttctgggaagactctggtcaagaagcatcgtgtctggcgattgtggggatgcaactagtgtatgttttgtatcttccgtcatgtagttcttcaaagatagggagggaaagggggaacatgagcctttgtagctatcaagcgccagaacatacgttggcattattcaacctttcaccg

SEQ ID NO: 565711 - DNA, 646 bp, Homo sapiens
  misc_feature (19)..(19): n is a, c, g, or t
  misc_feature (24)..(33): n is a, c, g, or t
  misc_feature (43)..(46): n is a, c, g, or t
  misc_feature (48)..(50): n is a, c, g, or t
  misc_feature (52)..(52): n is a, c, g, or t
  misc_feature (54)..(54): n is a, c, g, or t
  misc_feature (83)..(83): n is a, c, g, or t
  misc_feature (114)..(114): n is a, c, g, or t
  misc_feature (117)..(118): n is a, c, g, or t
  misc_feature (137)..(137): n is a, c, g, or t
  misc_feature (163)..(163): n is a, c, g, or t
  misc_feature (200)..(200): n is a, c, g, or t
  misc_feature (206)..(206): n is a, c, g, or t
  misc_feature (221)..(221): n is a, c, g, or t
  misc_feature (228)..(228): n is a, c, g, or t
  misc_feature (237)..(237): n is a, c, g, or t
  misc_feature (247)..(247): n is a, c, g, or t
  misc_feature (252)..(252): n is a, c, g, or t
  misc_feature (296)..(296): n is a, c, g, or t
  misc_feature (314)..(314): n is a, c, g, or t
  misc_feature (340)..(340): n is a, c, g, or t
  misc_feature (363)..(363): n is a, c, g, or t
  misc_feature (367)..(367): n is a, c, g, or t
  misc_feature (371)..(373): n is a, c, g, or t
  misc_feature (376)..(376): n is a, c, g, or t
  misc_feature (415)..(415): n is a, c, g, or t
  misc_feature (452)..(453): n is a, c, g, or t
  misc_feature (457)..(457): n is a, c, g, or t
  misc_feature (490)..(490): n is a, c, g, or t
  misc_feature (497)..(497): n is a, c, g, or t
  misc_feature (504)..(504): n is a, c, g, or t
  misc_feature (517)..(517): n is a, c, g, or t
  misc_feature (528)..(528): n is a, c, g, or t
  misc_feature (577)..(577): n is a, c, g, or t
  misc_feature (641)..(641): n is a, c, g, or t
ggagcagccgcagcctgcnccccnnnnnnnnnncccccccccnnnncnnncncncgccctccgccgccctccccccgccccgnggtctctttcccccttcctcctccccctccnccnnacccccttcctcctccgcncgcccgcggggcccccctcgccttanccgcccgcccctattgttccgcccccggcctcccgcnctttcnctttccgcccgctcnccttttnccctcagtngcctcgcgcntgcantttttggctttcacccccaaccagtgaccaaaaactttaccacncaaaatccagctccccanaacactgctcgacatggacaccggtntgattgaaggtggattaaatgtnactntcannntcnggttatttattcatggaaaggaagttggcagtatcatcngaaagaaaggagaatcagttaaaaagatgcgcgaggnnagtngtgcacgtatcaacatctcagaagggaattttnctgaganaattatnacttttgctgganccactaatgcnatcttcaaagcctttgctatgatcattgacaaactgggaagaggacatnaagcagctctatggaccaataagcacagctggccagtagaacccccggtcaccctggaggctgngtggt

SEQ ID NO: 565712 - DNA, 411 bp, Homo sapiens
ccgggcgcggtggctcatgcctacaatcctagcactttcagaggccgaggcgggcggatcacttgaggtcagaagtttgagaccaggctggccaacatggggaattcttcattttcacttaaaattccaaaattagccggtcgtggtggcttgaggctggaattccaggtacttgggacgctctagcaagagaatcgcttggacttgggaggtggaggttgcagtgaaccaaaattgcaccactgtacttcagcctgggcaacatatcaagagttcttttcaaaaaatataaatttaaaaaattcaaatattcaaaaaaaacaaaacatctttcaattttagcccattttttggagtacttgctgtaccctgtcacaattgcataatttaaaaacgcggggaaattaagtt

SEQ ID NO: 565713 - DNA, 415 bp, Homo sapiens
tagccagtgaccctcaagcgtgtgttgcacaagaattacttaggaattccatttacagattgtaatttcaccacaagcattcccttccccacctctcacttcttcaaatcccactaaaatgacagtagaggaataaaaacacattaatctacaataataaagacaaagagaagggagacacaattagaattagagatttcgacaagtatttggacaaagacacatgtttggaagacggaaagtgggtgaagaagtagtaattaacttagcagagaggaacaggtcaaaacctaagtgtaaagataggggccagttggcctcagagatccttaaagtgtcaacatttgggatataggaggtgtcactaaaggataggtcaggtgtttaggctcaaacatgggagatgtttgaaagt

SEQ ID NO: 565714 - DNA, 276 bp, Homo sapiens
tctaagatcctgctgctcctctcacagatgcggtatatgtaaatacatacataacagaactagcctcaatatataaggtgggaaatgacatagaagtaaggcagtgcagggtcctgctgtactcccagcacttcgggaggcaagtggggggggttgcttgattccaggagttcgagacagtctggcacatggaaaacctgctccacaaaaaataaaaaaattagccggtatggtggtgcacacccgtggtcccagctactcaggaggctgaggcgg

SEQ ID NO: 565715 - DNA, 191 bp, Homo sapiens
aatcaaccacatgcccagccctgaaggactgagggagcttgtgcgggatcccgtcatccggactccccacacaggtcaactgattgatggccatgggcatgagtctctggatctcctggaggttagcccagcctcggcctggagcacagggcctgtgatctgagaatctcagatccagaatcaggagctgg

SEQ ID NO: 565716 - DNA, 1452 bp, Homo sapiens
  misc_feature (426)..(426): n is a, c, g, or t
tggatacttgcctaacatgcttgtgctgtaaaaatagttaacagggaaataatcttgaaatgatggctagcttgtgttaaaggtcttatgaaatttccatgaacaatccaagcataattgttaagaaacacggtgtattaaatccatgtaagtggaataaaagttttatgaatggcacttttcaactactttctctacgagctttccagtttaaataagctctgggtcctgaaacttctctaagaggaaatgtgtcacatttttggaacattaatctccttatctccctctgtggcagctaagtgggcttcttaccaagttttaaacaccaaaaattatatcaataacaaaaattactacctaattatataacatacgtgtttctccagtgttcccatgtgattccccttcttctttccttccccnacccttgaaaaacaaagtgagtttccatatattatttctggggaagaaaggggcgggacatgtgcattcagaaaaacacaacagtgctcaggtggtgtttctccattttaacaatttctgtggccaataagtggcccatttctcataacctctaaggaacagccacaaacgtgttcacgtgtgagcaccaaatcaagtgcaccaattggggatacgcatcttaaaccgtgtaaagttataggggaggcttcccacaaattcaagcctatagaggggaattgcttaaacgaaaatttctttggaaaactcctaaaataaggccgtggctttcacattttgtgactcctcgttataaatgtaccttatgacataaattgtggctccagggtgtgtccaccgaaagaaaattaacccgtttagcggtggttttataacgcccctgtcttggttcttttgttacacccgaaacccaagtttctttaacttggtgggtggggcccatgatatcctcgtgtggaaaacaaatgagctccgaattgatgacatcttttctgtgtgataccacccatccaaagtgtcctatagcggacaccccccgggagtacccaattgggcatgtgagccaccccccaacggcagctgtagtgttcgccccacctacacataattatacatgggagcaagaacacttccctataaggctggatcaagagacagcggggggaaacatcccccgtttagaaaaccgcaaccacacctcgctgcagagagaggctggtgccgagtagcgagccacaaagaaaccgactaccagcaagtagtagcaccaccacatctcaaaaagaggcgggggggcagcatcccaccaccacagaaaacaaaagatactcaccctgctgggtgaagaagccaaacaagcgctcacacagagcgtcctctacaaagcgcacacacgacacgcggagttctgtgactagagcacaagctcggctgccagacaaaaaaaaggcggcgcaccgctgttgc

SEQ ID NO: 565717 - DNA, 306 bp, Homo sapiens
  misc_feature (38)..(38): n is a, c, g, or t
agtgactagaggatccccgactgctccctctatcaggnctgggataacaggcatgagctataacccagcgcatgctatggtttgtatgccttgccaggccattgttatagttgcttgtaattttcacagacttaagtctaagtcttcagtttccaatttccagacctccggtccccaccttttcctatttaacttgtctcttgttacctctcagccttggctctgctctgaccactgaggctccatactatctccttgggttataccctttgggtctaagatttaggccgtgaagagggaggcagc

SEQ ID NO: 565718 - DNA, 607 bp, Homo sapiens
ccacaggatctattgcagaattgacccccaaaggttaaccacctggtcccagctgagaagaggaagcccatcctagttctgtctctctttgatggaatcgctacaggactcgtggtggtgaaatacttgggcattcaggtggaccgctacattgcctcggaggtgtgtgatgactccatcagggttagcatggtgcgacaccaggggcaagatcatgtacgtcggggacgtccgccgcgtcacacagaagcatatccatgagtggggcccattcgatctggtgattgggggcagtccctgcagtgacctctccatcgtcaaacctgctcgcaagggcctccacgagggcactggccgtctcttcatagagttctaccgtctcctgcgtgatgcgcggctcaaggagggagatgatcgccccttcttctggctctttgagaatgtggtgggcattggcgttagtgacaagagggaaatctcgcgatttctcgagtccaaccctgtgatgattgatgccaaagaagtgtcagatgcacacagggcccgcttattctggggtaaccttcctggtatgaacaggccgttggcatccactgtgaatgataag

SEQ ID NO: 565719 - DNA, 401 bp, Homo sapiens
aaaaacagttctctctgctggataagtgtgccaagagaaccacgtgtgctggtggaaaagcgctggacctgctcccagcaccacagccgacagcagcaaatggccattgaacacttcaaaatgcggttatcagtggatgcctcaccttagaaaagtcccgtaaaactgaggaagattgtgggaggtatccttgggggtcatctagaccagcactccagcttgccccaaatctacagatcaaaaaagcaaagtccagagaagtaacgtctcaaggtcacataagtcagtccctatcaacaacagcactaaaatcaaggcttcctaaaaccagtcggatcattgttccattatagcatatggtaattcttgttagatggaaaacagaaatatttagaaaaaaa

SEQ ID NO: 565720 - DNA, 116 bp, Homo sapiens
ccatgttgtctggtccctgttcaacaccctcttcatgaacccctgctgcctgggtttcatagcattcgctactccgtgaagtctagggacgaggaaagatggttggcgacgtgacc

SEQ ID NO: 565721 - DNA, 708 bp, Homo sapiens
gggctcagcataccacgatcatcgaggttctcttggccgacaccttctgcgtggaagcttacttgcagaatctcttcagcctctgtcagctggacaagtatgctccagaaaacttagatgagcagattaagaacagtgtccacatgcagatccttgagaagtcgagcctatatgctagtgtcctcacacctgcgtgtgaccaaggaaacattgactgaaggtcacggggaacagtgttcccccgtgctaaccgcccgcccactactccataggtctccgttgtcttggatgatctgttactcttttttcagaaggtgttgggattatcacaggttaagccttttgttccccgtctgcacctgaagggttgtcgcctggcctgggagagcctcttccaggattcttgacctgcaggcagatgcgtctctcaacaggaccatcacagtctgtactgaacctgagccgtgagagagagaatggaattgctgaccctggatactggcgggtattctggtcattgagcgagacaccatacgtggccaactggggctttatgctgctgcctccagggtgtgaggtgggtggggacctgtgtccaggtgtggatagccatttctgctcaaccacacattctctaagaaacagcttgaaagctcatgtctgggtcattcatttaaactagaagacatgaggcacttaaaacatgta

SEQ ID NO: 565722 - DNA, 691 bp, Homo sapiens
ggataccacctgcgtggtttcaagtatgtgccgtacgatgggtgacagcaagcgcgcgctggatgagtatacctcgagagctgatgctgggcggaaccaacacacaggatgcgtgcacaacacgctgtgaggactcgcatgctggccgcacccaatcatgcatggaccgtaacgctagactgacacagagactagtgaccagcagcgatgagacttactagcactgacatggaaccccgagaccgacagcaccttaccacacaccgatgtctagtccctagctacagaatatacactcttacaaggacgaccacataagatgaccgacccaggaaagaccggtaggatcaaatagacgactatatgaaccgcgcagacagacagactgacaatcgaagacaacagtcacatcagggccctgcagatggaggacatccacggacacaaacgagaaaacacaacaaatgaccaaacacttgcggaaaacaacacaggacatgagcaggccgacccagaggacccacagaagcatcaaagacgacgatatgagaccccggtggacatgaccacacatacacacatagtggattgaaacaagagacaacggacccggataccacgcatgcccacacaactgagcatgccacacggatgcattgcccaatgggcaatcctgccaacgagggagcac

SEQ ID NO: 565723 - DNA, 1413 bp, Homo sapiens
  misc_feature (286)..(286): n is a, c, g, or t
  misc_feature (546)..(546): n is a, c, g, or t
  misc_feature (903)..(903): n is a, c, g, or t
ctttgtgttcctgtgtgttggtctggtcttctgcttcttttgggtctgtggcgtttcgtcctcgctgtcgtgcttgtgttgtctcttgcttggttctctactgctggcgtctgtctgctcctcctgcgctgctctgtgctcctcttcgcgcttgcttgctcacgtcgcctcttgagctgcgtcttttctgctcgttggctgtcgtcttcctcgttgtgccgttctttctctgctcttgttgttcttgctgtgttttgttgtgttgtgttttggtgtgctcggtttngtcgcatggaagaaaacagcgcgggttggacgtggggtggtcgtcagccaccggaggttgtgttttgtgctagacgtgtggatcctcctagtgttggtttgagagtcgtcctttctcgggtgtctctctctcttcacaaatggtcggtgaaacccacgttggttcccgtggggagcccctttcttttctgccgccccaatgtgggctctttcttcctgcgtctggaaacccccctggggtctctctgtcccctcctagancgcccgtggtgtgtggagccgctgcatctattggggcgtcctctgttgtcatgagcttgtccgcgtgtggtgtgggcaatattcgcttgctctgttttgtgagccttcccgaatatacgccccggggggcccccccccccccttattggggggggtttctcaaacacacctcggggcgcctttgtgaccgcccacggtacatacctttcttggcgggtgtatgcgcccctcgtgtctcgccttcccatgcaacccctggggggttctttttgggttgacatggaccccccgccacggctctgtttgttcagggcccgccggcctgcaccgcacgcgttcctctccattttggggcanccggggagatccacacattttgtgccacggggccctcccgctgtcaggcgcgccctacggctcttgcctcgcccttttcttggatacatggcgcccactcgccgtggcttttacatagaatagagcaccctcggcggcggtgcggaaaacgccgcggcaaagaagacaggagcgttttcctgagtagaaagcgcagggagaggcggtacttccacacaggttctctgttatcactcaccacgctggacgcacaccgcggcggcgtgtttctttgcctccaccccccgtctagagagcagagtagcagagagagcgtccacgacgagtaaacactcctcgttgtaatagtaacagacgtgctctctccacaagcacacctgttgtctttcaccgctgttgctctccgcggtccgtccaggccgctcgcgccctattgaggagtctttctcccccgggagtaggagaagacaaatacagacgcccccggcgagaacaaatagtccgagaaaa

SEQ ID NO: 565724 - DNA, 1406 bp, Homo sapiens
gagcagtgcgccgcttcgaggccctgcgagaaaactgcgcgccgagaccgctcctgcagtattagttcttgcagctggtgtgtggctggctgagtgcggcatggatctcagctgagctggagagagacaatacatggcctgctgtctgcctgagttctgcctgtgccctgctggtgtgcctgcaaggagccttgctgtcctgtgtgctgtccgactgacgtgctgggcatgtgggcccctgtgcttgtggccccactggatctactgccactctgttatttgtccccctgcctcgccttggcagactctcggagtgctgctgacaatgttggccacgactccaaatgaccctatttgccccgcagccgacgcggcgacaacggcttgttcttgccgacacaacttggaagcgacactggaccttccgtccggcctcgccgcgctcgggatcgttcgctcgtctcccaaaacctccatctctaccaagcatgccttggggccgcggtcacacactacacaccgtgcaaactcccatgtcaacattgactacacgccaactgcgcgccttactaccacgctattgccctccggacccacgcgcaccttgcacaccgctcaccccgagcgtcattcaggtgggcaccacccgctacggcgcatgccgcacgagcaccatacacacgggtcgctggcctgcaccaacacgcttctcccccggcgcatctgcagcgcttgaccggtccaccgccccaccagccacgcattgccacctcctaacccctgtgctgcgcccagggtcggccttcggcccacgcattcgttgcttgcccatctctcggcccccgtggaccccaccgcccgctcgcccgaactcctcgcgctgcgtcccgctgccaccaccgctttccctcggacgctttgcgcatcacctcgaccttcattgcggctcccagggtacactcccagttggaatcccccaacgaacagaaacagcaccgtagacgtcagcaagtccgcgcacaccgttggcaacgccctcgctcgtacccgggctttccccccgcgacagttctggcaccccgcgtacccacgccctggcgcggcacgagggaccccaagaacccagtcccgcgttcaaacaagaccgcgccgaccacacagtctacacacctgcgcgacgcgaagccaccccgcccactcgcgaacacaccgacacagcgcaccccacacgaacagacacccaccacacagcagccccacaggacgcggacccaacccgggaccacagcacccccacacgcaacacccgcacacacccgcgcagctcaccaccacacgctcccccaccccactcagccaccggcccccccaccccgcacctgcttctgccgcaacacccaccgcca

SEQ ID NO: 565725 - DNA, 687 bp, Homo sapiens
tgggtgagcctttatttccttcttttttctctttagcctcgcctattccaggggtgtggtttcgtccggatgccccccagaagggagggtggctcattcggtttaaaagattgggggggaaaaaaaatttcaaaacccctggggggggaatgcccttttttctcaaaatttttaaagaggggccttttttggaaccctctaaaaaatttgggaggagggaacccggttttttcaaaaaaaattttgttgtgggggggcccccaaaaaattgggaaaaaaattttttttcctttttttgggaaaaatattttccgcggggcgctttttttttaacaaacttggggaaggggggggtttggggggaaaaaaaaaccccgggaaaaaagttttttttttttcccaaaaaaaaaaccccccccccccccccccttttttgaacaaaaaaaaggggtggggcccccctttttttttttttaaaaaagaaattttttataaaaaaatattttttgggggggggggggcttttttttttttttttccgccccctttttttttttttttaaaaaaaaaggttttctttatttaaccgcccgcccctataaaaaccccccccccccccccccccaaattttttttgcgggggaggggggttttttcccccaaaacaaaagaggggggcccaccatg

SEQ ID NO: 565726 - DNA, 210 bp, Homo sapiens
tagtacaatataacatttaccatgctaccaacaagttcatttcaagccaaaaagtagctaaatacagttatacatttattaattacaggttgaagttctgggatccaggagaaacttaagtccttgtattgcaatagccatgtcttaagtttatgtgaatgtgaaatttctattaatcattctcatcttactcttatataaagtgccgac

SEQ ID NO: 565727 - DNA, 190 bp, Homo sapiens
ggttctttctggagctcttccttttctgaatctgtgatggtagacattacccctgagtaggaagcaaagccggcatgcctgcccaccagcttcctgtatttaccttaatggagttttaaaacacagcttctgacatgtgtacaaaccatgcatggtacaatgtggacgcctctgttggaggtcttcatta

SEQ ID NO: 565728 - DNA, 362 bp, Homo sapiens
ccccacccggcccaaggaaatatttaaaaaataaaataaaataagttatttaaaaattggggcaaagttggctgggcaacgggtgtcgcgcctgtggtcctagcactttgggaggctgaggaagggggatcgcttgaggtcaggagttcaagaccggtctggccagcatggtgaaacactgtctctactaaaaattcaaaaaattagccaggcattgtggcaggcacctacaatcccagctactcaggagactaaggcaggagaatcgcttgaacctgggagacggagattgcagtgagttgaaatcatgccactgcactccagcctgggctatggagcgagactctccctcaaaaaaaaaa

SEQ ID NO: 565729 - DNA, 201 bp, Homo sapiens
gcatctcagaccaagggaatacccttgcattttaacgtgatagaaaaagctatcagtggacaggagccaaagataggcctgagatagtgaacgagctaccgagtactaacaatccatatagagtagagcttaggaacgcagatagcttctcccggtatgagacctagagatagactagtatgacccgagtatagacaccta

SEQ ID NO: 565730 - DNA, 146 bp, Homo sapiens
ccccgacgtaggggaaacaaacggcaaggggaattggcaaaagtagagaagttggcaagacatatccttacaggcagagaggcttgcgatacaaaataattgacaaaactcagttgaatccaacaagtctacagagaagctcttca

SEQ ID NO: 565731 - DNA, 107 bp, Homo sapiens
cagctcacaccactttggtgaggatgccttcctccctgagattttcagcaccatctcggactggaaccttccaggaatccctggacctctctgagtcctaccaatca

SEQ ID NO: 565732 - DNA, 658 bp, Homo sapiens
  misc_feature (72)..(72): n is a, c, g, or t
  misc_feature (121)..(121): n is a, c, g, or t
tgctattgttgcagaaagtgctgccattggaaatgcagaggcaaatgcattcagtgtacttcagcatcttcnttggtgctggaccacatatcaaaaggggcaacaacaccaccagcctccntgagccagagtgttgccaaaggaagtcaccagccttttgatgtttctgcatttaatgccagttactcagactctgggctctttggaatttacactatttcccaggctgcagctgctggagaggttatcaatgctgcctacaaccaagtcaaagcagttgctcaaggaaacctttccagtgcagatgtccaagctgccaagaacaagctaaaagcaggatatctaatgtctgtggagacgtcagagggcttcctgagtgaaattgggtcacaggctctagctgcaggttcttatatgccaccttctaccgtccttcaacagattgactccgtggctgatgctgatgttgtaaaggctgcaaaaaagtttgtttctggcaagaagtcaatggcagcgagtggaaacttgggacatacgccttttctcgacgagttataacacatgcgtgtatttaaagctcagcccagaccagcaagcacatcaaagtcaggtctcttaataattaattaatgttaattcaacattttctcaatgaagt

SEQ ID NO: 565733 - DNA, 694 bp, Homo sapiens
atgttttttaaagatgttttggggcacacaaaataaaaaagaggatttaaaatattttatttccccccggggggaaattcttttgtaaagggccaccctaaaaataaaatttttaccagggagtgagggagtagttttctggtattggggggagatctctgccactcaaatgataattatgtttctgtctcactctcttgctctccccgtgcgatttttgcccgacgcataggtaaaggcccaaatccctcggagcgtggtgatagctggttgacaagatagactctgagccctcttttaaatttgcccacagaacccttcaatgccccttgtaactttaactgttagtccaaaaaggcacagctctttgtacactagcaaaaaaccttgtatagagagtagaattttcctccaccatagtaggcctaatagcagcctcggtttaagagagcgttcaagatcaacacccactacctaaaaaatccctaacatatagctgaactcctcacacccaattggaccagtctatctccctatagaagacctaatgttagtataagtaacatgagaacattctcctcggcataagcgtgcgtcagattaaaacgctgtctgacaattaacagcccaatatctacaatcagcgaacaagtcattattaccctcactgtcacccaacacaggcatgctcata

SEQ ID NO: 565734 - DNA, 405 bp, Homo sapiens
cccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaaccacctgccagcaaattggacaagtcctcaaagagctagtgcaactggtcctcccaaggcccttccctgagcatctattctttaagttcgcaccatctaaactatggtgtcgcaactcctgtgcaatattgccacagccgcgtctcaaactctgcacgtcgccacacaaaaaaaacacaacaacaacacaaaaaa

SEQ ID NO: 565735 - DNA, 122 bp, Homo sapiens
tctcggtgtgtcgtgtggtatgtgtgtgtgtgtgtggtaattgcgtgtgtgtgtgtgtgtgtgtgtctgtgtgtgtctggtgtgtgtcagagtctcgctctgtcgcacagggtggagtgcag

SEQ ID NO: 565736 - DNA, 165 bp, Homo sapiens
gtcccacgaggcttccatccccagctggcctccgtgctcttacctcccggtggtcgggcgcgaattactggaaattggcttttcccgttggggccgaaggtacttcccttcggcggcgacttaacgggtgtcgttccggcccgcgttacgcaaccccgattcgcg

SEQ ID NO: 565737 - DNA, 228 bp, Homo sapiens
  misc_feature (47)..(47): n is a, c, g, or t
aaaaaccactctatatttattctttatagaacacacttttcttcctngatggataacaaactgtctgaggtttcccacattaataaatcccattctgtggctttacatcctgaatttctgttcttaatcagggttcagtatcattatccccagtgattaaaatttttccctgggatcatcagggctgtgcctttgcctttgaaatcccttaccctcccaaatttcggg

SEQ ID NO: 565738 - DNA, 217 bp, Homo sapiens
  misc_feature (44)..(44): n is a, c, g, or t
tcttcaggagaaggggcaccactgctttaaaaaacaatactccnttatagacttgaacatttgcagacattatgatcttgcttccaactcccaccgtatgtccagcaaactctcgcatgtggccactaggaggaatgcgcaagaatgttcatattacatatttataacattaataactggaaaaagtgaaatgcatgtctgttacaggaaaataggc

SEQ ID NO: 565739 - DNA, 150 bp, Homo sapiens
cgctgcacccgggccgccggttccagcgccgccgtctggaaaaagagccaaggtgctgcagcagcccccgaagaccccagggcggctccgacgccgcctcatgggctaccgccccgagccgcatcgtgtgggagcacacacgacggccgc

SEQ ID NO: 565740 - DNA, 205 bp, Homo sapiens
ttcatattgcccatctctggccctggggcacttcctgcagttggccccttagcccttttaataccccttcagttggctattatgatttctgttctgttttctattacaaggtacttccgtttcaacttgaaactttccttccctagtgttttggagcagccatattcttttagggtacacactgagctctccctatatgtgggaa

SEQ ID NO: 565741 - DNA, 130 bp, Homo sapiens
cagctagcgtgcattgccaaaagttcacctctcgtgtctagaacacaagatattcatattttcagacaggtaaccagtcggggagaggcacatttggagctgaatgcattttgatggaagcgtcgcgcat

SEQ ID NO: 565742 - DNA, 246 bp, Homo sapiens
ataacgatacatatgatttttctgtgcttgatatatctcagtctattagatgtacaccaagtactgtaataacttaaggagaaaacattttgtagtatagagatatctctactatacccggtttatacatcctataagtagcaacgtttaactataaacagacaatcaaaaaaacagcaaatgagcatttaaacaaaaaaaaaggaaaggggcgaaacaacacacaacaacactaacaaaaaaaca

SEQ ID NO: 565743 - DNA, 1077 bp, Homo sapiens
  misc_feature (52)..(52): n is a, c, g, or t
  misc_feature (132)..(132): n is a, c, g, or t
  misc_feature (285)..(285): n is a, c, g, or t
  misc_feature (805)..(805): n is a, c, g, or t
  misc_feature (807)..(807): n is a, c, g, or t
  misc_feature (809)..(809): n is a, c, g, or t
  misc_feature (813)..(813): n is a, c, g, or t
  misc_feature (818)..(818): n is a, c, g, or t
  misc_feature (823)..(823): n is a, c, g, or t
  misc_feature (827)..(827): n is a, c, g, or t
  misc_feature (829)..(829): n is a, c, g, or t
  misc_feature (838)..(840): n is a, c, g, or t
  misc_feature (844)..(844): n is a, c, g, or t
  misc_feature (850)..(850): n is a, c, g, or t
  misc_feature (852)..(852): n is a, c, g, or t
  misc_feature (855)..(855): n is a, c, g, or t
  misc_feature (863)..(863): n is a, c, g, or t
  misc_feature (918)..(918): n is a, c, g, or t
  misc_feature (1006)..(1006): n is a, c, g, or t
gatagtgtgagtgggtacagtggcgttgagattgcgagctcgctggtcgtgntcgatcgtcagtgtcagcgcactctcgttgataagaggcgtctcggcctatcgacatgctgcggaagacactacaacgtncaggccgtgggaatgctctgtgacctgcgtacgaatagtctacctcgcctgtgtaggggtcgattgaacgctcgccacggctgttcgtgtccatcttgcgttatactattggcgtgctcgttctcgaggtggcacgggcggtacgcgcgactncatagcgtgggaacggacgccggacgtagtagctggttcgcgggggccgcgacgtataaagaggcgcggctgaggccaaagcgtccgaggctgcagacaggagcgggccggagtctgctcagacgccggtgggtcgcgctcaaattgcggggtcagagcggcttctcgccgagtgagggcaaggcgtgtgttatagcgaggagagggacgggaacgagcaagaggacgcggcggatgggttgggcgcatgcgcagcgaggtggctaaggggtggtgtggggcgtccgaaccgaaacgacccccgcgctcattcgggcgggggcgatgagataattaggcgtttcgtgtctctatcggtaggccaaaggaaggcatcctatgaatggtgaactggctatatcggaatagatggaataaacgaggtcagttatgcaatgcaatcataaagtttcatgtgatattttgcgtgcgaggcagaagtcagctgcgtctgattctcactccgcaggccggtcatgtnantntgtngttgntgttngganantagcattgnnnaaanctatanancanaggaaatnccaagtaaaatcaaacagtgttcactcttaactctaaacacagtgctcccactantggttctgcattgaggcggaggggaaggccagaggcaggcttagcttcggacggacagcgtattggggctgtcacggactggagctgnctgcccaaggtatgccctcggaaaaagcgtaatgaaaaagaaaaataggtaaagccaatgatttttctgct

SEQ ID NO: 565744 - DNA, 1437 bp, Homo sapiens
gaagctaggagccgcgcgagtcgtagtgtcgctgtttgcagggtctccgcgcgggaccggggcagcagcgagggtcagctgagtgcgaggagtgtcatgtcagacaacgaggcacaattttgatggccgacgacatttgatgatgtcggcaggaggatgcacagggctagcatgcacttggcagcacatgccagcaagcaggcacggccaaggcagcaatgtcagagcatcctccccgtcttggcggcagcgcaccgcacgggcccacaccaagcaagcgcacatcaaccacacacatcacactcggaccacaaaggtgacggaagacgaggccccagccagcgacgtggaggcaacccccgcaggcggcatccgagggaactgggcggatcgctagtaggagcccacttgatcggactctgggtgagacaggcctcgggcacgcgcggagcacgagcacggaataccctcctgaccctccaataaggagcacgtgaaccgggagaacttcagacgtacaagggtccaacgtccaagcatccaatgagaattccaacaatagcttccaagacacgtcaatcatgagagacgaggtaaaattcatgataagaggccatcatccatgactctgaaagccacagttaaggcagcacaaaacgaaggcccatgagacctgggacacgaaccggctcgggacacggacctcgacgcaccactaccaagcacatccactcaacggcccacccaggcctcgacaaaccagggcaccacaccacaggcacaggcaaacgcgagcgcacgcacgcacgcggagccggccacgcgaccaacacaagtggcagcaaaaggcagacccaccgagagcgacgaacgccagagcgggaacagcacacaccgactggagcagagaacggaaacacactaacacacatggaaaccagtgacactacacagggcagggaccactgcggccaacaaagcagcagaacgaaccagagagcacacaccataccaggaccgacgcaaaagaaaagaacgagatagcagggcaacgcacgagcacaagacggcgagcacgtcaccaacaaagacgacagagcaccaaagacaaccagcaaaacgacgtggagaacagcgagaaccagcagcggtcgcccgggcatccgcacggaacacaacgcccgggagcacgtgcttcctgcctcagtccgcggggtcgccagcgtctcgcgtgtactggggataggccacgacggaccgggggccagctgggttcccgaacgttacacagcagatccggccacggaggccagctgaaagggagtacgggaatcgccgtcagtaggagtgagcgatcgaccgacacacgacgcatagtcgacggggagtgaccaagtcttgcactaggatcaggtcgtgctagctagcaacgtcgtc

SEQ ID NO: 565745 - DNA, 606 bp, Homo sapiens
gcaaacaagcaaacacagcacagaagagactgaagacgccagaacaaacaaacgcagaaggacaagatacgaaaaacaacacaacaaaaaaaaaacaagagacagagaagaagaaacagcaagaccacaacaaaagacaccagagacacgaaccaccaacaaacaaacacaacaagagagagaagaacgacgacgaacagccaaagaacgagagcaaagagaagaaagcagcaggaacacacaacagcccaggcagagggaaaagaaagaccgcaagccaccaaagcaacaagagacgaggaagacacatgaccaatcgacgcatcgaacacacaaaaaaacgaagaaaaaaggccacacacaaccacaacaacacaccacccagaggacaccgagccacaccgcagtaacataaacaggacacgaagataagaaaagcacagaaggacgccaaaagaacgcagaggacaccaaactagcccggcaaaacactgaaaccaacaaagacaacagaagcacaaacacaaaaaagacgcacagaccacaagcgaaaacaaccccaccaaacagcaaacagggacaagcaacaaccaagagacagcagac

SEQ ID NO: 565746 - DNA, 784 bp, Homo sapiens
  misc_feature (6)..(6): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (85)..(85): n is a, c, g, or t
  misc_feature (90)..(90): n is a, c, g, or t
  misc_feature (95)..(95): n is a, c, g, or t
  misc_feature (99)..(99): n is a, c, g, or t
  misc_feature (101)..(101): n is a, c, g, or t
  misc_feature (110)..(112): n is a, c, g, or t
  misc_feature (116)..(116): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (135)..(135): n is a, c, g, or t
  misc_feature (190)..(190): n is a, c, g, or t
  misc_feature (242)..(245): n is a, c, g, or t
  misc_feature (249)..(249): n is a, c, g, or t
  misc_feature (255)..(257): n is a, c, g, or t
  misc_feature (265)..(266): n is a, c, g, or t
  misc_feature (270)..(271): n is a, c, g, or t
  misc_feature (273)..(273): n is a, c, g, or t
  misc_feature (276)..(276): n is a, c, g, or t
  misc_feature (280)..(280): n is a, c, g, or t
  misc_feature (282)..(282): n is a, c, g, or t
  misc_feature (285)..(286): n is a, c, g, or t
  misc_feature (291)..(293): n is a, c, g, or t
  misc_feature (301)..(301): n is a, c, g, or t
  misc_feature (304)..(304): n is a, c, g, or t
  misc_feature (310)..(310): n is a, c, g, or t
  misc_feature (313)..(313): n is a, c, g, or t
  misc_feature (323)..(324): n is a, c, g, or t
  misc_feature (327)..(327): n is a, c, g, or t
  misc_feature (334)..(334): n is a, c, g, or t
  misc_feature (343)..(343): n is a, c, g, or t
  misc_feature (349)..(349): n is a, c, g, or t
  misc_feature (363)..(363): n is a, c, g, or t
  misc_feature (372)..(372): n is a, c, g, or t
  misc_feature (384)..(384): n is a, c, g, or t
  misc_feature (390)..(391): n is a, c, g, or t
  misc_feature (395)..(395): n is a, c, g, or t
  misc_feature (399)..(399): n is a, c, g, or t
  misc_feature (402)..(404): n is a, c, g, or t
  misc_feature (406)..(407): n is a, c, g, or t
  misc_feature (413)..(413): n is a, c, g, or t
  misc_feature (417)..(417): n is a, c, g, or t
  misc_feature (419)..(419): n is a, c, g, or t
  misc_feature (427)..(429): n is a, c, g, or t
  misc_feature (437)..(437): n is a, c, g, or t
  misc_feature (440)..(440): n is a, c, g, or t
  misc_feature (454)..(455): n is a, c, g, or t
  misc_feature (458)..(458): n is a, c, g, or t
  misc_feature (460)..(460): n is a, c, g, or t
  misc_feature (466)..(466): n is a, c, g, or t
  misc_feature (468)..(468): n is a, c, g, or t
  misc_feature (472)..(472): n is a, c, g, or t
  misc_feature (484)..(484): n is a, c, g, or t
  misc_feature (515)..(515): n is a, c, g, or t
  misc_feature (522)..(522): n is a, c, g, or t
  misc_feature (525)..(527): n is a, c, g, or t
  misc_feature (541)..(541): n is a, c, g, or t
  misc_feature (552)..(552): n is a, c, g, or t
  misc_feature (556)..(556): n is a, c, g, or t
  misc_feature (585)..(585): n is a, c, g, or t
  misc_feature (587)..(587): n is a, c, g, or t
  misc_feature (632)..(632): n is a, c, g, or t
  misc_feature (634)..(635): n is a, c, g, or t
  misc_feature (641)..(641): n is a, c, g, or t
  misc_feature (644)..(645): n is a, c, g, or t
  misc_feature (649)..(649): n is a, c, g, or t
  misc_feature (669)..(669): n is a, c, g, or t
  misc_feature (704)..(704): n is a, c, g, or t
  misc_feature (708)..(708): n is a, c, g, or t
  misc_feature (715)..(715): n is a, c, g, or t
  misc_feature (769)..(769): n is a, c, g, or t
gcagtnatatgtaacagtaatattttctttaaatacagaatcacctacttttatacaacttaacaggcaaacatgtnantntgtngttgntgttngganantagcattgnnnaaanctatanancanaggaaatnccaagtaaaatcaaacagtgttcactcttaactctaaacacagtgctcccactantggttctgcattgaggcggaggggaaggccagaggcaggcttagcttcgggnnnnagangtatgnnnatgcatannaatnnanatnattnanaanntattnnnagttgtgnaanatgagnttntgaaagcgcnnagnagcagcnattatagcngcgcantgcatgcgctattnatgcatgcnatgctgcgcttnatgcannagcntgcnttnnnanngcagcntgcntngcatgcannngctttgcnatngctggcataatgcnngcnanatattntncaanatagctgcagcnagcaaaaagcataagcaattggggcataatntgcaaanttnnnaaaagcttttgctnaagcatttttnaagngcttcataaattcttctcatttaaacctnanagcaattatatataaaaaaatttataagcatttgtgcaaaggcantnnatttanaannttcnagcatttaagcttctgcaantgctattcaatcaaaatgcaactaaggctcctggnacantctctcnaagcttttttccaaaagcaaatttgcatatcttcgctgcatatcttcatcatcngtacttctgctgttc

SEQ ID NO: 565747 - DNA, 492 bp, Homo sapiens
  misc_feature (143)..(143): n is a, c, g, or t
cggctgacccttttttgtggtgtactccgtgccctcactgtccgtcctgacccccctgctgcttcggggcttgacccggctcggcccggcggctccccgtgccgcgcgccccagatcccttcgttgcccccgcgaggggaagncttgggatcactggaattggcccttgggcttacctcctgcttcgtgaccttcctcctgccacgcgggctggatactgtcaccaccctggagacctacccggaggccacgagtgaaaggggtcccttctgtccctcacccctgtgacctgaccagcccccccggcccactcctggtcatgttactgcactttgtggccggcctcccctggatcactgtcaattcacaattccacgtcaccctcttctgccatcatgacctcttgatgtctccctggtgacctccttgggggtccctgaccctgcttggtggggtccccccttgtaaccataaaatctatttaaaccttta

SEQ ID NO: 565748 - DNA, 365 bp, Homo sapiens
tcatctgtcctcattttttgggcctttcgcaaagcttccagcagcggtatgttgggccagagcatccggaggttcccaacctttgtggtccgtaggagcccctatgaggagggccctgggaaaaatttgccattttcagtggaaaacaagtggtcgttaccagctaaaaagggtttgtactttggatctgcatttgctacccccttccttgtagtaagacccccactgctttaaacataaggatgtttcagttcctccctttaacaaaaatgaaaagcattttaaaaggggcagcctttggaagtggatcaaactagaactcatatgccaaactaaatatgtttgtcaataaacttacgccgtga

SEQ ID NO: 565749 - DNA, 208 bp, Homo sapiens
tgattctatatatttttccttggttttgttgcctgttaagctgaagaatagaattggacaggaactaggttactcatattcttggtattactactggatggaaaggactgttggcatcaataggggacagaggctgatgctggagtggacagtagaggtggtggagcagagcagacatcttttagtggggctgtatcaggctgggttt

SEQ ID NO: 565750 - DNA, 931 bp, Homo sapiens
  misc_feature (373)..(373): n is a, c, g, or t
  misc_feature (601)..(601): n is a, c, g, or t
  misc_feature (637)..(637): n is a, c, g, or t
  misc_feature (754)..(754): n is a, c, g, or t
  misc_feature (829)..(829): n is a, c, g, or t
  misc_feature (931)..(931): n is a, c, g, or t
gagacagtgttgacagtacaagggtcggagactacgggcatctcagatcatcatgaattggtccttgacactcccgggaattataattctctacttctatgctcttatatgttctcctcttcaccgatgtgctacgcatactcgttgctatccacgagacaaactgactcgtcaatctctaagatgtacatacgatacggcgttcagtgtatatgtcacaatctgaccttgatggtaattccgtcgagcactttccttcgatctatcattactcctacaatccaacacgttaccactacacggtatcgtcactacgctctttaggtaagcacatcgttgagctactcacaggttcgaataaccatataaccantcaagaaatgctcatatagcgagccatgcatatagagatgacatagtacccacatcatcgaaacgttactacactgcacttgaatgggaagtgcacttccaaatcatctcaaaaattactcgaatacagaaacgtctcgcctaccatttttgtatccgttccaaagggacaaaggaggtgcgtataacgaaagaggaacactcccacttggaacactgactcgacacngcattcgagagttattgtaaactcacccactggatnctgacaaaggtcaccttctccctgattcagttcttcggcatagggataaatcatactacactttgcaacacgattatattccaacatacgatttagttctagatccctccgcaacangtaagagaggcgtttatgaccacaacgacggtattgaaagcctatccacgtggcaccagtgtataacctccgacnaaaaacggaactatctggatggcgagaaatttcccatagcactgagtcaggctgggtgcaaaacggagttgcgtaacaagcgaacatttttggcctaattan

SEQ ID NO: 565751 - DNA, 355 bp, Homo sapiens
  misc_feature (235)..(235): n is a, c, g, or t
tgactaccgtccgtgcggaacacggggccggatcacgctagagtgactcatgggtcataaacgtagcttgcgcatacagcacgatgcatgttctctattgacatggatgtcgtatgggattcatcggcacgaagtactcacaatggccctcgagggacagaacacagagggcaggtagcagtagagcgagaatccacagagatggacatgtacagtgaatgtcaatttgactgcntatcataatcgagagctcgcgtcgatcccagaggcgaagagttcgtatgcttctaatattgtagccgtgccctccccccctagaagacggcatactgaacttacttttctctgacaaacg

SEQ ID NO: 565752 - DNA, 252 bp, Homo sapiens
gcggccgcctactactactaaattcgcggccgcgtcgaccggcgagatcaaggcatggacggcccacgtcgtcatcctatgcaccggcggatatggatcggtgtaccactggtccaccttggccaaagggtccaacgccaccgcgacatggcgtgctcaccgtcaaggtgcatacttcgccagcccctgcttcgtgcagttccacccgaccgcgctgcccgtcagttcgcactggcagtccaagacgtcgac

SEQ ID NO: 565753 - DNA, 329 bp, Homo sapiens
tacgaatcgagctcgtaccctcataaggcaagcctaatattgctatactctatacacatcctccccgtatactttaatctctagattacttaaaataccaaatacaatgtaaatgtcatgtaaatagttgttatactatattgtttttaaatctgtattatttttaattgtattgttatttttcattttatttcattttccccaaacattttcagtgcagttggttgaatctgtggatgtggaccctgggatacagaagctgggataaagacagctgactgtgtaggtccagaatggttatgttagatgtatccttggcccttatcgag

SEQ ID NO: 565754 - DNA, 521 bp, Homo sapiens
tttggtgtcatatcatgtgtagaaatccatgtaacaccaaagggacttcatagatttgtgcacgatgagtagagatacacagcttacggtattctctatttccctgaattgcgtcatagctttgtgctttattaaagtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgtcgcttatactgtgatatctcatcctagctaagctctataatgcccaagaacccaaacagtacttttacttcgtccgtacaacaacaaagacatatagccaatacaaatcaaatgccggaggtgtttgatgccatatttgcaaattgccatctatcgaactcctcgtcacactacatagaccta

SEQ ID NO: 565755 - DNA, 621 bp, Homo sapiens
gtgagtgaagtgatgtgatgtgcaaatgtgatgaagccccagctgcctgcatgtgggccctgatgtgacaatgatgccatgatgcaatgctgcatgttgccatgtaactgatgaatgtgatgtcatgcatgccccatgcctcacctgtgcaccttctgcctgtgctgccctcgcccaccccatgccctgccgccgataacaggtgattgcaagccgctctctgcttgcgatgacctcccgatactagaactgcttagcttgtcgtttgaacccatcagatataatcaggcactagcattgattagagacctggtttttaaatgccgatatgagagataatgaaggatagttacattgctaaactaaagtcgcaaactggaatatttgacacataccatgcgtcgtggtatcgattggggcattgagtgatcatatcgttcccgcccataagtacaccagtgagtatacaattacctcgagaaagaagaataatgttatgtgtaagctactgaagtgagtcgctatataatggcatatttaccaactgtatacaaaattttaatccctccatcaatatagctcgattactaggataaagagtaaaatgtatgagtcccaatg

SEQ ID NO: 565756 - DNA, 929 bp, Homo sapiens
gagcacttctgcgttcccaaccccgaccagccgggctctactacgtgcatgtgcgagaccggctaccggctggcggcgaccaacaccggtgcgaggacgtagggatgactgcatactggagcccagtccgtgtccgcagcgctgtgtacaacacacagggtggcttcgagtagccactgctaccctaactacgactaggtggacggcgagtagtagtaggagcccgtggacccgtgcttcagagccaactgcgagtaccagtgccagcccctgaaccaaactagctacctactagcgtactagcgccgagggcttcgcgcccatatccccacgagccgcacaggtgccagatagtatgcaaccagactgcctagtccagccgacttgcgacccaacaccaggttaagctgtagagtagccctagaaggctaacatacctaggacgacggtaatacatactagcacggacatacgaccgagtgcgaaaacggggcttctgcttccggggtgtgccaacaactaccccggtaacttacgagtagcatctagcggggcccgactcggccttgcccgcaatatggaccgactgtagactccggcaaggtggacggtggcgacagcggctcaaaggcgagccccgccccaggcctgacgcccggatccaccttgactcctccggccgtggggctcgtgcattcgggctttgcttcataggctctccatcgcgagcctgtgcctaggtggtggcgcgttgggcggcacgtctggcgacctgcggcacgaagccaggggccgcggggcaagatggggtaacaagttgcgcggccttacaccgagggacttgtcgctgccttgtggacgcaccggaccgctaaaattagagggctcgtcacgaacctggacgcaggagctgtgtctacacaggttga

SEQ ID NO: 565757 - DNA, 181 bp, Homo sapiens
ttgcggttgctggttcgcaatctgtctcctgcggacagccgggtcaagcctccatctgctgctgctgcgttctcaaacagcatggcagccatgttcttctgctccgagtgggctgtcaggagctggtcccgcagggtggacagctggtgtatcctgaccatagagctgtaggtccttctct

SEQ ID NO: 565758 - DNA, 465 bp, Homo sapiens
ttagctgcagttgtcgtgagcaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgctgttctgtctgttgttagtctacaggtgtatccagcagctccaaagagacagcaaccagcaagaatgggccatagtgacgatggtggttttgtcaaaaagaaaagggggggatatgtaaggcaaagagagatcagactttcactgtgtctatgtagaaaaggaagacataagaaactccattttgatctgtactaagaaaaattgttttgccttgagatgctgttaatctgtaactttagccccaaccctgtgctcacgacaactgcagc

SEQ ID NO: 565759 - DNA, 1053 bp, Homo sapiens
ggatcttttgcatagtacctcattcgactccttgacccaatggagtcggctaccgatgtcgcgcctccaccgacgtctcggactcggagaatattcatcgtcagagtgactcgtgactctcgctcttctgtctgaagtcccctagaaatcaggcatgcgaccgcgcgtgaccccacccacgtacacgtaccggctagcctgttagacacccagctaccgaaatacacccaccaaagggacttataaagtgacgaagaaaggaaggtgtgtagcgaaaaggcgagcagacatgggacagagaacgccgcctgcacacagccggcgagatcggcgaattgagagaagacaccggcgcgcatggcagtgccaggctggacagagggaaggtaccacgagccaaggatggacgtagatggcgcgagcctgagagacgatgacgaggagacgcatggggtgagttggtgcagcgcccgcatggatgttgagatcgatcagtgaaaagaatggactgatcctagactagagctgttcacagagtggccattccgtaaagagaggtttggatgtgacttactagtgggttgataccttttaccccagaaaagggctgggaattcattctggtgtcttaatcaggttgtgttccacctctctgctacacaggtggactccgaacggctttccagtgcggagacgctcgaggatgacatccctgacagtgccagagccccggagtacctcacgtgcaagcatctctgcggtcaggacctgaggcgggtatgcctgggtcccctctccagcaaagcctccaccatggcaagctcgggccagagttgcctttccggctggatttgaaccgtgcgtggtgctacacctgcagtcttggagaaagcactgcggagtgtctggaccaggcaagtgtgacgacgggcaagggcccggggggagaatagcataggaagcgtgggagaatgccaaacaatggaggggaatttcaccagacaatggaaaccctggaacagccgacaacaagtgcagcaggaagcagcaaaa

SEQ ID NO: 565760 - DNA, 944 bp, Homo sapiens
tggcacgagggggacacaggtgtgcttacctataagcaaactggactggacattatacctgagggtggcctcatgtacctgccactgttctcacattgcccagatgcctgcataactgggaggtgctacactctcggtttttgcaagtgtaatgagcaccctggtggttttaccccttgacaggcactagccctggagtgtgtgtcacaactgtagaagccaagttactgctcttgcagagcatgctgctcaggctctgaattacacctgagtggccctcttcccattaatggatgaggttgatcagatcagaaaggtggtgttgcgaaaccgaatggtcttagacatagtaactgctgcctaaggaggcacctgtgcccttttaggaacacaatgttgtacctttatccctgacaattggcagaacataacagcagccctgcaaggggtctcacaggagattaaggtagtcaagagccttactgatgaccccctgcagagatggtagacatccctgggctctggcctacgctgggccctgatagtcataagtagcatagctggaatcctagtcgtgagctgttgctctccgtattgttgctgtggattatggattcagggctccaccctacgggcacatgtccctacctggaggatgccccgtgggcctagggggtggagtgtaacggaaagatggctgcgctttagtcaggagcaggctgagggcactttttggtggcacatgactcaagtgggttggaggcgtaggccccacgactccgacattatgaaccatggcacttgaggtggcttaggtggccactcacgctggagctccgtgatgcttcagagccctatggtgtaaaggttatttccctgtggcacggtattggtctgccaaaaaggaaagccgtatgccaaacaccgggttgaacccccacaag

SEQ ID NO: 565761 - DNA, 368 bp, Homo sapiens
  misc_feature (361)..(361): n is a, c, g, or t
gaagggtctagaagcaatgacaacccatggcaatgattttagtttctaaataccattccttactaaaaagaaccagagccttggagaaatggctgattcctgatcaccttatggaaatataaggtgagtctgggacatcttgttgtgccaaaaaagccaagggaaaacaaacaaacaaacaaaaaaaacagtgatggggtcatgtcaaaatgaaacaggaggagctacctagaaaaagttatcagtagccaaacctgagacaatctgagcattagcaaagactgtaattgattgttaacactgaataaataaaagtccaggagagtatggtgatataaaaaaaggaaggaagaaaaatggnggcagcc

SEQ ID NO: 565762 - DNA, 124 bp, Homo sapiens
caaatgtggaaagctactaaacaatctgtcatgaatgataagaagcaaaggcagcacatatcatctgcaagttccttcccaagtctataaatatatcatgttcatatttttcctgctttgtgat

SEQ ID NO: 565763 - DNA, 148 bp, Homo sapiens
acaagcatagtatgcacagcaggatcacagttctgcccacccagaacacctccaccctctccgagtcgtgggcagaaacgagtcgtgggcagaaaacgagtcgtgggcagaaacgagtcgtgggcagaaacgcgtggtgggcaagaaa

SEQ ID NO: 565764 - DNA, 877 bp, Homo sapiens
tgttataaatggggaaaaatcctccttgatttctttatagaacttgacgatgcactgataaatgtatatagcttggagtttcacctatttatctttctgggtataagatctggtttgtcacacatatacctcaaagagagttatatgattccaagaagtttaagatctatttagaacaagaaaggcgaaatatgtgcacacgttggtgaaagacaacattccattttggtactctctaaagtaaatctggtataaattggttgtgaaggaaatgactcaacagtatggtattgtgcttgtgacacatcattttaataaatggctcgtacttctccgggtgaccgggaaacctcaaagcaacaggagaattcctcttgtggcagataatagcctgtgcaaatccaagaacctgtcacatcactttaaaaaaacaaaatctcttttctcctcttgccatatcgtatccacacagtggatatcacgcatacaaaagcctccagtagtcataatacacgggtggaacaaaattctgaaagtcttgaactcaattaccaaaaaggtaggtctttaggggaaataggtccgtattactggtggtatcccatccttctgaaagctgaaaactgtgggaccgcataagcaaacacaaaggcatgattttgcacactggtgtgtcccctcattaaggggtgtctacctaataaggcacgacaacgcgcgttggtcaataagccacactaggtgccaacactctgggtacgcagtacgtagccacggcaacttcatactgctcatatgttttacacatagtattaatccatagccccacacgggctagataagacctctgggtggtacggagaaacacatgatccaa

SEQ ID NO: 565765 - DNA, 173 bp, Homo sapiens
aaggtcatcgctgagagccagcttggcgtcggcatgtggtagacgccagtgtaccatccggtcctggagagcttcctgtgttatccctactcggcggagagtacatccccacagggtgacccagacgatgtgagcctaatacagtccaggggaagacgtgctcatcgacatat

SEQ ID NO: 565766 - DNA, 390 bp, Homo sapiens
ccactgttattagtccttaatcttttcagaattttgcctgggctcttaaaaggatatgtggaaatttttaattcttgtttaaaatgtcatttagccaggcaagggtggctggacccggtaatcctagcactttgggaggccgaggtgggaggattacgagatcaggagatcgagaccatcctggttaacatggtgaaaccccgtctctactaaaaatacaaaaaattagctgggcgtggtggtgggcgcctgtagtcccagctgcttgggaggctgaggcaggagaatggcgtgaacctgggaggcggagcttgcagtgagccaagatcgccccactgcactccagcctgggcaacagagcaagactccgtctcaaaaaaaataaataaa

SEQ ID NO: 565767 - DNA, 360 bp, Homo sapiens
gtgctgacatagcagccctctctttgaagctaggcagtcttgcagtggatcccgagtctgcctatctgtttgctgagtgatccctgctttaaatatcaggcatcttatttgtgaaatgtggctcaaatctaccatctcaggcatctgatgacagatgaaatgggctaccaatgcctgacatgtagtcagcacatgcaatacatttgttaactcatgtattctcatgtatttacagagcaggacactgttctgagcactgggtgtataggaacgagacaggacctctgccctcatcaagacacatctagtataggccgagggacgtggctcacgcctgtgatcccagaactttggggctga

SEQ ID NO: 565768 - DNA, 152 bp, Homo sapiens
ccccccccccccccaaaaaccggggggggcccaaaggttcccttttccccccccggggggaaaagggggggtttttcccccccccccccccggtgttttttttaaagtttaaagggggttttttttttggttaaaaggggggccccttggga

SEQ ID NO: 565769 - DNA, 212 bp, Homo sapiens
cagctcatcagcagctcccccctcctagcgtcgctggagctactgtcgcccgccccgcgctccgctcactttttgtagtattagtagcagcggtgtgctaccatgttggtgcggcggctgtacacattgttggccgcgccgctggttgtcggcgtctgccgtcgactacgtcgtcatggtggtcgttgttgtctgtggtgtgttgttgtcct

SEQ ID NO: 565770 - DNA, 388 bp, Homo sapiens
ggacggtagccaggtatgcggacttacatttgtctgactataagtctggagcaactgcatcatatcatgctttcgtatggggaagagatgagacagaggagatgtagcggtactgctgcattcactgccatagccaacccctttccagatcaccctcatccctggacacaggtaccttgccctactccagaggctcattttcttgttcctagtaggttgactgcccttgcggtgggccggcagaatcactgtggtctccagggtgggagtcttctgctgcttttatagtccagaagcccactatgctgaagaatatgttagagactgatgtatttctctggggagagattgtaggtcaagctgttcataggtaaaatatacatatata

SEQ ID NO: 565771 - DNA, 106 bp, Homo sapiens
tagatcgagctggtaccgatcccagtttttgcaatatgggtattgtttcatgaggcttataaacttctgaaatacaaaggcctgataaaacaatacccatattgca

SEQ ID NO: 565772 - DNA, 257 bp, Homo sapiens
gcttataaggaacacaagtatatcacagtgatatatactgagagctcactatgtgccaggcacattcagagacaagctacatcaagttaacacacttaattctccagaacaccttaacagtgggtacctagtatcattatgtctttcacagcataagcaaacgtgaggcactgcagaattaagtaacattgcccagagatcacaagattagataagctagggagacagggccatttgaagcccaacgcagatctaag

SEQ ID NO: 565773 - DNA, 1325 bp, Homo sapiens
gccttcccagaattcattactggaggttagttgcccagttggtgtccatcccggatgactgtgaccggaaacgaagagcatgaacgtgcatgagtgaccgtgctagtgtggggccttatagcttggcatatttcaatcgctgatgtgcagcgcccagaattccagtgatgcctagtctgtctagttggacgacccaagggggggtcctcgccttcctaatggaatggctcacagggaatctgagagtgagaccgtcaacgttagtgacactacagtgcgcctgtgctcgtgatcctatgatgcgaagcaccatgaggccccttgttgtcaagggcgagtttgggccgagatgcggtggtggggaacttttcgataagcacattgaacgttgatgctcttcacatgaccaagaggccgagacacgggtagatttgttccaggacgttcaacgcagtatgcgggcgcgatgtcaccaagagtggactccaatcgctttggatcgtagaaaaaccatatggggggacgcccctggattatggaaccgtaggtctagaaggccagaattgtgaatgtcgaaccacggaatctaagagggcaattaccccaaagagttatgtactcttggggctgtgggcacgagggcacaatgggtgtaaaaacataaccctagataagcgcccaaaaaggggacgaggttattgcaagttgtccgttcgcaacaacgcgggctgtggcaagtgcaacagatgggcgcacaaagtcaaaccaagcggcaggcagtaaaaggacacaccgaacgaccgacctacgaggcaacagtcggagacacagcgggtggtggctcccccccgaatcggcaaggtggccaacccgacgaccccaagcgggatgggaccttttgaagaccacacttgtaacccttggggacaaggtagtgagcgacaccccctcaaagagaggaacagcgggaaaggagtcgtgtacaggaacccggccggctgggattacccacagcgatttgatataaccctccacacaaatatgacgtagttacgagcgcgagttccccctatttaacgaccttcacagggagggacagccccatttgtgctgattcaacagagtaggaacacatttggggtaagaacgtcacagcttgcccgcgcattacgtttagttgcgtgaaatgtacccccatttgggggaaaaaacccccgccaggggaggatatcactcggattggacgcacgcgccaacgtgggagtacggtagccaccagcgatgagaaaacacacccagcacaagggccaaaggaaaacccgccc

SEQ ID NO: 565774 - DNA, 198 bp, Homo sapiens
tgacctgctgcttagacctgacctgagcatcaaggagtacagcgcattcctcccacagactgtctgagaggctcctgtagacaatctgggatgatgagctgagaggagtctttggatgctcgggtgagctacaatgcactccagcctgggcaacagagttagacactgcatagacaacagagttaggccgtgtctcta

SEQ ID NO: 565775 - DNA, 375 bp, Homo sapiens
tgagtctgcgccttcgcctctgtcacttccgcaaataatttcttgttgaggaggaggatgagaaggttgacattgacttaggcctttttgaaagagtttcatgacagccacaccctcatactggagctgcaggagatcctgattgtgaagctgaaatcgctccacgtccacacccaggaacttggcatttacttcagactttcctgcctcatctcccggcgctgatgtcatagctgtcgcctggatagaataagaggcgggaagatcttcaatttccaccaagacacccttttccaggagctgagcagcagtgtaatgaagagaaggctgcttcttccccttcccagaactcttggagtcgggggccaggtggtc

SEQ ID NO: 565776 - DNA, 344 bp, Homo sapiens
tctagaggatccctttctctgatcgctctcctgactcaggtgataacctggctcagctcccaaagtgctgggattacaggtgtgagccacacgcctcgtcttagtggaatggagcatatctaagtaaaatgaacaagcactttgtaccagcaggagacctagttataacggtgtattacagagttcatccctaataacacaaagttcatcatatgcttgctgtgtagcagaatagtctgtgtagggacaagaatgggagccaggagagattaggcagtataggacagaggactgcagtgtactgtgtcagcacatgtagcagaacgtgctgagtagtggttgga

SEQ ID NO: 565777 - DNA, 305 bp, Homo sapiens
gctcgacgaaattccaggtacattttttaaaagatggaaactttaggccgagagcagtggctcacacctgtaatcacagcactttggaaggccgaggcggttagatcacttgaggtcaggatttcaagaccagcctgccaacatggcaaaaccccatctctactaaaaatacaaaaaaaaaaaaaaaaaggctaggcatggtggtgtgcacctgtaaccccagctactcgggaggctgaggtacaagaatcatttgaactcaggaagcagaggctgcactgagccaagatcacatcactacactc

SEQ ID NO: 565778 - DNA, 191 bp, Homo sapiens
aggaaacttcacccggatgaaattgacaccgactctgaatacattcttttctatgagcagcaggcgatagactatgcaccatttctgccaaagcctgatggcaaaaagatggcagacacaagcagtatggataaagactacgagtctgattacaaaaagtactgtgtgttacagtaaaggctacactcctg

SEQ ID NO: 565779 - DNA, 317 bp, Homo sapiens
agggtggccagtgccctcctgtttgaggggtcggggctaggctggcgtggtctatggctcagacccctcctgcgacagaaacacacttctgaggataatcaataggattatcccgtatcgaaggccataaaggacagatggtgtgtggtgaccttggtatgtgcattctcgtgtatacatcgcgccatcattggtatctggtacgtgtgttgataagtaagcctagtatgaggagcgtcatggagtgcaagtgaaatcacatggataggccggaggtcattcggagggctgagagggcccctgtaaagggtcatgaa

SEQ ID NO: 565780 - DNA, 147 bp, Homo sapiens
cgaaggtgttgggggaattaaggaccttgctgtgtttcccccgagaaaagtggccttttaattttccccctccataaacatgcttttgacatgcatagcagagctgaaggcaaggggaaggggaccacatagtaagtgacgttcctc

SEQ ID NO: 565781 - DNA, 373 bp, Homo sapiens
tctttccatggcatatccattaagtcccatattgagtgaagagtctagtatcacgatacatacatccagtcacaatgacatatgcaaggctgattaaaatatattcatatattgtgtgtataagttcagatgtccagggtgctagtcactcaacgccacatctccttacagttacttggattatgctagctgtcacattatttaaatactatcttatctcccaaagttatctctagccctgcctatacccctttacttgaaattagtatattgtagcttcccacattatattttctacctaatgtttaaaatgtatctcaaacttaacatgtcagatttctccctagaacctgtgccttctgcagtgtttccc

SEQ ID NO: 565782 - DNA, 190 bp, Homo sapiens
gcagactcgagatggcatcgatatttggagcgtcagcgctggtgctcacgtgtcgagagagcttgtacagggaggcatgcaccgcagtggtgaatacacgtcgaccaggatccatgtttacgatatttggaggtcagcacggtgctcatatattgaaggaacttgtataggagaggtatgcatggcagtg

SEQ ID NO: 565783 - DNA, 151 bp, Homo sapiens
tacggcgcagttgctgaattcggcttagcggcgcccttttttaagcccagcatatacaaaggcacagagctaagaggagctagggcaagaaaggaaagccaggaaaggtaggtagagagatagagtctcaaagctaagtagtggaagctag

SEQ ID NO: 565784 - DNA, 288 bp, Homo sapiens
gcgataacagtaaacaggcgaaccagggccagcaatatcgcacaaagatcttacgcttctgccagtaacaaccattctctacgtttctcccttcgtttttttcctcagagacttcctacatcaagtcaatgaaggactcaacgattatgcttttcataaaaattcccaaggggagcggcgaggaggcattttcgctaagacttcaccttttcccttaatctagagggatcatcccttcactttgaagaacaaaactgcatcaatttcttccagcaatttctgctgaac

SEQ ID NO: 565785 - DNA, 892 bp, Homo sapiens
ccaccacaatcaatgacaaattattaataaataatcgaatgtcttgtactaatctgaggtagattctgggaccctgaaacatgaggagaagggagagaatgggaacacccttccactcctggctctggactgaaccctgagtcaccccaatgctcctgcacactggacttcagtggaatcagccacccaggaagcacatgcaaactgacccatgcagacacgtgcgttatgctagacacaaggcactgcactactgaaccgatgaagtgactgacaccccacatcagattgaacaaacaaagttggacattttttttagacaagctacttcttaacgcgaaaagaagagaatgaaagaacaacgcaatggtataaatgaaccagcagacgcaccactggattagtataactgggatgtataatgatacggtcagtaatactgatgtgggtatgtacactagtgccatgatagacattaatcagtcacaacaaaccccaaagagtagaccgcgcttacgcatcacattaaactataatcaacagacatacaagcttgaaaacacactccacgactaactaccaaacattatgggctctcgtactgatatcatgagcaggagtacaataacaaatcgagacgcctcagatctaccatcccaccacgcactaaccataaaatccatcaattatactccctaacctactataaaacacacactatcaaagtaaatcacacacccatcataatagttaaattagaaacaaactactcactccagcacgccaagtgaaatcacattacgacagacgcatacagcaaatatccttagtacataaaaacaccctttaacctaaaagatccacgacactccacgacacgctaacacaaatg

SEQ ID NO: 565786 - DNA, 339 bp, Homo sapiens
ctacttatactctatgtcgcagaggaactcaaatctgtgcaccattagagtcccctgggaagcattgacaaatactgctccctggccaggtgtgatggctcacacttataatcccagcacttgacgacggccgacggggggtggcttgcatgcggccacggagtttgacgacccagcttggccaacactggtgacaaccccttctctactaaaactaaacacaacacttacgccacggactggtggcaggtgcctctaactcccagctactcacggaggctgaacgacaggcgacactttgcccgtggtacccgacgctccgaattcgtacatcaactt

SEQ ID NO: 565787 - DNA, 436 bp, Homo sapiens
  misc_feature (53)..(53): n is a, c, g, or t
ttgaggatcgtggcggtgaagggtgagcgaagggggaagagcgccttataaanacatcagatcttgtgagaactcagtatcatgagaacagcatggggtaaactggccccacaattcaattacctccacctggtctctaccttgacacgtggggatgataggcattatggggtttacaattcatgatgagatttgggtgggaagacaaagcctacccatatcaatggctcactgcagcctcaatctcccaggcacaagtgattctcccagcctcctgagtggctgggaccacagtactgcgagaccactcacagttcatttttgtatttttcgtagagatggggtctcacaatgttgctcaggctgcgctcagacgattcgcctgcctcaggctcccaaagcactgggattacaggtgtgagccattgcactccgg

SEQ ID NO: 565788 - DNA, 776 bp, Homo sapiens
ggcgcagggttagtgcctgcgaggctgcggcacggtggagtggttccgggctctcattgcggaggccgggacctgggacctgaccagccgcgcctcctggctgggggttccgctgctccggagctgcagtgacctgtgcacgtcgccgatggactgcctggtggcttcggtgggtggtcctggctctgctgggccccagacgtttttgctcctaggactccgcgagttgtcgcgcccacgtcgactggctgctcttcagtgcttccctcactgtgttgggcggtcactccctgccttgtggcccagctggccggtcgcttccctggctgcctgcatcgttacgtgttgtgttcttcatccgcttcggtggtggcctggtggtgggtggtgggtagagggaggggctagacggggggacagacgccgacaactgcgacgaaaccgcacactagagagccgcacgagaacgcccacaccaacaggtaccggggagcggccgcgagggacgcacacgtaacgagagcccgtcaaacaagaatcacacgtgaagcaggtaggagtaccagcacccgcaagggggggggccccacagcgtacagcacccacgagcctagcacgtagggcgcataaacagaagcggaaggggcacacccacacaggcaacgcggcaagcaggccgcgcgggctacaggcaggagcgacgagcggaggagccagaggacccgaggaggggggggcaggagggcggggggaacgtcgcggcggcgaatgagagg

SEQ ID NO: 565789 - DNA, 177 bp, Homo sapiens
actctagcaggatccccgcatcttgctcccatcagagaaatgcaaatcaaaccacaatgagataccatctcacaccagtcagaatggctaattattaaaaggtcaaaataaataacaaatgcttgcgaggttgtggtgaaaaaggaatgcttgtacactgcatgggacgaagactgg

SEQ ID NO: 565790 - DNA, 413 bp, Homo sapiens
cgacactaccatggggacaagacttctggaaaaactccgatatcttagcttattgtacctgctcgagggtccggaacatcctcctggtgtctgatgggcacctccaggatgagagcctgacattacagctcgtgaagaggagccgcccgcacaccaggttattcgcctgcggtatcgggtgagtctcagagagctggtcacatagtccagacccacggggaggtcgtcttgttgccctgcaggggactttggcaagcttggaagttgacactagaatacagaagccttacagcatagagggatggggctccgggctcccagccagactgcctgagtctcagaacctgggttggccactcattagcttagccgtgaccttgagcaagttccttaacctctcatctggtaaacca

SEQ ID NO: 565791 - DNA, 185 bp, Homo sapiens
gttgtgacaagttaacccaccttaagttgtaaaattcgataagtttataatttctgggctttttacaatgaaaatgtgagcatgttaagttaccaaaaggcttttcatcaaggagaatttcaaacaaagtaaaccaggcgttttatagtcctcttaaatctatggtgctcccaaccaaccaaggc

SEQ ID NO: 565792 - DNA, 1856 bp, Homo sapiens
gggaatcaccatggcggctgggaccctgtacacgtatccatgaaaactggagggccattcaaggcgtcatcatcgcttgcttcagtacaggcggggctcaggtcacgcgatgcgtctccggcaccagcaccacttccgattttggagcaaagccaaccgacacccctggaagtttctcacgcgaaatttccgtgccggcacaggctccccagccatctcggcagggctgcatgcatggcattcctgctgtgctcctgcagcagacaacgaccaatttgccgtcacgtcatgctgcagccaatggccaggcagactgctggcgagcaagttacatccacagagggcagtccaggcccaacggattggctgccagcatggtgctgctgccatatgtggcactgacatatcacagcagtacataggatagcacactcacaagacactaggatcacccgtgaggagatgattccgccaccaaccgatatgtgagcccagttcaactagacaacgcaaacgagaccgacaagcacagaggccacaacgatggacaggcgacatggcacaaaagcggtatgggcacacgctggcaggggccggcaacatatccctagggagagctcgtggcactgacgcacactgcccgctactaacacctaccgcaccacggcacccgcaagcggcaccactacccaccctcgcgcatgcggagcacgagacacacggaacagcttgaaccgcactcagggcaaccgtcggacacgacagtaccagcccacaggacaagggccagccgttgagacccaccacccgcagctgccacacagcactcgcggcactgcccacaactaacacagcaccaccggcagcgccactcacgcacgcgccacacaaaccactataactccgcaggcgacccaagggcgccacatcatccaccccacgaaactatacaacaccaaaaccccggcaccagtagagcaattcacagcaagaccacacgcacaccctgggcccaccattgcacaatcccagcacaggcacccgcctcaacagaactacccagcgaggggaccacttggctaccttcagccagcgcgaggcgaacacaacgtcggcgcaacagcacccgtgagccagggatatagcaaagccacacagagcaacattggggcacacaccgaagcggacgagggaacacgggcgtcgcaacgcacatgaggcctccagcgcacccccgagcaacacccacacgacgcccgcacaacacacacagggggccaaaccaaccacacaccggtacaccaccctaacagaaaagcagggcaatgcaccggcgcaccagacgccacgacaagcaccacgacaccaggcacccacagcagcgggacgaaccacgccagacaggaacacgactgacacacccacagccgcgcgcgcacggtcaccaccatgagacaacacccgcgacagtcagcaccccaaacagctggcacaaacgccaccgaagttcacggacacggacgccagaatgacgcgacagatggagcacacgaggcgccaagaggacccacgacagtcgcacaccaccagagggacagaccggacgcagcacacgaccgcgcagcgcatcgcgcgaaaagcgcgcgaaaatgtatacaccaggcggagcagcacacgaacacgtgacacacgacacacaacaacggggacacgaggaccagaacacgcgaggcagcacaccccgcacacacaacacgaagcgagacacccaaccaacgagaaccaaccagcgtgagccgactcaccgctacagtgcggacagacgcaggagacagaagacgcacagccaccgacgc

SEQ ID NO: 565793 - DNA, 85 bp, Homo sapiens
atcacttgaatccgggagtagaagttggcagttagcagaggttacgccactgtactacagccttggcaacagagacttcatctca

SEQ ID NO: 565794 - DNA, 332 bp, Homo sapiens
ggggccttcgggggaaacagcactccctttttaagggcttgggcaaggccaaaaaggaggccccgcccatggaaaagccggaagtggtgaaaacgcccctgcgggacatgttcttcctacccaaaatggtgggcagcatggtgggggtttccaacggcaagcccttcaaccaggtggagatcaagcccgaaatgttcggcccctacctgggggagttttccttcccctccaagcccgtaaagcatggccggcccggcattggggcccccccctcctcccgttttttccctttcaagtaatggctcagctaataaaggggcccatgcctccca

SEQ ID NO: 565795 - DNA, 200 bp, Homo sapiens
  misc_feature (158)..(158): n is a, c, g, or t
  misc_feature (188)..(189): n is a, c, g, or t
tctacgacctaccttcagggcagcgcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcacccngatcttcgtcaactcccctgagctggtacnnccggcggtcgc

SEQ ID NO: 565796 - DNA, 796 bp, Homo sapiens
agttctttatataacgtcccttgttaaaaatgaaagaataaaaacaaaccgaaaaaggggggcagggttaaaattttttaaaaaaaggaaaggaaagagaggaaaagaaaataaaataagacgatttatggcttctcctcagcatcctccttggtctcctccttcaccgagagagcttctagcttttccgccactttttcggcatgatcattttggcctgatccgtgctttcttttctctctcttcgatctctttccgtgcatttcttcaaacttgtgtttggaattttcgtgtgcatttcctcagcatttcaggaagcggattggccagcagctcgtggcttggggcactcgtcggcaaagtctcagcggtggggtgttccagaacccaggcacggatcgcttaccgtgcgtttgggccttcagcctccattcatcgggcggtgagtttagtgtggttgggcaccagattcttcagggctctgtggtccctccgcattgaggacggcggattggccccttttctccttggtgcttcaggagcttgaggtcaccagtgcctcgctccttccattctgggagatcgttctcagaggcaaatcggaacagtttggcccgcattttaaaaagttcctcttcatcttcttcccagtgtcctaattactggctcaggaagagaaacttatgtggcctcaacctggagggtcactggtgggactcgcctggaatcctcaagcgaaagtttcagtggccctcataagtgtccttaggggcccgcactaaaatatccccgaggg

SEQ ID NO: 565797 - DNA, 220 bp, Homo sapiens
taaggtgtgcttactgacgactggaaatgtatataaagaatggataaagcaaaagaacttcagccaagagtaagctgcatcaatacacatcatgcctgctctgaatttactaatttgttcagtttaaatcgtaaactttttactcctgtggaaatttagccaaacgtttcaatacatatacgattataaatcttaaagctaacactgcacagagaaagac

SEQ ID NO: 565798 - DNA, 457 bp, Homo sapiens
catagctgactcctgaggataaaacgccgcctggcagattcctgggttactaagtccagatcatccaggattccaatctgggacagtaaaagagttcatgtgctcagcctggccagcaccaaagcagctaaaaacagggatcacaggccctcagtgtttccaccactcctgagctgcttggaagcttcctctcagggtgtgtctgtggaaagcctagtccgaccagtatgacaccgtttctcaggtatctcaaatgtccccacagtcgcctggaaggagaatcatcatctcaagccagtaagcccttgcaagaaccagaatttgagggaagaagaaacattggtggagactgccttggttactatgataaatggccagtaacccttaacatcttctaaagccaaagtcacacagaaaaaagtctgccctaccagactcaaagaaatgttaaaagaaa

SEQ ID NO: 565799 - DNA, 687 bp, Homo sapiens
aactgtaaaatggggattcgaaggagcacatgtatatgcacgcactcactggagggttttgagaagaatgtcccgccattttggagattggagatgaaatgtccccaaatttctgccttgctgtggtctttttaaatatatttgagataatgcgttaatagcacccttacaccctgttaatgcacccaaaatgtaaggggttataataaatgttaacactggacactgagtcttctttataaattctaactttgaagtgctgtctccacatgtttgaaagtatctgaagccaggttgctccaccacggtagctctatggaggggctggccaacttaagaaggtggggagaccacgagagattctcttatacccgacatccacatacttggtccagatattggacatcttccaatactcttgccactccaagacttgttaagaatagtttaagcgtgcattaagattaacattcccatttgtgacataactctgctttagaattattggggggaaaattttaggaaataataaattgaccaggattattggaaatttgttataatgaatgaaaccttttgtcatataagattcatatttactttttatacatttgataaagtaaggcatggttgtggttaatctggtttatttttgttcccccagttaaataaatcattaaaccttga

SEQ ID NO: 565800 - DNA, 350 bp, Homo sapiens
  misc_feature (1)..(1): n is a, c, g, or t
  misc_feature (230)..(230): n is a, c, g, or t
  misc_feature (237)..(237): n is a, c, g, or t
ntgagaccagcctggccaacatggaaaaccttgtgtctactaaaaatacaaaaattagccaggcacggctgggcacggtggctcaatcccagcactttgggaggctgagacaggcggatcatgaggtcagaagatggagaccatcctggctcatatggtgaaaccccatctctactagaaaatgtaaaaaaagaaaaaagttggccaggtgtggtggtgggcgcctgtgncccagcntactcgggaggctgaggcaggagaatggtgtgaacccgggagcggatcttggctcactgcaacccctgcctcctgggcttggacagtcctcccactctagccgcgcaagtagc

SEQ ID NO: 565801 - DNA, 328 bp, Homo sapiens
cggagggagggggggccgagggagaggaagaagagacagaatgaagacatcgaggaaaagctcgggggaagggaggagaggggggcgggtcgcaggaggggaagaaaaaccgagtcgagacaaaagaatctcgcgggagacgggaagagacgaaagcaaaggggctcgttttggttttctccaagacctcggagactaccgacccccaacgccttctcgtagagagagggtggcgggcactggggcgtcaaggagatctcctatgaaggggaggggaattgtttggactattgtcttcaaggattggaataaaaataacttattttgg

SEQ ID NO: 565802 - DNA, 973 bp, Homo sapiens
gatctagaatcgcagagcggacgaccattaattattcgttcggcacatgtatgtgagagttctccgttgagctaaggggttggggttggcagtgttaaatcatgcagaatggtcgtaatctggatagtagcagcaatggatggtactaaatcagcaccatggatgccccagccagcccgtgggccctgcagaccccagagggaggtatggggagagctcaggggagtgggtctgagggctacggtctggggacacctctgaagcttacggtaccttcctctccccatgaagacaccatgaatagagtctaacatgcctcttctccaacttcctacctacgagacaagcagaacagttctaatgttgcacggcctagtggccaggggcaagctaaagaggctgtctggaggcttatatgtgtctggcgtcaaggggagaggacggcgggtagacagggcgtctctccccaggtgggatctgaaatatctgttcctcccctcttcttttaatgggcaaacctgattccttcggccccctggtggcttttaggtgtggtactgctgacaaccttgttgtactgctaatcagcacagtgaaaaaacttctccagcctggcaagggccacgttggttaaatagttccttttcccatgtccagtcctaaaaaatatgtccccttaaatgcctttggtgacattttacacctcaatcatgtgtcttttcctaatcactcttcatcattcaaagcataaatctatgtattttatgggatgaccgttttgtatttggattttttttatttggccgattgtttaaagaaatcagggggggcgtgagagaggccaaattggagcgactggtgcggagagagggtggccgttttaaacaggaggaggtgaattgggagtctggaaaaaaggcgatcaagcagcattatagatataacaattgtgtctatgatatacatatagggt

SEQ ID NO: 565803 - DNA, 311 bp, Homo sapiens
gcttctcccaaaggtacctgcttctgctgctccatgccgcactagtttggtgtcattggtctcagacaccactttgccatccacgatccggcggtggtgatcattatggatggtctgcatggagttgctagctgtccaaggcataaccaagattaaagtcctcaccatcttccagcaggcggcggtaggtggcgatctcagccgtgcagcttgaccttgatgttcagcagggcctcatactcctgggcctggcgctgtccctctgcccgggtctgtgccagctctgactcaaggtgcagcaggatcccgtt

SEQ ID NO: 565804 - DNA, 523 bp, Homo sapiens
atagtgcagtcaatgggtcaatggtagctctgttttaaattccttgagaaattttcaaactgctttccacaggggctgaattaatttacatttccacctacattgtataactataccattttatctgcagcctcaccaggcatttgttgtttggactttgtaataattgccatgtttgacttgtgtgaaaattcatattcattttgatttgcatttctctgataattaatgatgctgagcatttttttcatgtttgctagccagtcgtatgtcttcttttgaaaagtgtctcttcatgccttttgtccaatttttaatgtgtttatctgttatttttcttattaagtttcctatagagtctagatgttagacctttgttgaatgtagttagcaaatattttctacaattcagtctgttgtctctttattatattgatagtctatcttgctgtgcagaagtccttgggtttaattaggtcccaagaggctttttaactaaaaattaattctgcttgctcattat

SEQ ID NO: 565805 - DNA, 1327 bp, Homo sapiens
ggtctttaaaccctgcgtggcaatccctgtacgcacctgccgctgatgcccatgggcaacgacagggccgacctggaagtccaactacttccttaagatcatccaactatttggatgattcatccgaaactgtttcattgctgcgcgagcacgcacaacgctgcggctccaagccagactgcagcacgcatccgcatgctcccttcgccgggcaacggctgctggctgctgactgcggccacgaactaccatgcatgcgccatggcctctcctgacggcgcacctggccaccacccaccccacgctctgcgccgcaccccccgcctgcccctcatatccgggggcactgctgcggcttctcgctgtttctcccatccgcgatggacccctcacgtgaccactcagggcccccctgtcgcccggcccaccctcccgcgctgccagtctgcctgccccgctgccttgcctgcccctttcgccccccgctgctgacactttcccctcgctgcccaggctccccagtatccacctgggctcttcgttgcgcccccgaccgaaaggagctctcccctctcttgcccacgtgccttctacgcgtattccacccaggctaccgcattctttcattgtgcgtcttccccatttcgacaaattcccttgccgctgacttgcctgccatgtcttgaattcacaggaccctcggtccgaccaccacccttcgggacgcccagctagctgaaagaccacttggcttggcttgaaaccccttgcttccaagcatccctccccctccatatctttcctcattggcggccctgtgaccacattcccacaaaaggtggctgcattcgtacccaaatgggaccacgcattcttaagcacacaccattgaagggtgcattggcacgtactcaccaagaacgggaaacccatccctggcatttcctctggccatctccctcgcgcagcgctggttgcgtcaaatagatttgccccgatagctcctggccctgccacaacccgagcctcacccacaaccggccggcagattccagcgcaacccccaaatccgacataaatccacacagcgaccaacccaacaggacagcccaggggccagtggacccaggtggagaacggaataacaacacacccccacgacgtgcagaaagacgagctacagggccatacttgggcgagcactcaaaccggccccaagaggagttgcacaccccatgaggagataatagcaacacacaagccgtcaactcagcaagaacagagctaccacccagcactactggtgcagaaacgccacgagacagac

SEQ ID NO: 565806 - DNA, 386 bp, Homo sapiens
  misc_feature (54)..(54): n is a, c, g, or t
  misc_feature (134)..(134): n is a, c, g, or t
  misc_feature (252)..(252): n is a, c, g, or t
cctaacgctaagtcaattgcctgtaagtgcagggcttcctacctgagggatganactgccttcctacttgaaaaaatcccccattttagtttcattgttgaagaagaagtcagggctgaattgtggtggcccanacctgtagtcccagcactttgagaggctgaggaggttggatcagttgagtcccaggagtttaagaccatcctcggcaatatggcaaaaccctgtctctacaaaaaatataaaaattanccaggtgtggtggtgcattcctgtggtcccacctactcaagaggatgagaagtgggaggattgcttgagcctgggaggttgaagttgcccaggtggtcgaggctgcatcaagccgtgatctgggcgacagatgt

SEQ ID NO: 565807 - DNA, 329 bp, Homo sapiens
agaagaaaatggggggctttgctcccttggacccaggtgggttatcctatccagtgggcaaggccccccgaataccccctcatggtccctgcagcaaggcccctgaaagtgattcatggttttggggggccttttgcatgtttagggattgttttggggatgtttccctgctacccgcctccagggggttgcagcccccgaaaacgactaatggaactatgcagggttggttgggctttttcctgggccggggcccagtgggggggcctgaagaatccatttggggggggttgtttttcaaaatgaaataaaacccccttttttttgga

SEQ ID NO: 565808 - DNA, 202 bp, Homo sapiens
gatcagaggaccccgtactgtggtgtacgtaaaatctaatctagtgtgttcatgcaccaggcaatgagcatgaacatagaatttagtctctgtggtgtgtactggggttagaattaggatcagacttgcatggttttttttggttggtttttggttggttggtttggtcttttgggggccatacccacggcacatggaggtt

SEQ ID NO: 565809 - DNA, 369 bp, Homo sapiens
gcaacaaaaagggcacttacacattcgtactcctacaagacacaggatgtttagtcttatataaaatcagatgggaacaggaattcctctgtgcaacatcccctcaacctcatccctttcagggattgagatatctcccaaccattttcctgatgacagccatagttcattagagatactagcccctcaggggtgccttcctgtttcttatatagcccattatctttagattttttgaaatcttcatttgttactttcattcttcgttctcttatggccatcagaccatcttctgtacagattgccttgtatatcagcaccagagaggtcatctttagccatgatcaggtcgtccagggttacttcatc

SEQ ID NO: 565810 - DNA, 276 bp, Homo sapiens
  misc_feature (24)..(26): n is a, c, g, or t
  misc_feature (33)..(33): n is a, c, g, or t
  misc_feature (41)..(41): n is a, c, g, or t
  misc_feature (45)..(45): n is a, c, g, or t
  misc_feature (63)..(63): n is a, c, g, or t
  misc_feature (82)..(82): n is a, c, g, or t
  misc_feature (95)..(95): n is a, c, g, or t
  misc_feature (97)..(97): n is a, c, g, or t
  misc_feature (135)..(135): n is a, c, g, or t
  misc_feature (175)..(175): n is a, c, g, or t
  misc_feature (192)..(192): n is a, c, g, or t
  misc_feature (229)..(229): n is a, c, g, or t
  misc_feature (238)..(238): n is a, c, g, or t
  misc_feature (274)..(274): n is a, c, g, or t
tgaggatgaagaggaggataccannnagggaangccgatgncccnggccagtgcccacagctntcatggggttcttgcccgntctgttcgtgggnantgtattccagctccggggaatagggggttcaggttccnccttgccctctggggagctgtggctttgcagggcccgggncgtgttatgagaagccntgttagctgtggctcctgcgagaatcccccggaggangcgggcatntctcgccccccggcccttcagcgccgtagcagctancg

SEQ ID NO: 565811 - DNA, 113 bp, Homo sapiens
tctagtcaccagggcgcgtacctatcggacctatgattatagcttaaaacattgacaatccaaacccagagccaagatgacaccatggcacttcagtctggactagaggggcc

SEQ ID NO: 565812 - DNA, 641 bp, Homo sapiens
taaaactaggagaaaccaaatctggaagccaaaaggtaggcttagttgggtggtgtgtgtcctcttgaagtttgtgtcgcctcagtgtgtgtgtgcaacagggttagtggacatattcgtgtcgtgggtggccccgatttcgtgggtggctcgtgtgtggcaggctgtggccagttccaggcgtgccgtgggggcacgccgccttctttatacaagacagtctctgtgtgcctgtggtgtatcacatgtgcgctctcagggggcacagtgcagtgaggagccgtgggcccggtgtgcacacgttgtgagaagaacgccccgtgtgtgtagaaagagtgtgaaagtgctgtggggacacctcagagggcctttcgagaaacgagaagagaggcacgtgtgatcagggaagggtggacggacaagggggggcctgtggagagaaatcctatccgtgggggagaaaccaagaggcccgggtccctgtgccctgtgtgtgggaacgccacgggtctctctcgagggggggcgcagtggctatttcaacactcactgtgggaaaaacatctgtgcaaacgaaagaggcggagaagtagctacatgatgggggccgagaaaagactgtgggaacactcagtgggaag

SEQ ID NO: 565813 - DNA, 406 bp, Homo sapiens
cacaaagtataccctgaactgcacatcaccaatttggggggggccaaccaaccagtgaccatccagaactggtgcaagcggggcctcaagcagggtaagacccatccccactttgtgattccctaccgctgcttagttggcgaggttgaaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagagacaacgtgtattctgctgatgcggaggaggatgactcggttgtct

SEQ ID NO: 565814 - DNA, 364 bp, Homo sapiens
taacgacaccctcctctttcagcttccagtagtcggactacaagcatgtgcaccacacctatacatttttgaaaaattttgtagggctgggtgcggtggctcacacctgtaatcccagaactttgggaggccgagacaggtggatcacgaggtcaggagatcgagaccatcctggctaacatggtgaaatcctgtctctactaaaaatacaaaaattagctgggcatggtggtgctcgcctgtagtcccagctactcgggaggctgaggcaggagaatggtgtgaacccgggaggtggaacttgcagtgagccgaggtggcaccactacactccagcctgggcgacagagcgagactccatctc

SEQ ID NO: 565815 - DNA, 785 bp, Homo sapiens
  misc_feature (258)..(258): n is a, c, g, or t
  misc_feature (263)..(263): n is a, c, g, or t
  misc_feature (276)..(276): n is a, c, g, or t
  misc_feature (289)..(289): n is a, c, g, or t
  misc_feature (295)..(295): n is a, c, g, or t
  misc_feature (299)..(299): n is a, c, g, or t
  misc_feature (310)..(310): n is a, c, g, or t
  misc_feature (393)..(393): n is a, c, g, or t
  misc_feature (403)..(403): n is a, c, g, or t
  misc_feature (444)..(444): n is a, c, g, or t
  misc_feature (449)..(449): n is a, c, g, or t
  misc_feature (480)..(480): n is a, c, g, or t
  misc_feature (683)..(683): n is a, c, g, or t
cggacattaatctggatgtcccacattcatactctgtgctggagcggttgtagaagaatgttttcaggctggaataatttccaaacaactcagagatcttgtccttcaaggggcagaaagcgtttgtaagcgaaggagatggaggtcgtcttaaaccagagagctactgaatataagaactcttgcagtcttagatgttataaaaatatatatctgaatgtaagagttgttagcacaagttttttttttttttttttnaagcncttgtttggggtncaaggctttctgntttttntaancctacttttanggggaattttaaaggaaatgttttttctttttttttggttttccgagggggcagggagggacagaaaagtaacctcttcttangtggaatatnctaataagctacctttggtaagtgccaggtttattatctantcatnccaagtttggctttgatgtctgacggccacncctttctttcagggacagtgttttggtagtaaaatcaggggtttatacaaagccttaattagggggtaagagttaagctgttaaaaccccagtgtgggttgctgctgtggaaatacgtggctggggagtaaaaaaaagaaagttatttcttgggtcttaaaagaattttaaaaaattagtcatgagacttattcatctttccngggaacatactgattggtcttaaagactagaccgttagtaaaggtggtgggacatctatttctcacagtggaaatgactggttctaagatgtctcaattaat

SEQ ID NO: 565816 - DNA, 183 bp, Homo sapiens
  misc_feature (1)..(1): n is a, c, g, or t
naatcactcgaaatgaataaaagacttaaactaaaaagataaaactctaaatctcttagaagataacatagggttaaatcttcatgacactggattccacaatgatttctgtggatatgataccaaaggcacaggcaacaagagaaaaaaaaaccagataaacgggtctacttcaaaataaaa

SEQ ID NO: 565817 - DNA, 385 bp, Homo sapiens
ctttgtgtatttgtctgccatcttcagagagaccttccagataagaatttctgcttagagctccagtaccaagtatatgggccagcacagccacaacacagacttggtgctcctcacaggtcctctggccaatgtcctcgttaatattctcaaccagctcagaaggtgggccgttatcagaaaccaactcaagggcccgggactcaatgtcggttcttgtcggcccacggtcataatccacaggagactggcctttttgaaatatcttgatgtgtaggaaatcctctaatccggtatcgggaggccagacacgtgattgactgtagcatccacagctgacagtctcactcctcctttcgtgtgctcttacacctctaaatctgcg

SEQ ID NO: 565818 - DNA, 793 bp, Homo sapiens
gagcagcccagcgtgcccattccagcgcccgcgtacccgcagcatgcctgcgcccaccgacctgctaggccgctgctgtgctgtgcgctgctagctactgcgcccccagtcctcctcgttcgccctgtgatatctagttccaaagaacccctgctcatgaacggtggtttatagcgacggatgatttcccaatgaagtgctgaggagatgtcttcccctcgttacacctgcacgtgccttactcgggctacgcaggtgcaattcactgtgagacgaaatgtgtcgagccactgggcactggagaatgggaacacttgccaatctcatctatgatctgccgcctacatactagtcgcgtagtagacctatcttgcggcttttgctctgcattggtgtacctcggagcttgtgtcctgcctgacatctcgttgtcagtgcataggtcaaatgccttaggacatctcctatgtcatgtccaattgacgatatatccccttgtgactccagcgctgaatccttgtcatgcgagagggactgtgcggtacacacggtgctgtgtgacctgcacgtggatgtccacccgtccttctggcccagctccctgaacgcttcccccatgacaaagtgtcccttttcacacgtgcttgtggccctacttatgcccattacaactgctgcacactctgatagttccgcacatctccacttccttatcactcgtttacatacataccaaaccaccaacgtaagaataagatatgtagataacactgtagaaactactaacacatcg

SEQ ID NO: 565819 - DNA, 140 bp, Homo sapiens
cgtgtgctggctggctactggtggtgcctgacatcaggttaggggctctcacgccactctgcgtgcctctgccctcgctgctcttggccatgcgcccccaagatgctctctcccttctccaatgagggagccacagaact

SEQ ID NO: 565820 - DNA, 142 bp, Homo sapiens
ggtcgacatctgctctggtcgacttctgctctggtgaactttgatattcaagattaaattggcgtggtattaagagggtaaggaatgtttaattggctttaaagagccccttagttgagatggaggaagaaacagaaataag

SEQ ID NO: 565821 - DNA, 416 bp, Homo sapiens
ggctggaagcatagttcaccacgtaatagatacaataaattatgctcagggcgtgatgtgtggcaccatgcagtcccagctattcagagagtgcttgagtgtagaatgtgtgtgaacctgggaggcggagctatgcggtgagtccaatattgtgccactgcactccagcgtgggcgactgagtgagactccgtctcactaaaaaagaatcatttcctttattttaagtttcatctgcctgcaaacacaagcattctgttgatcaacggaaatatttagatgtgccatttcttgtctaaatcaaagtttcatatacagcaccgagggggccacgagaggcagaggcccagacagaaggtgaacatagccttgcagggagacatatgccaggcaggatgaccattgggactgcatcat

SEQ ID NO: 565822 - DNA, 196 bp, Homo sapiens
aggtggttgctcgctggtttagcggacagtcgcattagcaagatcctccgtcgtggtcgggatgccgtcctgtacgaggggacgaaggtggtgttcgctatgccttgggcatttccaagtacaacgagaaggagatcttgaggctacagaatggcctggaaatctaccagtacctgcgaacctatgagggtacgca

SEQ ID NO: 565823 - DNA, 405 bp, Homo sapiens
accgcttatacagaggctacctaagatcaagcattagagaaaaacagtggagtcatgcaggcagtaatatgtcagatttggtacaggattaaaatactaactgttttgaatggtcctggtctcaaattgaagtaaatacgaagacaatatagaaatatacaaccagttgataagactgtactgcagatgctcagaaagttaaatctcgctctcatatgtagtgcaggtatgtctagactgtcaggatctctgggtagctgcggctggtctttcggaagaagtcgcaggctggtgagatgttcaatgtcgcgcgccctgaggctgtgtgcggtcttcatgagtgcttctacccatgttgattcgtcgtctgagctattgctgctctcctcgttgtccggccggtga

SEQ ID NO: 565824 - DNA, 626 bp, Homo sapiens
tatggcagaaatatgggccttgatgtgaggacagcatcaattaatgagggatcctctcccttgatcaaaacaccttccaccaagacccacctttaacgctgagcattacctctcaaagtgagaattgggcagggactaatatccaaactgtatcaacatctgacaaggtgttcacaaccagaatatataaggagctataacaattctatagacatacaaatggcaaacaggcatatgaaaaggtactcaacatcattgatccattagagaaatgcgcatcaaaactacagtaagatatcatctcaccccagttaaaatgtcttctcccaaaagacagataataacacatgcttgagaggatgtggagaaaaaggaaaacctcgtgcacttggggaaatggtattagtacaaccacatatggacacacacatttgaggggccctctaaaacttaaaatagagctattataccattccaccatatcacctgtgggtatataccccaaagacccgaaaatacggtattggagagatatactggcacgcggtgaccggtgcactatctactaggccagaatttggagcgacctcaatggcttaccgccgatgggagggttttttggcccc

SEQ ID NO: 565825 - DNA, 304 bp, Homo sapiens
  misc_feature (32)..(32): n is a, c, g, or t
  misc_feature (102)..(102): n is a, c, g, or t
  misc_feature (214)..(214): n is a, c, g, or t
ccccccacaaatcaacctaagccttgttatanccccttgaagaaagcccaattgattaaataaaatatttagaagtttcagaagagtaggccataaaagtgnccttataatctaccacaaaagtcaaagaattataagtatgaatcaggaacatcattctgaacagcagcttgcatgtgtggtatattttgaagaaaagattgctcctttcaantttctgaaatctgtttttaaacattttttgtttgtttttttaccaaatatatatatttttttgcctttgcttgtttctaggaattccata

SEQ ID NO: 565826 - DNA, 951 bp, Homo sapiens
agcggacgggcgcgcggactatcgggcggctaggctctctgaggaggctgccacaggtgaagcagccgtgacaagtggtgcccgaccaggacctgaacgaggaaggtctgccagagcagagaaagtgaaactgaacagacaaacaacaaacccccaagacgggagaagttctagccgacaagaaaataaaaaaaaaaatacaaatccaataaagaacccaccaaagaaaaaataaaccatataacttgaatggaccttgaggaggaaccagattataacaggtcatagtctcttgagatgcgtccgaaacaatccttaaaccgagttaaatacaaaagacgtgaacttgagacaaagaccgtgcggagtacgtgtagattttgccatttgcgttcttaaatatattaaacatatgcgaaagttgcaatttcaaagatttcattttaatgcttttttattttttcgtcattatgtgttcattctgggggattccttaaactgtccatattaactatatttctcaaggtgcttgggctatttaattaccattgattgtactgataattaacttttgaaaaaccgatctctagccaagtatttgaagttgtttaacacaagcccaaaaaaaaacgcgatgattgatcaataattttagcgatttagatcaggaacaaaattgagatgaggtttttaactctctgaaatatacttacgtttacgaattttaagtttcgggtaaagaactcgacttgggtggatcttctagaaattcaagatcttttcgattaccaattatcgctatagttgaagtcgtgaataatattgactaaattgaaaacaattcttggttacaatgcgcttcaataagtaaatatctagaaaccgaggctttagaccccatgtttctcttgatttccgaaatgttagacttcaagaaatctgatctaaatc

SEQ ID NO: 565827 - DNA, 129 bp, Homo sapiens
cacattctgtagctttaaaacattattaaagaacatgaaaataaatgcttgggaagtataaagcgttgaggtttctctggaaagcactagacattgtggtgttcatgggtagttaaacataaaatagct

SEQ ID NO: 565828 - DNA, 577 bp, Homo sapiens
  misc_feature (331)..(331): n is a, c, g, or t
  misc_feature (333)..(334): n is a, c, g, or t
  misc_feature (370)..(370): n is a, c, g, or t
  misc_feature (394)..(394): n is a, c, g, or t
  misc_feature (453)..(454): n is a, c, g, or t
  misc_feature (513)..(513): n is a, c, g, or t
  misc_feature (515)..(515): n is a, c, g, or t
ggagcagtaggggcacttgaagggcttgctgccggcgtgcaggtgcatgtggcccagcaggttgtacatgcggtccacgcacttcccgcacaccctgcatctgaatggcttcacgggcgagtgtacaatcatgtgggtcttgagagtctgcttctgtacaaaggtcttgaagcagatgtggcactggtagggccggacgctggtgtggatcagcatgtgccgcttcatgttcgcctgtagggtgaactcccggccacacacctggcacttgaactccttcacgcccttgtggctccgccagcgctgcccagcgtggtgaatctggctgaantnnacgccgcattcagtgcacacgaagggtcgcaggttntggtggttgagcatgtggttctgnacctggctgcggtagtggaaggacttgtcacactcgaggcactggtagagggtggggcnntggtgggaaaaatagaatctttatattttttgttagggctggagaagtccaggccgcantngacgcagacatggcagcggccactctcatgcttcacttcgtgggccttgagctcgctggggt

SEQ ID NO: 565829 - DNA, 382 bp, Homo sapiens
ggtaggtgggggtagatctggatgtgatgtgttagtctgaggtgtctcaggtagtccctgggtggtgtgtgcagtgagatggtgtgttatgaagtgacttggatgttgtagggcatgtctgtgcatcgtggggttttacgcatgtttgctcagcacttctgcgtgctctcagctaagcgttggtgttatgaaataaaaaacctatttttcaggaccagtctttgttgtctggaaattatatgtatgatgggacacgtccatgtattttggggaaggcctgggtgtcatgggataagttcagttgtccccaaaatatacggacatgtccgataacacatacaatgttgtgattctgtgtggcttgcctaagttcagagccagg

SEQ ID NO: 565830 - DNA, 588 bp, Homo sapiens
atttgaatatcttcttgatgaatcaatccttttatcattctattgcatatctaaagctaggtaacaaattattctaaaactttgcagcttaaaataataaacatttatttaacaaacactggttctgccgatcagaaattcagaaattcaggggtagcttagttgcgtggttctggcctgcggtctcccatgaggtagccgttaacaggttggctggggctgcagttatctgaaggcttgactgccgttgctggatatgctcccaagatggctcacacacgtggctcttggatgcaggtcttcgctgctcactatgtgaaccctctcttcatccatagcagttgacctctctcagagccacatgactaagtagagagcaactaagctggacggcacaatatcttttatctctttaccatactctattcatgagtcacaacgtccaatcaacattcacgaggagacgattacggtctaccctctaacgacaagcacttctaccaatacgaagccctattttttcacacaacattttacaacgcctctttccccgccgctctcgtctctcttcctctctctctcttcccg

SEQ ID NO: 565831 - DNA, 358 bp, Homo sapiens
  misc_feature (201)..(201): n is a, c, g, or t
cgaggcggggtgttggctgcgacacgcccctcactgggtccggagctggtaatctccgttctgcgtagatataaacgcacccagtgcagggcctggtacccatctcttctcaagtgatcttcagtgtagcgcacctggagcgccggagttagtagaagtaggggatctcgaacttgacactgatcgggggcttgcccttcnttgtcttcggcctccacactaggcaggccgaattgggcccgcatcaggtactccttgcggccggggaaggctttgatggaccacacgatctcgctgtcctcggggacccatttaacgctccccacggtcgtcttgaacttgggtgagtcggcttcct

SEQ ID NO: 565832 - DNA, 355 bp, Homo sapiens
  misc_feature (303)..(303): n is a, c, g, or t
  misc_feature (339)..(339): n is a, c, g, or t
atctaggctgagtgcagtggcgtgatcagggctcactgcagcctcaacttccttggctcaggcgatcctcccgcctcactcagtctctcaaatggctggaactgcagttgtgcgccaccatgcctggctaatttttttatttttttgtagagatggtctcaccttgttgcgcaggctggtctcaagggaattcaaacctttggacttacgctgtcccccagcctcggcctccccaagggttgagaatacagggcatgagccaacacacccagccaataagatttcattcttgtgtagtattanttgtgctactttttttctttccccaagagtaacttntatttcaaattaaatt

SEQ ID NO: 565833 - DNA, 218 bp, Homo sapiens
catcttcccctgaaacccagtagtatatctagttgtatgctcaacttttctgcttggattctaactaggaatcttaaaattaacatgtccaaaccctgttttttcttgtttttttagaggcagagatctcactctgtcgtccaggctggagtgcagtggaaagatcttggttcactgcaacttccgactcctgggttcaagcgattctcctgcctcag

SEQ ID NO: 565834 - DNA, 143 bp, Homo sapiens
cgagccaggaaacgtggcatgcacgcgcagaacgcctgtcagcgtgaaccgaacgatggcgcgctgcgcggtgatcagtacgtcaaaatctccagtccgagcaaggcgctgggtttgcagcgctcaagcgtacgcggggaggc

SEQ ID NO: 565835 - DNA, 212 bp, Homo sapiens
tggcgctctctgtcatctgctcgaatctttcccgtctgaagttccttttggggctgatcttggaggaggtgtctttcttgcctgtcacaggtcagactaaaggggagacttcactaggtttgctgcaaatttacttccctgtctttttcttgctatccattgataccctttgtgctgataactgataagggcagttgactgagcccagcaag

SEQ ID NO: 565836 - DNA, 670 bp, Homo sapiens
cgaattcggccattatggccgggtgctttggctcatgcctgtaatcccagcactttgggaggctgaggcgggcagatcacaaggtcaggagttcgagatcagcctggccaatgcggtgaaaccccgtctctactaaaaacacaaaaaaattacccgggtgtggtggcgagcaactgtagtcccagctacctgggaggctgaggcggaacaattgcttgaacccgggaggcggtggcggaggctgcagtgagccgagatagtgccactgcaccccagcttgggcaacagggcaagactctgtctcaaaaaatcccagcactttgggaggccgaggtgggcagatcacgaggtcaggagatcgagaccatcctggctaacacggtgaaaccccacctctactaaaaatacaaaaaattagccgctcgtgctggcggccgcatgtagtcccacctactcccggcaggctgaggcagtagaatggtgtaaacttaggaaggcgagcttgcagcgagcagagattgggccacttgactccagcctgggcaacagagtgagactctgtctaaaaacaaaaacaaatgctcccatataggatgaacactcatgaatcgcaagataggtctcaacacggaaattgacgctttaacggatcggaaattttcggaactcc

SEQ ID NO: 565837 - DNA, 490 bp, Homo sapiens
  misc_feature (28)..(28): n is a, c, g, or t
  misc_feature (38)..(38): n is a, c, g, or t
  misc_feature (63)..(63): n is a, c, g, or t
  misc_feature (100)..(100): n is a, c, g, or t
  misc_feature (441)..(441): n is a, c, g, or t
cctcttggaagtttccctcattttgcangtgccagctnctttccccctgcttgaacaggggantgtactgagcactcccagatgggcctttccccaagcnggaacccaatgggcccaaatgaatcaagttgaaggagagtgagcagagtcagcagtgagagaaagacttagctgcaaggtcaaaatccgtctgaaaacagacacgatggaagacagacagttcctcctggatcatcgtataaagaaaagggatggatcaagacagggattgctgatgcatatctgctcgctgtttgactacaaaatactctcatgattgattctgtgtctgccacccaagatcagtctcaaggaaatgctgacaaaaccctggcacccagagtcacagagctcagtttccagccctagcaccacccttgataacttgagtgaccttggacncctggtctctgcctcagtttccaaattaaatgagtgtggtgaaaactta

SEQ ID NO: 565838 - DNA, 768 bp, Homo sapiens
  misc_feature (768)..(768): n is a, c, g, or t
agatggaaaatgttgtccagagttcaggggaagaggatattgggttcttttctctgaggtcactgtttcaaaacgttacagaagaaaaggctaatattgcttcagcccttgcccagatcccacagaagttataaagagtatgctatgagtttatcagggattcaccatgatcaacctgtgaagcccctgatcgagcaaacttctggatcgagtttgtcatgtgccacaaaggagccaagcacctgtggtcagctgcccacagcctcacctggttccagcactactctatagatgtgattgggttcctgctggcctgtgtggcaactgctatattcttggtcacaagatgttgtttattttcctgtcaaaaatttaataacactagaaagatagaaaagagggaatagatctttccaaatttagggaagacctgatggggtaatcctgttaattccagacacaaagaatttagtgaaaacatgttcccttcctattttcatattatctattctgatattttatcttagctaagtagcctagaattccacgatcatgaacttgcgagtatatctcattctttcattgcattttcctaggtgtgcttactctcttctctcactttgtgacacaaggacatgaatacatgtaaattttcatatttctgatatcactgcttccatgatgtcatcacttctttaaccttaagtgaaggggtgacctgcaatatgctgattcctggtgttgcccaccacttgatgtaaaaaatcn

SEQ ID NO: 565839 - DNA, 880 bp, Homo sapiens
  misc_feature (91)..(91): n is a, c, g, or t
  misc_feature (100)..(100): n is a, c, g, or t
  misc_feature (107)..(107): n is a, c, g, or t
  misc_feature (119)..(119): n is a, c, g, or t
  misc_feature (130)..(132): n is a, c, g, or t
  misc_feature (139)..(139): n is a, c, g, or t
  misc_feature (146)..(146): n is a, c, g, or t
acttcggcacgagggctgccttttgaaatatttgatgtgttgcctggcaggatactgcaaagaacatggtttatttaaaatttataaacangtcacttanatgccanttgtctgaaaantcttataaggnnntaccctngataggnatttacacaggtagggagtgtttagtggacaatagtgtacggttatggatggaggtgtcggctactaaattgaataacgagtaaataatcttacttgggtagagatggcctttgccaacaaagtgaactgtagggtcgttttaaactcatgaagtatgggttcagtggaaatgttggaactctgaaggatatagacaaggttttgaaaaggataatcatgggtgagaaggaagtgtttcgaaagtctcttcgaaagttagtttagggccatcacggtagctcaccctgtgtaatcccagcacttggggaggctgaggtgggtagattagtctgagcccaggaatgcaagaccagctggtgcaacatggtgaaaccctgtttctatacccctcgtatctgggctttgtagcatatgcctgtggtcccaggtactgaaggaggctgagcgtgggaggattgctttgaggcccaggtaggcaagagagttgtgtgacgcaggatcacgtctttgaactctagcctgggtcaactgagtaagcacctacacatgttctttattgaagtcccaggaggcaaacttgtgggacggacggaagtatctgtaaccactaggtttcctcaggactatataaagctaaccagtctccattacacaatgacagccgaatcagactaaaacaaatcaataaaacacggtggacaaaaattccaataaaaaatttcaaatgtaagcc

SEQ ID NO: 565840 - DNA, 154 bp, Homo sapiens
atgcagtgtcacaccatgggccataaaatacaccagaatgatatctgcatcattcacaacttcatcaaagttctctttgtgtcaacacaatggtggatccatctacgagtctgaccgtgcagtgacatgcaatgcttgtgcacttggcctgtct

SEQ ID NO: 565841 - DNA, 148 bp, Homo sapiens
ggcaaacccctccaggcctgggtaattttttttttttcataaagactaggtagctccataatggtcaggctggtttagaacacccaaccttagggggaccccccaacttgaccccccaaagtgctgagattaaaggggtgagctccga

SEQ ID NO: 565842 - DNA, 789 bp, Homo sapiens
cgagagcagaggacgagccgggacgcggcgccgcggcaccaggcgcgcagccgggccggcccgacccctaccggccatacggtggagccatcgaagcccccacccacaggtctgacagagagcaccgtttcaccagagggactcaacaccggcgatctatgtttaaggtttgtaactctcgccgtccaacaggaccagcgagtaacttcctgtccccaaaggcccagcaggcccccctagccccgcgcggccccctagcctgcctcccggccgcccggactgccgcgccatgtcctccagtcggccctggggacatcggcagctctgcatgcagatccgcgtgaggaagtgaccgtagacaggaccggagtaggagcagcgtagggatccagctgctggccagaggcacggcaggcgccaaagcatgccccatcatcacgtgaacgagacaggtgtcggcggccttgacgatgcaagcggcaagacggcccgcccaggtggaacagctggtgacacgcgcaataggaccctggcggtgatctcctaagtccccatccatggccccagtgactcatggcgcctcaaagctattgacccaaatggggacgttgcgagaagtcgcgacgtgatgccacatgccagacggagagggagcccctgcttggggagcgctggcacagggacggaggtcaccagacacgagctgagcagggtgccaggtttgacacccactgccttgaaggtctcaaagacgcacgctggacacaatgggctgcagtgcagtcgaca

SEQ ID NO: 565843 - DNA, 856 bp, Homo sapiens
tctttaacaccctgcgtggcagtccctgacgcaccgtcgtgatgcccaggaagacagggggacctggaagtccaactacttccttaatgatcatccagctattggatgattataccgaaatgtatcattgtgggagcagacaatgtgggctccgaagcaagaatgcatgcagatccgaatgtcccttcgcgggaaggcgtgtggctgcattatggcgcaatgatatcaccaatgattgcgtcgaaggccattacagtagcggcggcctggaaaagcgaagccccaggctcgtggtatgaagagctgctgcctccatactcgctgggcggaatgtgaggccttcgatggtatcaccaatggagagatcatcatgtgaagagtcagaggacattgtttgctggccatataagagtgaccacgtcgtgcgagccctgtgctggtgccatttgccccgatgtgaaagtgcgacatggtgtccgagcgctcgagtaagcaactgggtctcgggcccggagaagagctcctaaaataccggaggcttgaggtatgtcaccacttagaaatcctccatggggcagcagtttgaaatcctggagttgatgttgctgctgatctagtgactggggcaccaaaagtgtggaagcccagcagaaggccactgcttgctgacacatagcacgaagaatctgctcccattctaccttatggggacgtggtcaatccgagcaggtagtacgaaagtggctggattttacaagccctgaagtgcgttgatatccacacgaggagaactctgatactcgcttccgtggcaggggtgtcccgcgatggtgaccagtgttctgtctgcggattg

SEQ ID NO: 565844 - DNA, 141 bp, Homo sapiens
caagtaaggtagaaatgtactcgataacccaaggagccaggaagagcaagaactactaaagagagataggggataggagaagcaggtagagaacaagaacacagaagtatatatactaccaataaataccactcctaaagt

SEQ ID NO: 565845 - DNA, 314 bp, Homo sapiens
ggtaactttaatgtccgttctttttatatatagctcggcttattacagaggagtgtttagttgatatacgcacctgattgaagcatttaagttgtttaaagaatttatacatggacatatcataggcttgtgggtgagtgcctttgcttaaagtcttcagcggatatacattttgagatcatggtcactcattgaatagggctactgccttagcgtcatcatgctgtagatgagttgtgatgtgcatctgttcgaatacctgtggagagactgctgatcgttgtgctgtgtacgaacctgacagtctgtgctgg

SEQ ID NO: 565846 - DNA, 200 bp, Homo sapiens
agtttttcatttctgtctagtgctttctaagcctctttctaagctctttctctaactaactctccccaactccccctttttactttgtgttttccttttgaaaaaggaactttttctttgtggggggggggccccccaaatttgtgggggaaggaaggaaaaggggtgtttttttttttttccggtcttttttctaaccc

SEQ ID NO: 565847 - DNA, 82 bp, Homo sapiens
ctcttccttctccttttctttctccttcttccttttcctcttctccttcttttcttctccttctcccttctgtcgtcttctc

SEQ ID NO: 565848 - DNA, 562 bp, Homo sapiens
agtaaggagcggaatatcaaagtgagaaagggtgatgccatggagtgtcaatttaatatcaggatattcttgtgttagaaatgtagatattgaattttacagtttgaaaaagggtacctcagcctcttcagatactggtttattggcacatttcaacagaaatattagattccctttctttttcttaatagtgatcttctaacaagtttcttggaaaaactatcattctaagggaaatccctgtttataacctattaatatatttctattcctagaagagagtctagcagggattctagtaggaattactgagtgtttaggaaggcacttgatagaggcatctctgctttccagcacagggattctcagccttctaaagatctagaccagtttccaagctagcttctccacagcccaccactgactagtgtttgcttgtgtattctctaatggattttaggaggataggccttctgacagagtcatgaaagactgaaggcatgtctagggacataaaagctgactggcccttcagcaggaatgactgacagcggatctctgg

SEQ ID NO: 565849 - DNA, 347 bp, Homo sapiens
ctccctcacggatgtctgcgaaccttcaataaatgagttttatacttgcgtttaggtttttagaacatacggtcttactgtgttgccctggctaaattcaacactcctgggctcaaataatcctcctgcctcagcctcacaagtagctggggctccaggctcatgccactgaaaccagctagtttccacttcttaaaggtgccatcatgtcacagcgtgcacagatcatagagaaagcctgtgttagcacatttgcattcccatgggcattgagccaaatctgggcttgtaggctattctctcatgccaggcagggaacccagggcaggcaggttgtcgccaacaat

SEQ ID NO: 565850 - DNA, 127 bp, Homo sapiens
tgggcacgaagcagcgcgtactcattcttcagctcctcgatctgctagcctcaggagctcgtagtccatctgcagccgatcggcctctatgaaggtatcctgcatgcgctggttggtctggcgcaac

SEQ ID NO: 565851 - DNA, 397 bp, Homo sapiens
atccgtacacatattggatgttctgaatatgtcttgggtaacttaactatcctctgttagaagaacattttggatacttgtagggttttgcccatgttttttttgcgacagagtctcgctctgttgtccaggttggagtgcaatggcatgagcttggctcactgctaatctccacctcctggattcaagtgattcttgtgcctcagcctcccaagtagctgggattacaggtgtgcgtcaccacacttggctaatttttgtttgtttttgttttgttttgttttgttttttttgagacggagtctcgctctgtcgccaggcttgagtgcagtggtgcaatattggctcactgcaacctccgactacctgggtcaagcgattctcctgccttagcgtt

SEQ ID NO: 565852 - DNA, 155 bp, Homo sapiens
cttgtgctggcctctggtggcgcggcacccatcccctccacatcccacagctccaggcatccatttgtcaacacatcctcaccaacatgcaccaatcaacaccccggtggggttttttttttttttttttttttttttttttttttttttttttt

SEQ ID NO: 565853 - DNA, 875 bp, Homo sapiens
aaagtggtgaaggcagcagcccaggtcttgaatacattcatggcaatatcgggacctccggagcatctatagaataaggatgggtggaatcagaaccattttacttacaccgtgtgtcgacattggacgcgagaccgatatcaaattcgacatgccgtgtccttgtctacgcacactaagcccagagcatgatggtcacccagtcagttgcagtcaggtctccagctaaatcgcttcatccaatttgtaccatcagttcctattcctcaccaggcaagagaacaataatagacggctacagcatcagcagctgtattatagtcaggatgactccaacagagaagaacttgtgatgctactacagatggtattggcagtctccgtcatagctatgaagcatccttagtgttagatgaccgagttacactgtgtccagctttcgtacgtgagttactcaacaccagtatggactgtaaatcgcacgagaaattatgtagcacgtttattccactaaaggagcttctgtatagagcagaacagtacccaggtccccagacgtcatgggtgtagcatcaagagtgcccaacctgaggaaactctttctttgctaaacctgtgcagactcgaagggtgaaccagtccatctgggctgatttgatgattgaactgtgaaagtgaacgtggccggcatgaactgaaggtgtcaagaaatcctatccgaggatgatccgcgccgcgagcacatgccgggaaaggacctcaccccaataaggtggaagatctaacactcataatctgggacggtgaaagtggcagaaggaaacttgaaccgggcacaatcgggttcgccacaacagatgacttccggaaaaacc

SEQ ID NO: 565854 - DNA, 154 bp, Homo sapiens
gagaaagactgtattcaataatcaagttggaggccagacgtggtggctcacacctataatccctaccgtttgggaggccaaggcaagcagatggcttgagcccaggagttcaagaccagccttggcaacatggcaaaaccctgtctttagggca

SEQ ID NO: 565855 - DNA, 124 bp, Homo sapiens
agactcggcacccgttcgagtaggagggcgctggggtgagcttgaaggctagtggcgcggaccctgtggtggcgtccggcggcaggtgcagattttgagtggtcagtagctaaatattctaaga

SEQ ID NO: 565856 - DNA, 186 bp, Homo sapiens
ccccctccccgggtatcatcacccgaggaggcaaccagccttaacgcctgaacgcaggcacatacttcctattctacaccctagaaggctcccttcccctactcatggcactaatttacactcacaacaccctaggctcactaaacattctactactcactctaactaccctacccggggaggggg

SEQ ID NO: 565857 - DNA, 237 bp, Homo sapiens
  misc_feature (47)..(47): n is a, c, g, or t
cccgctaatttactcgggtactggaggatctctagagtcgtccaggntcctcttaacgatatttggaggtcagcacggtgctcacgtatcgacgtgaacttgtacagtgcaggcatgcaccgcattggtgaatacacgtgaccaggctccatctatacgatattaggagagtcagcacggatctcacgtatcgacggaacttgtccagggaggcatgcaccgcagtggtgaatacac

SEQ ID NO: 565858 - DNA, 711 bp, Homo sapiens
tacggtccctgcagtgcctgctgctgaggaggccaccgaagctcgtgggacgcgatggagcctggcgtggccctgtgaaagacgccccgatcctggacgctggtgcagctgcatccaccatgctgcatgtgctgagctgctgcgcatgtggcttcctgcctgacttggatgtgatgttgatgttgtggtgtgcgctggatgtgtgtgcatcagtggttctggtccccctgccctgctcctggtgctgtgtggctgtgttctctgtgctgtgtgcgtgcctggatgtgagtgagctgggtccttgtgtggctgcatgagtcagattgtgggctggggatttctggggcaccgtggtcctcaccttcacgaaaaaggccccacagcacgtccccactaccctgacgactcactcttcgtggcttctctctcctccccaagagcatggggtgggcctgtctcgcgttcccctgcgtggagtcagtgaagcgtccttcctacctaccagtcctcccctctggtgtcttgggtgacacttcctgtggggcctttcaggtggtttggcgccgtgtgcaggggccttgagaggcctggtggtgcgcggcctcagggtccccacattgcctgcaggaggccaccgccagtacctgcggcagtcgggccctgaactacgacttcgcgcgcctaccggagcacagtgccacggggtgacca

SEQ ID NO: 565859 - DNA, 270 bp, Homo sapiens
  misc_feature (29)..(30): n is a, c, g, or t
  misc_feature (35)..(35): n is a, c, g, or t
  misc_feature (44)..(44): n is a, c, g, or t
  misc_feature (49)..(49): n is a, c, g, or t
  misc_feature (53)..(56): n is a, c, g, or t
  misc_feature (58)..(58): n is a, c, g, or t
  misc_feature (60)..(60): n is a, c, g, or t
  misc_feature (78)..(78): n is a, c, g, or t
  misc_feature (80)..(80): n is a, c, g, or t
  misc_feature (82)..(82): n is a, c, g, or t
  misc_feature (234)..(234): n is a, c, g, or t
  misc_feature (259)..(259): n is a, c, g, or t
ggatcggcacgagccacgacgaccacaannccaanccttccagnggcantcannnncntncctacctcttcaactcantntnagtatctgtgtcctcccttcttgtctttccctgtacctctgtttgttgtacctgttgtacccctgtgtcatcctgtctgtagtactcccagtagtttccccgtgttgtcaggtcagtgtaaaattgtgttgtaacgttgtgtgtctgtcgtntgtcccaatccgtagtgtagtcgtntgttgtctgtc

SEQ ID NO: 565860 - DNA, 237 bp, Homo sapiens
  misc_feature (181)..(181): n is a, c, g, or t
  misc_feature (215)..(215): n is a, c, g, or t
agtagagacagggtttcaccaggttggccaggcatattacgaattcctgacctcagctgatccacccgcctcagcctcccaaagtgctgggattgcaggcatgagccactgcgtctggcatatcttagttttattatgcaaatagttttgaccttgcagatcctctgaaagggtctcaggnacccagacaattgtaaccagaccattctttaagnaccactaaacagttttgtagag

SEQ ID NO: 565861 - DNA, 314 bp, Homo sapiens
ggggcccccaagatccgtgtgaatcatgttccctccccattggtgatgaggttcatgggccaggccccttgtagtgccccccccaaggcaaaggttatgttgaaccgattcccccttggcaagtttgtttgggtaggggacgtggtgaacgccatcctttttttggggaggggcccaagggggatgcccaggggttcccttttgccggtggaaggggggttttgggcctgttggggtccctccacacccctcaagccccatgcgggggttttcctccccccaatccctccaataaacctgtttttgttgcccca

SEQ ID NO: 565862 - DNA, 445 bp, Homo sapiens
  misc_feature (23)..(23): n is a, c, g, or t
  misc_feature (192)..(192): n is a, c, g, or t
  misc_feature (370)..(370): n is a, c, g, or t
  misc_feature (407)..(407): n is a, c, g, or t
tggtggggaatggagtttcactnttgtcgcccaggctggagtgcagtggtgtgatctctgctcactgcaacctctgcctcctgggttcaagcgattctcctgccttagtctcctgagtagctgggattacaggcgcccgccaccaagcccagctaatttttgtacttttagtagagacagggtttcaccatnttgggcaggctggtctcaaactcctgacctcaggtgatccacccgcctcggccttccaaagttctgggattacaggcgtgacacccgttgcctggcccctctgtggttactttctctggtgaagtcaaacccctcaaagtcatccatgatgattgagtcaacttttttcaaactcctntaaatgttggacatattgacctttttcaatgaatcantaatgttcccaatggcatttagggtggttaatctttcc

SEQ ID NO: 565863 - DNA, 776 bp, Homo sapiens
taccaatatttgaatagtaactaagatcgtcagtgtatctggacttcttgttttttgaagttctaaaacaattatagtagggatttattatttggggcctccatccagatgttttgtccaagatcatttttataaaacttcatttgtcttctgttgtccagataacatactttccgttctataggaatcttcactgccaatcatagatatctaccagttggctttcttagactattcacgtccaaagctggagactgatgtcctgccagtagagaatctacagaaagttaatttgaatgaattaggaatccaacattcttgtatatgcaggagacagcttcctgatctagatgtacaattagagtttaggttgggaaattactttaaaagtgtgttttaccgggagatgtcttcaatctctgtgtaaatacccacatgcttatgcattgtaaaccagtgtgtgtaattcctgtgtatgaatttggtagaactgatttctgcttcaaagaagaatgctgcacctttaatttttataagtgtcccctccacctgtaaccctgatatattgtctgtagagctaaatactactaaatattgtgtacgtgactaggatcaggtttcgggaatatctgctgatgagacctaaaatagttcgatttttttaagtaccttggttaacagagtaaagattattcctcttattttttacagaagaatgcactttaacaaaacatagagctgcatgggcaattcaaaacaaatctgtgaagtgcagt

SEQ ID NO: 565864 - DNA, 228 bp, Homo sapiens
gcggcgagtgaatcgagctcggtcgtcgattatagaatgactgcgccggttcaagcttcagtgaggtttggatatgaatggctgttactacgagggcttatgtgtgtctgattgaagagtatgctaatgagctgattttaggtctgtttgtcgtacgcacgatagagcttgttataattatgcctcatatggatagtacaaggaagggttataatcgccggtcacgag

SEQ ID NO: 565865 - DNA, 109 bp, Homo sapiens
cccccaaaaaaatgggggtgcatgttgggcttggcccccttggccccacccccccctccagggcaaaaagggcccagggttataataagtaaataacttgtttgtccca

SEQ ID NO: 565866 - DNA, 388 bp, Homo sapiens
gaccctgtctagctttcagcagagaggagacccacatagggtagctcgtcaccgcaggcaggtcttcccgacaagtggaggagacctggcctggagtgggtagttccttcctgtacctggtagtcccaacatctgtctgagtctagctgagtcctgggattttatgggctcagaagggaggaagtgtgtgctgtttggtccatgggtgaccaggagcaggctgggggaaaaagcaccataagttctcactctgggctgaggactccacctggaactggcagcccagcccccaggcttcaggccatccctggcttgtaggtggcgtttcactgaggacccacccctttctgcccaggagcctgtctgccttctgctgccatcaacatgt

SEQ ID NO: 565867 - DNA, 977 bp, Homo sapiens
cagtgctgagcgcgcggccccactcatatggggagagccaccacgccaccgggggttgcgggaccagacaccacatgttgtggctccacaaacaaaacgcgggggggttctctcaccaaaagagggcaccgggtcatccagtacgaagacgcggcttgtttgccaaaccagcacggagcgctgcgccgctcaaggaaaggcgccaccgcggagtggggccaccgcacaagacgggactgaatcccgtcagtagttcagtaaaggtggtgtggaagcgaccccgtcagcgccccccgtcaacttgtagcaacacaaatacacacggtgcggtgaaagaaagcggcacaccaacacggagcacacacgcgatgtcaggtgttcggcttaaacaagaaccaccaccgcgggacgggtcgttgcgtgatgggacaccaccacaccggggtgggagcgcgagagtcaggcgcgcacacaatattcgcaagattgtgtgcaggaaaaataatcccccgctttgtctccacatatgttgtggcacacggtcgcacattcggctagttcttgagtcggtgactacatcgtctcgaccaaacaagctactggtcgcctgtcaccacacgacggggttgttaccaacacaaaaatagaaactcacacccgcacacgctagtgacacttcctgtactgacaaccctcgttgcaacaccatctaggaggagcaattctcaagggttgctctcacctgttagcaccacgtgtagtatgcacccacggcgctcattcatataaatagccttctttttcatgtgggcgttgttaacgaacaggtagcggcgaccgatgcgtcccggaaataatagggcaagaatagaacagctgtcacccaccgaagaagaaacacctcacatgtgagtcttcccgcgcacacaacgcgggctttcaggtgtcgacaaaaaaattttttgtcccacataaca

SEQ ID NO: 565868 - DNA, 297 bp, Homo sapiens
tcctatataacgagatctacatcgggttcctagctaggagacactcgtcgcgagactccctcagaatgcattttcagattctcttctgggtctagattgagaagctcagattttcccatcatgctgggtaccagtgcaccccaaaggcctcgcagaaataattcggacgggccgtgtacctgtaagactctgccttcccacctccctgggggccatctaccttctccatcatcttcttggtttgcccatctcggattcgaagccggcgagcctgggtatccgtgcaattagaacagg

SEQ ID NO: 565869 - DNA, 399 bp, Homo sapiens
cacacctacgtggttctgtgcattccgggtgggatcatgttccatagccctgctggggatagggtccttcgcagctgtcatatgcatgagagacgactttggccgtctcccgttgggttctagggggctgccggtggtaaatgggatgacaggggagatgtgtgcagtcctctgtgtcgctggatatgtggggcacaagcataggaggtgcttgagtggactttctcttcccggtaatcctgtggtccagcctcatggcagcatataggtctttttaggttagctttgcaatatgggttgtggtcaatatccttgtggagatggattcccgagtcgtgccttgcagggccccccactcccctcgccacctaataaaggaatagttaacactcaaaaaaa

SEQ ID NO: 565870 - DNA, 423 bp, Homo sapiens
  misc_feature (104)..(104): n is a, c, g, or t
  misc_feature (151)..(152): n is a, c, g, or t
ggtcatcactacccacgcgtcatctccacacactgtcctctctcccctcccgaagtttacatttttaatatttgctttactgtttcagataacatgtcaaaacnatttccaaagagtgggagccgtggagggaggtgtccatcagcctgcnntgccgcaagccgctggctgaaccaggcaaggctgagactgtcttattttcaaagttctgataagtgttaggaagaaatcagcttggattgtgaaggtttcccttctccttgcctattttttcactgtaaatatttatatactactgaccagatgacggaggggactgggttttggttttttttgtaaaaatgtcttatccagtcacataattatgccttttttatgttgcataagtgaaaacttagagaattaaaaaccattatctttcaa

SEQ ID NO: 565871 - DNA, 705 bp, Homo sapiens
cttggtaccggtccggaagtttctagatcggcagtgcagcccgaagccccgcagtcccccgagcaccgcgtggccatgcgtccctgcgcccccgcgcctgcgctgctggcgctcctgtgcctcgctcctggccgcgcccccggtggccccggccgaggccccgcacctggtgcatgtggacgcggcccggcgctgtggcccctgctgggcgcttcttggaggagcacaggcttcttgccccccggcgtgacacaacatgccaggcttgaccagtacgtcctcaggcttgggaccagcgagctcaaacctctgcctaatgtcgggcgcctgtccctcacctgcgagcatcaagcaggggggtccactggacgggggcctgagctaccaacttcaccccacctgggacgggtacttggacccttctcagggagcaaccagctcctcccaggttgagctgtggggcatcctggccaccttcccacaaggacacggcccatgcgaaaccaccacgtttgcaccactgaacaacaacacacatctataaaacgtccaacccacaaagacgaccatcatggaaaatagcattagagacatagtcacaaataaacagaagaggattagaaacattatagggaacgagcagtgagagcataaaaaagaacatatgaaaaaaagaaaaaggcgaataaatagagaaaataataa

SEQ ID NO: 565872 - DNA, 138 bp, Homo sapiens
tggaactcctgcagtcggatttcacgtggatgttgattttttcccggtctaactcccgaagcttcggcgatggcctgcacgaaattagcatctgaaagccactggtaacccaggctccccgagactgcctcgccaaat

SEQ ID NO: 565873 - DNA, 420 bp, Homo sapiens
  misc_feature (79)..(79): n is a, c, g, or t
gtcaatgtcaagatactaggtgaagagtgtcataggtgtagaagcttgtcaaacggtggaggagcgagagaaaaacggnaatgaggaaggtgagagaaaggattgaccaagcctcccgtgcaggagatggtagatgagttacaaggccccttctcgtatgatttctcttactgggcgcggtctggagagaaaatcactgttacaccgtcatctaaagagctgctcttttatgccccttcaaatggaaagcccgttgtccagtggagaacagctgcccaggggaaggctgatcgagaatccactgggaaggcaggcctggtttttaggaaggcccagattccaacccggaggttggcaaggagttcgagatttgtcattcaggtgaacaagggagcgcacagatttgcgagtcggggtacc

SEQ ID NO: 565874 - DNA, 1026 bp, Homo sapiens
ggattcggactcggggcgggcctgcacgagggcatcgtgctccacagggaccagtcatccccaaaactgaggggatatcagcttaccgaggccgcaggtttgcctagtccctacctcatagatatgtaggacatccccgtggccctggaatgctggtctctgacaccatctctgtgccctcccccgaccccacgaaccaggcttgtgcgtggctggagtgctgccagctggatgtctcatgcaaggatcgtctctgtggctaagcactcacatttcctgatcctgacactgggttgctcatctagagaccctggtttatcgagtggcagtctccagggctgccgcatacagcagcgatggagcaacggcaccgggccctacggagaagaacgtccacgtgaagtccaggagacgacagtcaccgcgggggctgccacaatcgcctttcccagatgccaacagaggtcttattataacccggtgcaggaatccaatcagggacctgacatgtgctgtgatcaccgagtttgctcgcatacagactaggggccaaaggaatccagatcaaggaccaggagcagaacggcacacgccacacagtggacgggaacttgtcagagccacgaggcggcacacggtcgcactgacacgacgagtgaacacctggcctccgtgagacccaaacctcgccacaagcagagccgagcgaggacaactctgggacagacagagctgcactggtgctagtgacggactggagagcaccgagactacggtacacatcgaaatgccctaaacgtagctggaaccagaccatggtggatacaacaaagcactccaacgggaaagagacaacaccagcggcaagagcagaccaagcgaggacacagggaaaggcagacagagaggccggagaagtacaaaaacgaagaagaaaacaaacagagggacaaggaaccgaaagcaaaagacaagagaaaaagaaaaacgaaacagaaagagaaaagaaacaacaaagaaaaagac

SEQ ID NO: 565875 - DNA, 131 bp, Homo sapiens
gcactacgacctataagtaaataagggctatcgtagtaaactaggggtagaacatgtagcccatttcttgccacctacatgggctacacctgtgacctaacgtctatacgtagggtactatgcgctatact

SEQ ID NO: 565876 - DNA, 477 bp, Homo sapiens
tcagaggtcccctcacgcccatgtcacaaaccatgcaagtctaaagatcacaaacaattgtaaggaagaatacaaattataccaacaatagagaacacactttctttaggaaaagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgcccaacaggtacatgaaaggggctgaacatcactagtcatcagggaaatgcacagcagatatcacctcacacctgttagaatggctattgtcaaaaaaggcaaaagataccaagtgttggcaaagatatggtaatggactaaaactgataaataaaaatgtgatatataggctgggtgcggtggctcacgcccgtaatcccagcactttggga

SEQ ID NO: 565877 - DNA, 126 bp, Homo sapiens
aagcgtgctgacagtgaggccaggattgcgccaccgatccacatccgagatacttgcgctctgtgggtgctatgcatcttcatcttcattgtgctgggcgccaggtcggtgatctccttctgcatc

SEQ ID NO: 565878 - DNA, 404 bp, Homo sapiens
  misc_feature (132)..(132): n is a, c, g, or t
  misc_feature (171)..(171): n is a, c, g, or t
  misc_feature (194)..(194): n is a, c, g, or t
  misc_feature (197)..(197): n is a, c, g, or t
  misc_feature (206)..(206): n is a, c, g, or t
  misc_feature (260)..(260): n is a, c, g, or t
ccccccgggggtttaaaaaaatagccccttttccaattagaaatatcattcggggcactgaaaatatgtttaatattggcccccccccctggaccaaaatatatctaagatgggtagcatcaaccaaaaaancaagggatgtctatgcttaaggaaccccccctctgcatnaaaatgtgaggatgggaaaaccnagnccacttttnaaatgtccatgcataacacaatgaagtctaagtctcctcttcccttaactttanaacatttagtggctttttgggaagacatctctttggctactatcaaagctgcttcccagaatatgatttttccaagtcctggttcctgtgcagttcttaagaaagaaagagtgtgagaaagagaataagaagtccaactaagga

SEQ ID NO: 565879 - DNA, 265 bp, Homo sapiens
  misc_feature (4)..(4): n is a, c, g, or t
ccgnttcacccacccaggactttcctcgggcttatcttagctctgataagatccacccctcagggcccacaatctcaacagtgtcctaacctcggtaagagtctctagcaagaggtgcagcctgcaagatgatcttcgcattcctgcgctcacttccttgaagatgggcaccatggctttggagtttgagaccagcctggccgacagggtgaaaccccgtctctactaaaaatacaaaaaattagccggggtgggtggagagcgg

SEQ ID NO: 565880 - DNA, 152 bp, Homo sapiens
  misc_feature (60)..(63): n is a, c, g, or t
cggctggtaccctgtacacgtttcctgaaaactggagggccttcaaggctctcatcgctnnnnattccagcggggctcaggtccgcgttctctccgcaccacccacttccatttttggcaaaccaaccgcacccctgattttcttccgcaaa

SEQ ID NO: 565881 - DNA, 167 bp, Homo sapiens
  misc_feature (10)..(10): n is a, c, g, or t
  misc_feature (28)..(28): n is a, c, g, or t
  misc_feature (32)..(32): n is a, c, g, or t
cacgcgtaanaagcggcttgcaaacgangaanagagccggtggagtgtacttgtccctgacaggctgacctacctgagtctctgagcttttcagtccaaatctttgcaaggctcaaaatgccacagaacctctcctcttctccccactccccatggcagggaccgga

SEQ ID NO: 565882 - DNA, 384 bp, Homo sapiens
caccgtcatatgtaacgtatgctaggattatcatagttctctcttgtgtggaaaggaatctggcagggccccccgggcgggagtccaggggggaaaccccagctcacggcaaacctcggcccccggggtacaggccattctccggcctcagccccgggagaagcgggaacaacgggcccccgccaccaatcccggggccatttttaatatttttttaagaaagagacggggttccacgggtgtaacccagggagggtctcgattccctgccctcgtgacccggccgcctgggccccccaaggggcgggagataacaggcggtagacgccatgggcgccgggccttgggggatccttgggtcctcttgggtaacatataacgggg

SEQ ID NO: 565883 - DNA, 145 bp, Homo sapiens
  misc_feature (35)..(35): n is a, c, g, or t
gggggggccccccccggggggcccgggggggtttncccccccttttttttcccccgggccggggggggggggggggttttttgaaaaaaaaaccccccccccctttggggccccccccaaataaaccctttttttggggggggga

SEQ ID NO: 565884 - DNA, 407 bp, Homo sapiens
  misc_feature (407)..(407): n is a, c, g, or t
tgagatggaatctcgctctgttgcccaggctggagtgcagtggtgcgatctcggctcactgtaacctccgcctcctgagttcaagcaactctgctgcctcagactcctgagtagctgagattccaggcacccgccaccacacccagctaatttttgtatttttagtagagatggggtttcaccatgttggccaggctggtcttgaactcctgacctcaggtgatcctcccaaagcactgggattacaggcgtgacccaccgcacccagccggattctaatttcttcatgataaccagtttaatccctacagttgggagtaaagttctgcacttggaatatcatgactaatttgggccataagtgaattctattactaatcctaactatgtacgtttaaatgatcacn

SEQ ID NO: 565885 - DNA, 539 bp, Homo sapiens
  misc_feature (22)..(22): n is a, c, g, or t
  misc_feature (62)..(62): n is a, c, g, or t
  misc_feature (82)..(82): n is a, c, g, or t
  misc_feature (203)..(203): n is a, c, g, or t
  misc_feature (235)..(235): n is a, c, g, or t
  misc_feature (241)..(241): n is a, c, g, or t
  misc_feature (254)..(254): n is a, c, g, or t
  misc_feature (264)..(264): n is a, c, g, or t
  misc_feature (269)..(269): n is a, c, g, or t
  misc_feature (525)..(525): n is a, c, g, or t
tctacctccaaacactttaggnccataataactctgacctccacccatcacatctttatccnaaaaggaagtagagatgatnctcatctcccctctgtgtagaagaacagcctcatctcattctcttgtgttcattgttccaaaagggacatacacagaagatgttatagaagtttggggcaagatgtcagaacacgtgtcanagccctaatggatgagaaggtctggcaaaganccaggnaaaggaatctcanaggcaaacanacatnaaatgccctgaggtgtcagagagtgacctgcaggggcacaagaaaggagaaggggagtagaggtgggcaggctggcgacaggctgtgttgggcactgggtttattctgagggcctcaggaggattttcagcagacagtggcgtgatctggctgatttatgggagagcttggctttgcaagccttcaagtggtttctgtaattttccatttacagtgtggacttgggatagctttgtggggattatttttggttctntggccattttggtc

SEQ ID NO: 565886 - DNA, 914 bp, Homo sapiens
  misc_feature (683)..(683): n is a, c, g, or t
gaggaaattgaagctcacagaaagtgtgactcctcaaagagcacaccactgatagtaaaacagggagaagaaagactaattctatgcatttggaagatacacgccatctcatgttactgctatctctgacaggcaagaggatgcccagcctctcccttctgagatccaggtggattgctgattaggtaaaagttttagccctggaaaaactatttctatccacaagatagctttacaagattaaatagagacagtagatgtgccatgggactgaatgtatatgtacgcccggcaaataaatacccagctttctaatcgttgatggttcaggaggtggggctgtcaggaggtcattatggtcactactggttggagcccgagagaacttggagtcatgccgagccattaggagagtaagagaagccccagatatcatggttgaccttgaggccctcttcctagaccaaatgatgagggacctatgcagggtagacgtaaagcttggtcacgtatctgaaccaacctgtcaagatagagagtggctcgccttcctctaagggaacatgttgtaactctgcaatgggcgtacacttggaattggttgtggccaagtttgtccccctaggccccctcctaaaggtacatcctggctgctacaataacaactacagatccatactatngtatcgggaatcggtccaaagagctatagcttccatgcgtttatctatgggcgtgaacatgaccgctaagtgctgaagaatacgaaagtggtgaatgaaacgggaaaaatcgcgtgcgatcttattatatgcacacaattcccagttctctttgcaaaccgctctggtagtgaacgcgttcaaaaggcacaaattcttctaacttgcttttcccagatttaacccagaacg

SEQ ID NO: 565887 - DNA, 767 bp, Homo sapiens
  misc_feature (126)..(126): n is a, c, g, or t
  misc_feature (129)..(129): n is a, c, g, or t
gctgggggacatctgtgtcggaaatgtgctgcagcctggggccggggcaatcatggcccgaatcgcccagtttctgagtgacatcccggagactgtgcctttgtccactgtcaatagacagtgttngtnggggctacaggcagtggccagcatagcaggtggcatcagaaatgggtcttatgacattggcatggcctgtggggtggagtccatgtccctggctgacagagggaaccctggacaatattacttcgcgcttgcatgcgcagaaggcacgcaagcgccagagattgcctgattccctcatggggataacctcctgcacgaatgtggctgagcgcgtttggcatttcacggggagaacgcaggatacctttgccctggcttccccagcagacaggcagcccgagcccagagcaagggctagtttccaagctgagatcgcgcctggtgaccaccacggtcccatgatgacaagggcaccaagaggcagcatcacctgtgacccaggactgagggtatccgccccagacaccaccataggagggccttgtgccaaccacttgtcgcgctgcccttccaagtgacagactgggttctcaccaactgcttggatcccctcctcgccgaggttgcgtcgatgggggccggctgccatgcctcggctgccccgtgcgcgtctcgcgttcccgagtctgcgcctcttcaaccttgcgcgtccttggggtctctatgcaccggctcccggtccccacctcgcatcatgc

SEQ ID NO: 565888 - DNA, 261 bp, Homo sapiens
agaccctaatgtgctaattcaacaagcttatcaaacactcgtatctattaatcacccgctagttgagtattcggcaacagtagccaaggtcggcaacttgtcacttggtgccacagttttgattatgcacagtgaccgtgatttaagttataagacacgagtgtttgaagttaagtatgacttgttaaatcctgaaatgactgaattgtcattaggagacacttatcagcacagtatcacggcacagattatcattatcgg

SEQ ID NO: 565889 - DNA, 303 bp, Homo sapiens
acttatttgttcttcatagcagacctatgaggtaggaatcgttactggtacaactttatagtggaggaaaccaagagacagattaaatagcatgccccaaatcacttatctgctgtgggtagagacaggattgaatttcatgagattggctatagaacttgtgaggtaagccacctgtcaaatggactaaaccagaggttttaatactatcttagttttagtaacccctaggtcagaagaaatacagaacgtactcacttaatgtcatatataataagctactggccattgtgactttaaacg

SEQ ID NO: 565890 - DNA, 266 bp, Homo sapiens
  misc_feature (121)..(121): n is a, c, g, or t
  misc_feature (178)..(178): n is a, c, g, or t
  misc_feature (180)..(180): n is a, c, g, or t
  misc_feature (239)..(239): n is a, c, g, or t
tccatagagacgtggtctcactctgtcacccaggctgctcttgaactcctggccttaagtgatcctcctggctcagattcccaaagcactggccactataaggattgcctggccacagctntagatacttagtctctaaaactgcaaaagtaagccagtgagccctgaggcccggcgntntcaccatctccctgtccttcctgtgtgggggacagcagcccaccacagtatttcctttnttcttcagtcatagggatgtacagatt

SEQ ID NO: 565891 - DNA, 107 bp, Homo sapiens
gtcacatgaccatccccaacctctcctctaacccactagagatgctgtgtctgcctcttgcctcttgtagaatgcagctctggcctcaataaatgcttcctgcattc

SEQ ID NO: 565892 - DNA, 134 bp, Homo sapiens
gagcgtctcatttgagagtacataattgcatacaatctgcgctcactctgcaaatcttacgtaagctggcaccttcggcaccaggtggtgcaggcgcacttctaagtgggctctttttgttacagcacaaaatc

SEQ ID NO: 565893 - DNA, 909 bp, Homo sapiens
gggtgaagaatctctctgccttggtcgggtgataatcccgtccttttgggttctcaatgttacctgactaggtatgctgaaggtcttagaatcctagataaaggtcttgactcttctccaggtgattgggaaggtgtaagtgccctaaaagctgtacgtatcttgtgtatatcttcccttgagtattgttgcctggttccaaagtctattcaggctgttaaggaataatcctgttgggataatgcttatgtgtgctatgtaagtgtttattgttttgtgcacttagaagcttactcagaattaacgagtggctaagagcctctgagaccgaaattttgtgtcccagtctctacctccttcacaactgcttacagaatggactcagtgtcccccttatgttgaggtgaccacttaattagctttcctggccatccttgaaagaaatgaaagaaagtaagactgctgtattttgccactgatttagccaatgtgaaactcagtctcattagcccttttgctgggttatgaagactgctgtctacgagaagtggccatactcaagttgtgcttatgtatcagtcatgtgctggagaaatcttagaatagcttatgtacaaaactttttaaattctaatgattatatttgaaactttgctttgggtttgtggcaccctggccaccccatctgggctgtgacagcctcgtgcagtccgtagggctggcagtttgttgatctatttaagtttccttccatacccagtccccattttctggtaaggtttgctaggaggtctgttaaggtgtacatcctgcagcttattggcgttaaaactgtactctccttttatgtggtctctttggggccgacttgggagaaagagaaatcaactagtgcaagctgttttgata

SEQ ID NO: 565894 - DNA, 279 bp, Homo sapiens
atcgtgaaatcttaaaccttacgatactaaggacgtcgtttaggttgtacttaggaattcttagtcacaaaatatatcttgtttacacaaaaatttcatgtaacacaggttatcaacagtgttaaaagtctcagtttcttgcttggggaacttgtgtccctcacatgtgtttagattgctcagattgctaaggagctgatactttgacagtgtttttagcacctgtgttactaaaaaaaaagatgaatgtcctgaaaagggtgttgcagtgtgcttccg

SEQ ID NO: 565895 - DNA, 198 bp, Homo sapiens
aacccagctacctgcaatgagacattgggtcacaaacaaaatcaagatagacattatttgaactgaataacaatactgacacaacctatcaccacctctggagatacagacaaaggcagtgctaagaggaaagttcatagccctaaatgcctacatcaaaaagactgtaagagcacaaatagacattctatggtttgt

SEQ ID NO: 565896 - DNA, 132 bp, Homo sapiens
ccccgatgtcgcacgatggcgcgtcgggtacaggatctccagggtcccctggtttacagagtaggccaggacagcactgtggtgagtggccagcacccgtttgatgctggacttactctccaggtggccaaa

SEQ ID NO: 565897 - DNA, 136 bp, Homo sapiens
cctggaaaggagggaggcttcgacgtcgagagggagaccgctgccagtttagttccgagcttgagtcataggatttctctcaaacttctgtgctgaggagactcagatgttgggcctcagctcctaggctgactca

SEQ ID NO: 565898 - DNA, 432 bp, Homo sapiens
  misc_feature (193)..(193): n is a, c, g, or t
  misc_feature (214)..(214): n is a, c, g, or t
aggccggaaaatggtgcccgcaaaaaaacaaaaaattcgtggagtcgatcaactttaggccccacctcgttataaaaagtgggaagtacgtcctggggccacacacgcctctgaaaatgatcagccaaggcaaagggaaattggtcattttcgctcaccccggccccgctttggggaaatttgaaaaaggggnttatgctatgtgggctaaaangggggtccccccccccaggggcaaaaatattgaacggggccccgcatggggaaaaaactccagggggggcccccgggctttcattgatccggggggctttgccctctttagaggcaggcccgaccagacgggggaaaagtaacccttttcccccccaaaatttcccccgccccccttaaccccgcaaaattttcctttaataaaattggcttgtttta

SEQ ID NO: 565899 - DNA, 160 bp, Homo sapiens
  misc_feature (59)..(59): n is a, c, g, or t
tcagtatgacattcaattaggtttaaaatttaaatccctccgtgtgtggctgggaattngtctgtgtgtgtgtgtgtgtgtgcatgtgtgtgtgtgtgtgtgtgcaagtgaaacgcaatatacatacactcaattctccaacaattcctatgggatgact

SEQ ID NO: 565900 - DNA, 356 bp, Homo sapiens
agctgctccccacgacgttaggtgctcagaccttggttcacagtcggtggttctccacaccatgcactcctgtagggtgagggtgggagcaccccaggatgttggatggacttgagcctaaaggctgacagctgtaaggcccagaagtggcaaagccccctgagtattagtggcaggatgtttctggcaccgtctgtagaggagcccctagactgtcgttgcaggaagccaggctttgtgataatgaccgctactcctgactgagcactgacgtgtgccaggagctgatgggcactttctgtgtaatctcgtacctcattccttgcaggaggcctgggtgctaagttactgttact

SEQ ID NO: 565901 - DNA, 201 bp, Homo sapiens
  misc_feature (17)..(17): n is a, c, g, or t
  misc_feature (30)..(31): n is a, c, g, or t
  misc_feature (38)..(38): n is a, c, g, or t
  misc_feature (81)..(81): n is a, c, g, or t
  misc_feature (153)..(153): n is a, c, g, or t
  misc_feature (180)..(180): n is a, c, g, or t
  misc_feature (189)..(189): n is a, c, g, or t
ctgtttcttgctttaanagaagggtaaagnnaagagtnttggaccagtattgcagttctgtagtgtcatttcttataaaanacaaaacaacaacaataatttatcaaaattgggcatatttaaagcctaacattctaataaaggcacaaattntctttttaatacttgtctcagcctctntaatctctntataggtcacct

SEQ ID NO: 565902 - DNA, 490 bp, Homo sapiens
  misc_feature (17)..(17): n is a, c, g, or t
catgtgggcatcacggnggcgcgagggaaccgggtgggctttcggtgaggctttactttctgagcgcggggttctgatgccctcagttcatgtggaggtgtttggatttgggccgcagcctttaacgtggcaattccgcctaccacgtggatcccacaatggatacatcattcctacgggcccattggtttggtagtttcctaataaaccaaaggcaggggttggctgtggtcttattaaacagcctgggccagtgtctacgggtttttggtttttttttttcctgggtagtgggccagggcagagacctgggaaccttactcatccaggggagagatgtcgggagtccaggtttggacaatcagaaaccttaggtaaaaggcggatcactggggaagacctttgggggtggcttcacctcaaattggccaagagtagttaaatcgctagggggactcacggggtaccttttttcaggaggcccaacatg

SEQ ID NO: 565903 - DNA, 388 bp, Homo sapiens
catctcatcaaacctaacagattctaaagtctctggtgataatgacaatatctgctacggagagactagcctgggggaagaggatctccctgaacaaggatagcggagttgctgcagctttcaaatgaagctggacatttagctgcgggggtagcaccctttgatcaaggcagcccaaagatgagtttcagggatgggactgacagaagagaaaagttcttcccagccctttctactttttctctttgtttctcaggcttctggccgtcttcagttttcacagtttcactctcaaccctaaacagtacttctgtgaagtacactttggcccctcgttttcagctcctaaactcacctggaaatagatgtcaatctaattttggtctga

SEQ ID NO: 565904 - DNA, 269 bp, Homo sapiens
tctcaggatctcaagctttggtcaggctggtctcgaactcccaccctcggtgattgcctgccttggcctcacaaagtgttgggattacagacgtgagccactgtgtccagccgagagtaagtcttttttttttttgggaattgggattctcgttgtttgccccgggtggaattgcgggggcccattctgggtccagtgcacccccggcctcccaggttcaagcaattctcggtgctcagccctccagagtatgcttggacctatacggg

SEQ ID NO: 565905 - DNA, 1173 bp, Homo sapiens
  misc_feature (417)..(417): n is a, c, g, or t
  misc_feature (504)..(504): n is a, c, g, or t
caacgccagtttatccagtgaaccactatcacgaaaaaaactctatcctcttctattacgtaatctcccttacgtaagtctcctttaatttatatagcattctacgatggcacacaagtaactaactctatcttttatagtcattacttcagtataatcgcacacgttagtcccctactctttgtgcataatcatctagcctcgaaatgagggctagacctaggctccgatgacacgcactgaagaacagcatggcacaatactttaccttgacttctatcgagccactaagtaaggcttgcaccattcccacatactcactccgccgacttgagttgtacaaacatcgacgagattagacccgtagaggcgtcgactttatggacatttcctatcgtacgtcagcatctcgacttntgatccaagagaaactaatccatatctccgtgaagtccggaacagaacttaaattattgatctacatgtcttaatcgacacatgagncttcttcactagctatatatggattaccctcgttgtatccggagcttcgcattcttaatgagcatccgcttagaacgccccatgttcgatagacccctcgatcggctgcggttcgaactagtgactttgaccgacagtacgtcttagaaagtagaagcggtctcatggtggatcaatacgccctcatccactcagttgctcaagatctccctgaacataatagcaacgataaggctatccccattacctttggtagctagtccgctactgagtgccatacattataatacaagctccgattctaggcctaagcgagaaagatctagcacctataaagtcggctcgattcgcattactcctttcacatccaggcactgttagccctcggtaggtcaacgagccgattccgtcgattccaaagacccgcgctgaaagcttcgaccgagggcagttcagttctcattaattcgacccagaggacttaacattctcgattaggtaattctggcgtagcaaaactcgaaaggtacgaaaccgcaactcgacagttgcgcattcgtaattccttctcttccaaggacctttgcagacttctgcgtcccactaatagatttttggagtggcaattctagcaaagcttcggtaacatcgctcttaccccccaattat

SEQ ID NO: 565906 - DNA, 179 bp, Homo sapiens
cgtcgacgctaaagacaagttctggaactatggcgaccacttaagtatttttttaagcgcctgcaaaatgggggctgacgtgcataaaacaacgtccccctgtcaggccctagggagaacatagcaggaggatggagggagccaccatgtccctttgggtcgacgcggccgcgaattta

SEQ ID NO: 565907 - DNA, 101 bp, Homo sapiens
aacattgcgtatcaatgttatacatacacattcctggtccaactcaatgcggtaggaaccccagtggtgtccactctatgcttgggattggcctgtgatgg

SEQ ID NO: 565908 - DNA, 916 bp, Homo sapiens
  misc_feature (525)..(526): n is a, c, g, or t
  misc_feature (666)..(666): n is a, c, g, or t
  misc_feature (680)..(680): n is a, c, g, or t
  misc_feature (810)..(810): n is a, c, g, or t
  misc_feature (852)..(852): n is a, c, g, or t
  misc_feature (883)..(883): n is a, c, g, or t
taacttcattgctatatagtaaacagaggttccaaagaaatatagttaactcagtgtcaagggacttaagaggcttagaagaatgagcagacataaatgtgtaagccagaaaacagtgtgtaagcagggtgactgtcatctccatcccaagtgagcagagtctacggtggaaatgctagagggaacaaacaagaagagaaagctgatggtaataagaatagtggagaaattagcacattgtcaatctagcatgacatttactgcagaattacatcccaaaaaactataggaaatcagtttgcttatcacacaattcaaatacctcacaactgtaagaagatatacagtagaacacagcgatacatctcacacacacacacagacttttcactgctttcatggtttatttttatagaggtttctctgggggaaaagaagttacagaagcagcagcttcattctttccagcataatggagtttgggtggggacagggatcttcaggttaagcttttcaaaaaaaaannaaaaaatctaagttaattcatctcttcctgattttggaaaggttagtttcctaggataagaactgggaggcagtttagatatgttattaaaaaaaaaaaaaaaaattctagcaccctaaagctttcccagttcagaaaangttccaccggcctngctcacacttaccagcattaaagtgatgatacacctcatggccatgtgccatcagtagcctgaagatgtacagtactagtactgtggattgtattttcaatttttattgaaatctgtcctttgcccacantcgggtttcttttcacctggcccaatctctttcagttcctgngcttgaagcctgtgctatctgtatcaacatnaggcagatcattgaagggagactcactgtggaa

SEQ ID NO: 565909 - DNA, 177 bp, Homo sapiens
acgttttattacatatgacatgtctgtatcaaaacatttcacgtgtccaggctcggtggcccacgcctgtaatcccagcactttggtaggcaaggtgggtggatcactttgaggcgaggagttacagtcacgcggagatcacaccaatgcagtcaagcctggatgacatcgctaact

SEQ ID NO: 565910 - DNA, 156 bp, Homo sapiens
tcagtgcgcgcggtttttacagtcacttcaaacaactcctctaggggctgacccgacactagaagcagggtatgtgccacacaggcttggttggtggaggtgctcgcagcgctccagaataggggagacccagcagaggtgcaagagacagccgcg

SEQ ID NO: 565911 - DNA, 348 bp, Homo sapiens
ggagatccgctgcgagtactccaggtgtttacttgggtcgtgagcgccgctccctgttcgctatctctactgctcctcgttccctgtgtgagctttgttcttgcaaagatggggctcagcagtggtgcggtctgagtgtgctgccggcggcttatgtgatacacccgtagggtggtcgcgtatgagtcccagggctagtttcatctttccaccatgacagacatgccctatgtgaggctggcctccttggcgcctgtccccacggcccccgcagcgtgagccacgatgctccccataccccacccattcccgatacaccttacttactgtgtgttggcccttatcgag

SEQ ID NO: 565912 - DNA, 917 bp, Homo sapiens
ttccccctacgccagatcctggaactgatgctgcctaccaacttgtgatgaaaggtcctggctggagcctgaagcgcggagctggaggccatcctgtgaggactatcctgcgatgagcgggacaccagaccctgacaagggtgagctggatcagtgacgaggatgtgatggagtaccatgagtgtggctcggtgatgctgactctatcccttccttcacaaccaaagtgtgcccaaatgggtgaaagtgacacttaaaagacccagaatgtaacgtgtgtgtcactcttggggatcatgcatggggcagatgtcaccaagccaggctgacccatatccatcaattttcacacaacttgtgtcgtgatggtggcagatgggcgatgaggaagggtactaagtcattgatttaaccaagagcatatatactgatgcacatagacatatatgggattaacaactgttaatcatcgaagatcacgacattaacctatgccattgtgatttggatggagatacatcagtgcctaacccaggttggaatactagtgaaatggaggaccttggaaagcacagggcacgtcacgaatcgaagcgcgatggacaggagttgggatcattgaagagcccatcttgtagaaccctatgcgcttctgccgttgtggcaatactcacacccataattcatcgtcagacccgttgtacaataagattggaggccaagaggatgttgatgtgaatcatgaacatcgggagtgctaatacagggaatgccagactgtgcaataactgcccactgtgggccaaacgggttagtgcctcaggcatcagtgtggatatgaacgcggatgcaattcgaagacaggcacatccgtgtcccaatagggcacggtagaaagctggaacctcaacaagtgg

SEQ ID NO: 565913 - DNA, 430 bp, Homo sapiens
gcggtccgcaaacttcgtccactcagactgattttaagaagtgtgtggaggtcggcgtgtgtgcacacgccgagcaccatacacttcttgaagtcaggtctctatggacgaagtgcacacgccgagtatccacacctacgccaaaatccatttcactatcatattcatcggcgtaaatctaactttcttcccacaacactttctcggcgaggtcgtaatggacgaagcaacaacttcgtccaccgggaccttacttcatgtgtgatggatcctcgtggtgttgcagtctggggtctcggcagtagtgcaacaggttctggccacaagagagctgcaacaacttcgtccatgatgatctcaagaagtgtctgggccctcggcgtgtgcaacacgccgagcatccatacgccgcaggtctgggtggacgaag

SEQ ID NO: 565914 - DNA, 282 bp, Homo sapiens
cagaggagcttggtcagtgtctcagagagagatcgctcaagaaaaataaaagagtatcactgttactgttgggattaaatctctgatgtggtaatatttaacttgctatggttctgttaactctattgaggagatgagtgtacttcagaaggatgatgaaacagatttggattccattgtgacgttttcaggaaattccattttttgttatttgctttaaagtatttgtatgaaagttcatattcttctgtgtgcagtgacttaacgcttgtaatcccagca

SEQ ID NO: 565915 - DNA, 425 bp, Homo sapiens
cacacacacacccgggcacacacacggacacacaaagacacagacacagatagctcaaagggagacctcccctcatattgtcttatgcccaatttctgcctccaaagaaagaagaagtaaaatctaaaaggcagagatgaaatccacaggcagacagccccgcgccacaccctgggcctggtagttaaagatcgatccctgacctactcggttatgttatctatagattacagacattgtatagaaaagcactgtgaaaatccctgtcctgttttgttctgatctaattacctgtgcatgcagcccccagtcacgtaccctctgcttcctcaatccatcaagaccctctcacgcggacccccttagagttgtaagcccttaagagggacaggaattgctcactcggagagcttggtttttggaga

SEQ ID NO: 565916 - DNA, 391 bp, Homo sapiens
  misc_feature (387)..(387): n is a, c, g, or t
atttattagctagtaattttataaatgccaaccattagattaatcagtgattatcaaattcctatttatatattatagagacttaaataatgtgtagaatttacttttacaaagctaattatggtagcatctgtttgtcctacataataaaaaaaaaagctattatacataaacctaaaattaatataatctgatttaaacaatatataattaatataatctgatttaagtctgatttaagaatctgatttaaatattacccttgtttcttatatatttagcagtgtttgtggttaaactatgattcaaccatttgcctaagggtagtttattaaaattgtccattcacaggtggtgttttttagggactataggttgcttgctccngggg

SEQ ID NO: 565917 - DNA, 124 bp, Homo sapiens
tctcatcacggatcccgcacgatccttgcatagtacatgccttaatgtgtttttttgaatctgacatcttaagctaaggaatttgaattttctattgttcggctattgcaatatcccattgata

SEQ ID NO: 565918 - DNA, 230 bp, Homo sapiens
aagctaagttccctgcactttggagtgttacagtactatctagtggttgtctttttcgacgctgactatctaaccccagaccgtcttaagatagtaggacgagtcctcatgttacaagcacatcggagttccatgaagttccctggtctcgaggagcacctgatagtctacatactaatatcgaacctgacaccagacggccgacgtattagtgatcacttaagcgccgg

SEQ ID NO: 565919 - DNA, 356 bp, Homo sapiens
ggaaaagtggaaagcattacctgtgagaactagaacaagacaaggatgcctgttctcaccactcctcttcaacatagtactggaagtcctagccagaacattcagacaagggaaagaaagaaagggcatccaaactggtaaagaggaagtcaaactgtcactgtttgctgacaatatgatcgtttaccttgaaaaccctaaagcctcctccagaaagctcctagaactgataaaagaattcagcaaagtttctggatacaagattaatgtacacaaatcagaagctcttctatacaccaacagtgaccaagcagagaatcaaataaaaaactcaaccccttttccaccagctgcaa

SEQ ID NO: 565920 - DNA, 1529 bp, Homo sapiens
acccctaaaagccaaaatgggaaagtgaaaagactcatatcagacattgtcgctcatcggacacgctagactcgcggcaagtccaccactacatggccatctggacgtctactacaagtgcgcgggctatcgacacaacagaaccagtggataaacattcgagaatgagagcgctgctgcagactggcgaacacgggctgccttcacagctactgccctgggctccttgggcctaacacctgagacacgcctgatgcagtgaaccgcctggcgtagtcacgcaacatccgactactcatcgctatgcatgcaacacacgtccccgagcaccccgagcacacgcgtaccctacctggatgaccctacgtcagtcgcacctgcctcccaaggcacccagcaccgcacggacgaactcccaatcaagacaccacacccactcgcaacccccacgagcggccacgacatcctccagcgccctcgccccctgccgccccgcaccccctgcacgtccgcctccgcccccggcccgagccagccccggcgccgagagcacccgcacaacgcccgcgcccactcctcccccaaacgccaccactcgcgcgacctcggtcactccccgccacacacgacctctgaccccccactctcccctcgccgcccgtctgacccaccccaccctcgcacgcctgcctgaccacacccccacccaccctcaacactcccggcccccgacgctctgcctcccaccccgaacacacacccgccgccactcacccccaacctcggaacaccgcgaccccccacgtatcccggcccccactggcacacacaccgcacctacactcgcaccggcaccacacctcccgccgcaacatcgcgcaccaccggccaagagccacacagctcaaccaccctaccaccccgacccacccacaccacgcgccgccaccccaacaccacccccgccaccgccaccccacacgacggcaccctcccaccctgcaccccacaccgcccccccgacccccgcccccaacatcgcgcacgcacccaccccacctggccccggcgcacccccccacacaccccgcccaccccacactcgcccccgccagcgactccccacacacacgcacacgcaacccaggccgccacccccccgcccacacccaaccacgccaccacccccccccgcccgcgcccacccccacgcccccgccaccgacccgcaaccccctccgcccaccgccccccacccccccaccccccaccccaccaccctcgcccccgcccaacacgagccccccacccaccacaccccacccccaccgcccccaccacacgcacacggacgccccccaaccacacacacacccgagccaccccaactcccgccgcaccccagccaccaccccgcaccacccccacacccacgaccccccaccccccccccccaccctcccacagccccccccccacccacacccccacacaacaccccccgacgccaccccagcccacaccccccg

SEQ ID NO: 565921 - DNA, 477 bp, Homo sapiens
tctacagctgctctcactatgttttatacatttgcaaaagatactcagacttggtgtgttctacaagcttgctatatatagcttcaccatgaatagcaattacagtgggtgcatgtacaatcaacaaatgccaatgttgactggtttctatcaaactgacctctgctatcctctcacattcccttagcagacaggctaaccacacacaggcaaggaggtcactgtgcctctaatggagcatcctgcctagaaattgaggcacatgaaatccttcacttcagaatttaaacactcactcagttccatggactcgccaggcctatgaagaagatcacagagagatgatgtgtgtaccagaagacttcaaattaagacctccggatggttttggtggaggaagtgataattaatatgaggcacagcgtgatgacgactccagtgatgcctgccaacaaggtcacatagctagcaagccac

SEQ ID NO: 565922 - DNA, 342 bp, Homo sapiens
tggctggaggttgggggcaggatttgggccgagctttcctcagacctccccagacctgtttttttatcaacccccgctgttttttttttccgaacaaggggtgcatttttgggacacagtggaccccctcccaagccctcccttaaccgttttcctgagtcccttagggcaaacacagctccaggggcccagggcgggtgccccacccccgacactcctgctgtcccctggccttaggtcctgcaggtttcccaggggccgcccctgttcccttccctgacctcccctttctggggtttgtggctggctggagataaaaataaaagccattgtggcccctta

SEQ ID NO: 565923 - DNA, 105 bp, Homo sapiens
actctagcaggatccccgcttcttagctgaatacctctcctacgactccagtgacccatgcccggtgcagttcacgtgccgcacggggcgttgtatccggaagga

SEQ ID NO: 565924 - DNA, 170 bp, Homo sapiens
atctcaggatcttagtcgctcggacgactataggtgaagttttcggcgagtaaaggccatagcgagaaggaggttgccgatcgccatcaggtctcaacgaggaactcagagtggacgaggaaacacaggaagtcctggagaacctgtaaggaccgctggtccgagcggac

SEQ ID NO: 565925 - DNA, 481 bp, Homo sapiens
  misc_feature (13)..(13): n is a, c, g, or t
  misc_feature (33)..(33): n is a, c, g, or t
  misc_feature (38)..(38): n is a, c, g, or t
  misc_feature (88)..(88): n is a, c, g, or t
  misc_feature (115)..(115): n is a, c, g, or t
  misc_feature (120)..(120): n is a, c, g, or t
  misc_feature (122)..(122): n is a, c, g, or t
  misc_feature (136)..(136): n is a, c, g, or t
  misc_feature (143)..(143): n is a, c, g, or t
  misc_feature (146)..(148): n is a, c, g, or t
  misc_feature (161)..(161): n is a, c, g, or t
  misc_feature (169)..(169): n is a, c, g, or t
  misc_feature (181)..(181): n is a, c, g, or t
  misc_feature (201)..(201): n is a, c, g, or t
  misc_feature (227)..(227): n is a, c, g, or t
  misc_feature (247)..(247): n is a, c, g, or t
  misc_feature (260)..(260): n is a, c, g, or t
  misc_feature (265)..(265): n is a, c, g, or t
  misc_feature (269)..(269): n is a, c, g, or t
  misc_feature (302)..(302): n is a, c, g, or t
  misc_feature (304)..(304): n is a, c, g, or t
  misc_feature (332)..(332): n is a, c, g, or t
  misc_feature (364)..(364): n is a, c, g, or t
  misc_feature (377)..(377): n is a, c, g, or t
  misc_feature (380)..(380): n is a, c, g, or t
  misc_feature (398)..(398): n is a, c, g, or t
  misc_feature (478)..(478): n is a, c, g, or t
tcacaaggaaaancattttattactgtaatcanaaaancgtaatttctgtacaggaatgtataagtgaacattattcaaagcattggnaattcacttcaaaaagaggggaaacanactananaacaaattgtaaanaaaaaanatnnnaaaattttctggncttgcagngcactatttagngcaagtatttaagacacaanagtgttcaattcagcaaagtattgcngaatgtcatgccacagtccncttaattcaaagnggggnaggncaggcagcttgtaataaaatgtcagagtgtgtntntttttttttttttttttttttttttttntaaaaccacaagtaattcaaaaaaaaaaaagnggtttatttaganggntttaaatgatttcactgnggaatccagcaaaacgggaacaacacccaagggcttcttaacggcaacaatcttattgccaggcaagggcttgggcttcnggg

SEQ ID NO: 565926 - DNA, 86 bp, Homo sapiens
ccttacttcccagtactccctgtatgggtatctctgtcagagtagtctccatgaccttatttcccgtagacgcggccgcgaattta

SEQ ID NO: 565927 - DNA, 302 bp, Homo sapiens
agctgttctagaggatcccatcaaaacgtatcagaacatggtatgttcaagccacttgtgcccacaaggaactggtctgtatgaaggacttgacttggctgtcacatgagactttcaaaacgtataaatgaaatatggatatctaaccaagtgacatgtttgataaaattggtctaggcttgtaacaacaaaattagtttgtatcttggttatcaaacagtatctgggactggttagagcagaatattaaccttcatataaagtatgccaataattgtataccgagtatactgttgctatat

SEQ ID NO: 565928 - DNA, 330 bp, Homo sapiens
ttttttaacctttgggaactagggtatgggctctcccttgtccgccacctgggatatatatttaattttcttaaattccccgtaaactccattttatggttttgatttccgattgccaacctgttaaacctgcatagccgcgagtcctcggttttgccgggttctttagttctttaccgtccccgtcctgtaatccgctaattctctgtggatggtgctgtaaagtatgcctgttcccttcctgtggatttaatcctgatgttttattttgcccccctatttgtaatgtttctttttaataaaagtggctaattttgttgtagtctggga

SEQ ID NO: 565929 - DNA, 363 bp, Homo sapiens
  misc_feature (244)..(244): n is a, c, g, or t
  misc_feature (277)..(277): n is a, c, g, or t
  misc_feature (325)..(325): n is a, c, g, or t
ccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcancataaaatttggaggggtcgaatatccaaaccntagcaacttggaaccaccagaagctggaagaggcaaggaaagattttntcctagaggcttcagaataaggtattgcaattctgaaa

SEQ ID NO: 565930 - DNA, 151 bp, Homo sapiens
  misc_feature (2)..(2): n is a, c, g, or t
  misc_feature (13)..(13): n is a, c, g, or t
  misc_feature (18)..(18): n is a, c, g, or t
  misc_feature (22)..(22): n is a, c, g, or t
  misc_feature (36)..(36): n is a, c, g, or t
  misc_feature (96)..(96): n is a, c, g, or t
angggggggggcnaaatnattnggccaatttagttnggcagtgggcctgttaccggttgggattggtggggtgggtttaggtaattgtttagtttntgattgcagataaactcatgccagagaacttaaagtcttagaatggaaaaaaaaa

SEQ ID NO: 565931 - DNA, 140 bp, Homo sapiens
cggtcctgaacagcctgtccagtctgcacgcgttgcgggagtcctggggccctcctccttcagcgcattgctactctggtctctggcattgctggtggagccatccctggggcaggcaccagggtctgtgccaggcccag

SEQ ID NO: 565932 - DNA, 841 bp, Homo sapiens
ggaccagcctgggcaacatagcaagacctcatttctacaaacaaaaaaaaaattggcccggcatggtggtacttgcctataatcccaccttagcctcccaaagtgctgggattataggtgtgaggccacagtgcctggcctaattattttcttgtgatcaaattgcaggttaaactgttctctgggttacagaagtttcctacgtgaatgttcgtgtacttattttgtgtcattgtagacgttcagtaacattaattaggggtggtacttcctctaaactagagatagtttaaacctagagtataaccttcaaaagcgtctagattgtgacgtagctaccggtgatgaggattgaaattgatctgatactagagtaatgaacaagaaagcctgccttttgtgcgccagaaccttttgctctcccccagtcagtacttggagcagcactagttcaggggcccagagttcggccgtatctgtgtggggatcttacgctctggctaaacaaggagcctacatcttttagctcctattccacccttctcgacacgtcttggtgttgtgaggtagtatgaaatgagagacagagtctcactctgttggcccatgtgctggtagtgcagttggcacaatctcggttcattgcagcctccgcctcccgcgtcaaggggatgctcttggcctaagctcccaagtaactgatattacggggcccgaggaacaaacccgggtgatttgtgattcgagcaccagacggggttttccccgtgggccgggctggtttaaacctttggcctcagtgacccccggctggtctccaaggggggggattcccccgtgc

SEQ ID NO: 565933 - DNA, 210 bp, Homo sapiens
accaggacatatcctagctatgcctttgtcctcttgtcctgtttgcatttcacgtgggagcttgcactatgcagctccagtttcctacagtgatcaggttcctgcaagcagtggggacagtggagcgaggtattggaggattccctcccagctttggaagcctcatccgcgtgtgtgtttgtgtgtgtctgtgtatcaaattgaacggtc

SEQ ID NO: 565934 - DNA, 935 bp, Homo sapiens
  misc_feature (16)..(16): n is a, c, g, or t
  misc_feature (18)..(22): n is a, c, g, or t
  misc_feature (714)..(714): n is a, c, g, or t
  misc_feature (732)..(732): n is a, c, g, or t
  misc_feature (761)..(761): n is a, c, g, or t
agcggctgtggtgctngnnnnnagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcgggctctacggtctcatcgtcgccctcatcctctccacaaagtagaccctctccgagcccaccagccacagaatattatgtaaagaccacccctcctcattccaggaacgaacagcctgactacatacgcacggggncgcgccccagtagtggcntgtacatgcgcagtgtctagtgccatcgnctgaaccacggccagggagacaaaaaaagagcaaaagagaacgcgaccacacacagacaggagagagcatcaagcagcaatagcccaaagacacgcgacaggaaccgaccccaaacagacacgaccaaccgccggagcacccgagacagccgaagaagacagaacgacaacaac

SEQ ID NO: 565935 - DNA, 1823 bp, Homo sapiens
ttttgtttttgttgttgcttttgttttgtctttttgtttgtgttctttttgttgttcttgctgtgtctttgtgtttcttgtgttgtttagtctgtgttttttgttttctgttgtttgtgttcttttgttttgttgtctttttctttttttctgtctttgtgctgtcttgtttttcttctctctctttgtcttgttgtgtgttttttgttgttttctgctgttgtgttttgccttcttgtttgtctgtggtgcttgtttggttatatgtgttgttttgtgttttgtggtgtgttggtttttgtgtttttattatttatttttgttattttggttttagtttagttgttgtgttttttgtaattgtttgtgttcttgggttgtttgattgtgtggtttgtgatgttttttgtgtttttgtttttattttgagtgtttattattgtatgttgatttcatgtctgtttctgatgattttattcttcgttattgttattgtgttgttgttattcttgttctgctggtatgttgtcgtagtgtatggtgtctcgtctgtagtctttcagttgttttgtgttcttacttgttcgctgatgtatagcagtatgatgagaagcgacgcagcagcgagacgcgggacgcagggaggaaaagaagatgacacgaagataggttagttgcatggactgtcgatcatcatcttttggtatggtgggctggtatttcgccgcgcttttctgtctcctctcgggggattgataggatcggcgtgatatgtgatgcgcaaattttcttgggagcaaagatagccctgcgcgggtttttcgtatattatagggaatgtgcaaccaaacaagggctggccccgtcccacaggaccactagtgtggtcacatgctcgtatgtagaccatttataccgggaacctatttacactttggggaaaacacactgtgtcgggctatcaatatcccaaagggttggacacacacaataaacccataatgaccagctttccaccatgtggaggtcttgtatggttgggttaccccacctggctggtggaaacgggttttcgttgtggttccttactctttgagtcccggtgctccagggtcctagccccactgtgcagcaccctgggcacctgtggagtggagcccctcctacttgtttttatgcgcctagccctctataccgtatttccctccttccccatctccttaagggacctgagcccccaaatggtcgtcctcccctgcccgaattttggctatcacttctcttggccctcttcccaatctcctgcttacctcctcttaatttttataagatgcccaaaccaatctccccttcctctttttccaaagccaccagattaatagtggccactgagcccttaccccagccacactccagtgcaagaggggccctgaccttgctcttttatatttggtctcccgatccctggggtgcgggccagaaataattttcttgggcctggggttagagcagagaaggtctgcttgcacgccactctacgtcgctgctgtatccctatggaatattgtgggaacactggaacctcggtgtcccactgcccccgatgagtaaacacctgagctgcccaaacatttttttaaatacacccgaggagccccaagggggaaagggccaatgcctaaccccccgcgttatttttggggaatgagggctgtgcatagggaccatattctcttagaatctattttattaactgacccggttcttgggaccctgttaccccaataaaagatgcttttcatgaaacaaaaaaaaaaaataac

SEQ ID NO: 565936 - DNA, 190 bp, Homo sapiens
  misc_feature (16)..(16): n is a, c, g, or t
  misc_feature (18)..(22): n is a, c, g, or t
agcggctgtggtgctngnnnnnagagcgcagcggctgacgggccggatcgccttcgccgccgcccgcccgcaaaccttcgtgcccggcccgtcctcgcccccgcctccgcacgctgccaactgcccctccccaccgcaaatgtcgagtcccgctcacgcctccgcccccccgctcctccccgccccgccc

SEQ ID NO: 565937 - DNA, 517 bp, Homo sapiens
  misc_feature (517)..(517): n is a, c, g, or t
gaacaaagctggaggcatcacactacctgacttcaaactatactacaaggctacagcaaccaaaacagcatggtactggtaccaaaacagagatatagatcaatggaacagatcagagccctcagaaataatgccgcatatctacaactatctgatctttgacaaacctgagaaaaacaagcaatggggaaaggattccctatttaacaaatggtgctgggaaaactggctagccatatgtagaaagctgaaactggatcccttccttacaccttattcaaaaatcaatttaagatggattaaggatttaaacgttagacctaaaaccataaaaaccctagaagaaaacctaggctttaccattcaggacataggcgtgggcaaggactttatgtccaacacacccaaagcaggggcaacaaaagccaaattgggcaatggggatctattaaactaaaggagttttggccagcaaaaaaactccctccgggggacgggcccccccaccgtgggagan

SEQ ID NO: 565938 - DNA, 354 bp, Homo sapiens
tacttcgatcgcggagaacttatcaagctgctccctataagaagcaacttccttccatccactcgagttatctaaaaggagaggaaaaaatagttatagatattttggttaatagaactagaatcaatcattaatgcaaagttcaatgtttggccactaacatagtgtttctctaaataactttatttaattttaggattgtcactttaatctgcattctaataattaattgttttttaaaatctaacacattttcttagctttagctttcatgcaccatagtaacatccctttcaatagagtctattctattcaagctattctcctgtcctcaggctcccaagtagctgggac

SEQ ID NO: 565939 - DNA, 675 bp, Homo sapiens
caaaaggaagctacccaaactcccacagccgacaacacgacccctataacccaaccacaaacccccagccgccccgaccacccataccacccaacaccgaccgcatccaacacctccccccccacccccaccactacacccacaacccccccccccccccacacccccccccaccgccacactcccccaccacccaacccccccccccccaacccccccacacccccaacccccacccccacccacccaccccccccccccaacccaccccccccccccccccaccccccccaccccccccccccaacacccccccccatacccaccccccaccccccccacacccccccccaccccccccccacacccaccaccaccccccccccccccccccacccccccccaaccccctcccacaccaccccccaccaccctacaccccccccccacccccaccccccacacccccccccccccccccacccaacccccccaaccccacaatccccccccccaccccctaccaaaccaccacacaaccccccacctcccactccatcctccccaccactcctcacaccctacccccaccccaccaccacacaaccccccgcacaccacccccgcccccccctccccccccccccccccccccacaccacctccccccccccc

SEQ ID NO: 565940 - DNA, 113 bp, Homo sapiens
gcgttagaggatccccccttgaagtcctgacaggtgaaatgtagtttacagcagctctctcatcagcagttctctcacactagctcttttatactggttcgcctttatcttgg

SEQ ID NO: 565941 - DNA, 781 bp, Homo sapiens
  misc_feature (244)..(244): n is a, c, g, or t
  misc_feature (247)..(247): n is a, c, g, or t
  misc_feature (256)..(256): n is a, c, g, or t
  misc_feature (265)..(266): n is a, c, g, or t
  misc_feature (271)..(271): n is a, c, g, or t
  misc_feature (277)..(277): n is a, c, g, or t
  misc_feature (285)..(285): n is a, c, g, or t
  misc_feature (300)..(300): n is a, c, g, or t
agcgggtcacctggggtagggactgttgaagacaggtctccatcactacatgtctccatctatgcctaggcatttgtccaaccttggccatctgtccagaacctgctcccacctcaggcccaggccaaccgtgcactgctgcaatgggctctgagctggagacggcgatggagaccctcatcaacgtgttccacgcccactcgggcaatgagggggacagagtatccaagctgagcaatgaagngangctgataanagctgctgnnagacnggagcntctctggnttccctggatgtganaaggagcgttaatgcatgatacggcaaacaagagagcccgtcgaagagcttcttagaggtaggcactagcaatgaggtccacataatgttcaactgcatgcttccttcgtacgctcagtcatttgctgctcctgggctcctcagaccatcgccccttggcctctggagctctagtgcgtgtacccgttcccgtatacgacctcccttcttgcctgctctctcccagcctacagggcccagtagagcgcatgtggactgtctgctggatcaagggtcgagtgacatcggagcctagcacgagaattggatgaacggcggatggctggatcttcccacggaggtatgctggtcgctgtgtggcatgcatctctacagctggccatggtagccacatttcttactggggagtaacaagtctgagcagtactagaccacattggggcgagtcgcaccttccatctaccagctctcccaagaactg

SEQ ID NO: 565942 - DNA, 375 bp, Homo sapiens
  misc_feature (359)..(359): n is a, c, g, or t
caagatcagtgccatctgcactccagccatgggcaacagagcgagacgttgtgtccccaccacgccgacccaaaaaaaaaaaaaaaagaagcatctttcatgcagctgtgcagcgcctagtgagagttgcccaccctggaatgagcacatcaccttcccgcccagagaggtcagacccctggcttcctaccccaccaagggcacactcagaaacttctctccgtgcctgagcaagtgcaggccagactccctgctctgttctccttaaatgaccaccccctcccacttcctggggatttcccttgcagccagagggaaagggagcccaaggaggggacgggggattattcattgggggncacgatggttgatttt

SEQ ID NO: 565943 - DNA, 717 bp, Homo sapiens
  misc_feature (478)..(478): n is a, c, g, or t
  misc_feature (485)..(485): n is a, c, g, or t
  misc_feature (552)..(552): n is a, c, g, or t
  misc_feature (582)..(582): n is a, c, g, or t
  misc_feature (639)..(639): n is a, c, g, or t
  misc_feature (680)..(680): n is a, c, g, or t
  misc_feature (686)..(687): n is a, c, g, or t
  misc_feature (691)..(691): n is a, c, g, or t
  misc_feature (694)..(695): n is a, c, g, or t
ccgggctgcagggcctgggccacatgactggacttttttttttcctctctcatctcctgcatccaacctgggcctgttcctgtgactctccgggtagctctcaattctgtttactttttctctttgactacttctacttaaagccaccaacatttctccactaatcactgtagccacctcctgtcagctacatcttctcttgcttctttcctgttcattccatgctagccagggaaatcttgtaaataggcaggtttgatcatggcatccttgtttaggagcctttaaggacatggctttggtgtgacgagaatatctcaaagtaatcatgtgctccaacttccctctccagccttgtttcccactcatcctcacggttgccaattcttatgcctactccttcctggtctcccacctccttgcccacctgacttctgctgatactttgcaattaagatggggcagatttcctactctncctttgntcccgcttctttggcatagcaccaggacccactggaggacatatcctgctagactggaatattcagntaaccctgtctcaattcccccgctagacangtaagctccttgaagcaggagccatgccatgctttcgcttgtgcctacttcagcttnaggatggttaaggacatattcctatgaatagtgcgacctanagggtnnaggnccnntgatgatgaagaggtgcctgcc

SEQ ID NO: 565944 - DNA, 429 bp, Homo sapiens
  misc_feature (267)..(267): n is a, c, g, or t
  misc_feature (342)..(342): n is a, c, g, or t
  misc_feature (355)..(355): n is a, c, g, or t
  misc_feature (364)..(365): n is a, c, g, or t
  misc_feature (367)..(367): n is a, c, g, or t
gctagtaaattaccttttacgtgttaacatggtaaggccacagtgggctgaattgtttgcagatagacgacaataagaagccagaaattgtggggaaatggaatgtatactgtggtaaagatgggggagatggaggctacaagaaagaagagatcagcatagaagactgagttttgtgaagaagagagaggtgaatcaaatcatgagtcaaacaacaacatgagaggatggtatggcaggcttcagttctccaaagaggttataagnagaggaactcaaagaaatgaaaatggaatggcaaactaataaaaactagcattacgtagcatataccaggtgcgngcactgttctaantgctttatnnangttaattaatgtaaacaatgaccctgttaggtcagaatgatttcacttctctatcatacaga

SEQ ID NO: 565945 - DNA, 203 bp, Homo sapiens
gaactatctaagatggtagcccttagaagctaggaataattgacccttatagcactatttttcagaatacaaaaaggtacacactcatttctgctctctgaaatttcatgtgatttcaaactgtttcctattatcttgggtattaactttgcacttataggcaaaattgtattggcagattcagccttgagagtggtcctagg

SEQ ID NO: 565946 - DNA, 1254 bp, Homo sapiens
aaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcatta

SEQ ID NO: 565947 - DNA, 1263 bp, Homo sapiens
tccaccattacttacatctataacggaactaatttgaagaaccgacaaacctcattactctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcatta

SEQ ID NO: 565948 - DNA, 1601 bp, Homo sapiens
aaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaactgggggcctaggggcacatgacacagggaagcctgtagactggttaccaaacatgcatataccttattccctgtctaaagtctgcggtataccattgaactg

SEQ ID NO: 565949 - DNA, 1096 bp, Homo sapiens
gcgctggagagagctgagatatgccttactagatgtagagcactcactgatgactatctgaatagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcatta

SEQ ID NO: 565950 - DNA, 128 bp, Homo sapiens
gcctgatctcctttccatcccaagcgatctcccagctcagactactcgggcgctgacgtaggaaaattacttgaaaccgggaggcaagaggttgcagtgagacgagtattgccaccactgcgactacc

SEQ ID NO: 565951 - DNA, 841 bp, Homo sapiens
gctcgcgatctagaactagtccccacgcgtccgcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcatta

SEQ ID NO: 565952 - DNA, 957 bp, Homo sapiens
  misc_feature (719)..(719): n is a, c, g, or t
cgcagtggctcacgcctgtaatcccagcactttggggaggccaagggaggcggattcacgaggtcaggagatcagatgaccatcctggtccaacagtggtgaaatcccctgatctcctactataaaatactaataaatttagtaccggtggagctggggagttgtcagtgtccctgtgatttccgcagactaaactctgtgggagggggatgatatgccatgtgaggaaatttttgcgtccaatgaacctcgtggtagagggagatgtgtttgatgagttgaaggacttgagggagtcgtgggcccaccgtgtggaactccgcgatgtctctatgggttgagctagaacgtggggggatctgccaatcgttcagacatattaatttacaatgagaagataaaataaaattgttaattatacaatatgaagggggtcgagaaagaaagatggatcttagcaaggaagtctgcctgaaaataaattacgcgatggtgagcgaacagggcgagagtggcgtaaaaaaagggatttaagaaatggaaagcggtggaacttgtatagagcactgcgctaaagagggttccacggtgaggagggaacgagtttgtaaggggtgagtgggaagtgatttatactccaggatatggggaagtaattcctctctgtggagagaaggcaagaatttaaagtatccgcaaaggatgaaatttcaacacgngagcgcgtttggtaaaaggtggggagtggaactgaccaggggagaggaaaactttgcggggatcagaggtggtgttcaataacgcccgtgagttattcaccggcggactatttttatcttataaagcgtcatggaccgggaaagtggtgggtgggaaacaaggagtttaaatatagggggaaggatggtgttagggtaactgaaacaccggaattgggggcaagtaacggaattagga

SEQ ID NO: 565953 - DNA, 210 bp, Homo sapiens
gaagatcgaggctgcagggagctatcatcacaccactgcacttcaacctgggcgactcagcaagagcaagaccctgtctgtaaaaaaaaaaaaaaaggagagagacagagtgaatccaagggccggggggcgtggctcacacctgtaatcccacgcattggggaggccgcgggggctgggcccctggaggccaggagttggaaaccctgg

SEQ ID NO: 565954 - DNA, 209 bp, Homo sapiens
attttatagatggggaaaattgaattaagaaagaaagtgacttgcccaaggtcatttaagtagtaagtggtggagctaggatttgagctgtggtctgtttaacactaaagcccaagcttttaaatactgctttacaccttaatatccggtgctttaatattcttggccttctttcaaaaacttccctcttcctgtcaattccagagata

SEQ ID NO: 565955 - DNA, 273 bp, Homo sapiens
agtgaagcttgaaattgtgccactgcaatcccaacctggacaacagagtgagactctgtctcaataaaataaaataaatttgctacttatatgtgaatgtgtcttcacactgtatatcttgggacgcgtctaaattttttggaccccctccttaagggggatcccaatgatagtattgaaaataagcagcatgaaaattttaaagccatcctagacaacatttccctgtatttaaaccacccgagttgggaagaaggatggatatgttgtttc

SEQ ID NO: 565956 - DNA, 920 bp, Homo sapiens
ggggtgggtcaattcttccgtgattgtactgggctccgtgcatctctctaggtcttcattggtcttccatctggaactatataaatgtcccacaaaatcatgtctcgaagatatgattccaggaccacttatattttctccacgaatggtcgcttattaccaagtagatctatgctctatgggcaagtctattgtgcccatggcgacccgctaccttagtctggggaactttctaggcaaatgatgggtgttgtccgcattgcataccatgaggtacgtacgctactcactccaacaatgactttgctctggagtagaaagtcttttattttccttgaaaacataatttcctaaagtcaaatgagagactaatggcctatgcacgttgttgtgtcaagcgtcataactgtactgtagttagctaactcgttctagacctaattgatatctgaaggctcattgctcaaacaacggtatctattacatgtatcatggagcccaactaccttgttgagcacgttggtcacagcgctgttatgatatcagacaacgcttatacacaatttggacggaaaacgtccctttgtgtgtttcatttgctgtactagtgtctgggattaagcaatattggtttcagcatctatcatgagtgacctgagtgaaattacggggggatggaaggccacatgcattgaaataatagcggctgcagcctgttgttcatgttgaaacaagacttattagagagggaatgacttgaagtcagcactgttttagctatcaagtacaaataaagccatgggtgttggaacctctgctgaaaaggggaacttgcgctcaccggagtgagtgacagccgatcccgattccacaaagattgtggcgcgtcaaaccgggataacccctgggggggagaaaaa

SEQ ID NO: 565957 - DNA, 786 bp, Homo sapiens
tgtacggcccgaattcgggatagagacttcagagagtcctaccgacacatagaagtcagactttcaacgaagaattacgtcaacaaacgagcacccgttgacaatactacaagttgcaatcaacatagaccaacagtggagagaagtgcgagaagatctagactaaccagagtgtcagcgtcgtatcagttaaccagtcctgcttaaataaacatttatgagatatgcaaagaaacaagaaagtatcacgcatacacaggggaaaaatggcatgcaagatcaaataaaaaactttcttttggagcacgatccagacattttttagaacaaattgcaggccaggcacagtcgctcacacctgtaaccccagcactttgggaggctaaggcaggcagatcatttgaggtcaggagtttgtgaccagcctggccaacatgttgaaaccccgtctctactaaaagtacaaaaattagctgagtgtggcagcacatacctgcagttccagctactcaggaggctgaggcagcgcaagaatcacttgaacccagcaggcggaaggttgcagtgaaccaagattgtgccattgcactccagacctgggggacaactaacataactaacagacacctatattcacacaaatatttacactcaattaaaataaaccatgtctaaggagctaaacaggatactactgagaagcaagggacacatacacatacagagaacataatccactaacagcatgaccagacacatattgaaaacggcagccaaaatagacaa

SEQ ID NO: 565958 - DNA, 244 bp, Homo sapiens
gaggacacattaggcgcgtctgcgtcggctatttttgtatttttagtagagatggggtttcaccatgttggccaggctgatctcaaactcctgacctcatgtggtccacccaccttggcctcccaaagtgctgggattacaggtgtgagccactgtgcctgaccaggattgtttttttctatttctgtgaaaaatgatgttggtacacacacacacacacacacacacgcagaacgcgcctaat

SEQ ID NO: 565959 - DNA, 426 bp, Homo sapiens
gcagactcagaccaaccatgggaaagatctgactttgggaaagatatggaagtatgacactctgtggaaatcaggcagaatatgcctagtagccagtctccaaagtggctctgtgattcctgtctcccggtgttcacagcctggtttagaccctttccacattgtaccagaacactcatcctggaagaagccagctaccatgacttgaggacacttagccccaaggaaaagccattagcaaggaactgagacttcccgtcaacagccatgtgagtgggccttcctggaaattgatcctgcagtttcagtcaaggcttcagatgatgcaacccagatgctgaaccagaaacacccagtgaaaccacgcctagattcctgactctcagaaactgtgggagaataaatgtttgttttaagccacaaaaa

SEQ ID NO: 565960 - DNA, 231 bp, Homo sapiens
  misc_feature (15)..(15): n is a, c, g, or t
cccacccccccttcnccgggggccctggcagaattgacccaagaccaaagggggtttcttgggttcccgcctgggtgcccagccccagttctggtggataaccaaggccccctgttttggaaaaaggccgggtgcttttagggctggccgccccctttccctgggttttttttcccataaacgggttttttttttagggttgggccggggggggggtccccccggccttga

SEQ ID NO: 565961 - DNA, 748 bp, Homo sapiens
  misc_feature (64)..(64): n is a, c, g, or t
  misc_feature (269)..(269): n is a, c, g, or t
  misc_feature (410)..(410): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (459)..(459): n is a, c, g, or t
gataacaaatgcgcgtctatcaggtactcagactcgcctgggaagaaagagttcagaaaatttntaaaaaaattaccggaggtggctaaatgccgttgttagatagcttcacagtcgatcatacccggatggaagcgcctgcagttcgggtggcgaaaacaatgaacaccccgcatggcgacgcaatcaccgtgttcgatctgcgcttctgcgtgccgaacaaagaagtgatgccagaaagagggatccataccctggagcacctgttngctggttttatgcgtaaccatcttaacggtaatggtgtagagattatcgatatctcgccaatgggctgccgcaccggtttttatatgagtctaatggtacgccagatgagcagcgtgttgctgatgcctggaaagcggcantggaagacgtgctganagtgcnggntcagaatcagatcccggaactgancgtctaccagtgtggcacttaccagatgcactcgctagcaggaagcgcaggatatggcagcgtagcattctggaacgtgacgttacgcatcaacacgcaagcgaaggaactgggactgccgacaagagaagttgcgaggaactgcactatctagtcagtagactatcttcactaattcacttgaacacaaagcagttcaagtgaactggcttaggttgtacttaagtgcgcagcgctccgcacgcagctgggcaaattggcggttagcaatcacaccaggcccatagac

SEQ ID NO: 565962 - DNA, 210 bp, Homo sapiens
tgctggtcggtccgagtgtatggattccctctctcttctccctcacccagcaggcacccccggttccgccaggccctcctgccatgtcggacccagacgtcccagggctcggatgtcccgccatgtggccccttgtccagggtgcctgagccccttcagaggtacccctctgcacctgcgggctcgggcgagaatttgtccaattctcta

SEQ ID NO: 565963 - DNA, 1401 bp, Homo sapiens
ggaggagatgactggggagcgggagctcgagaatactgcccagttactctagcgcgccaggccgaaccgtagcttcttggtttaggtagttctactcacagccggacgatttcgaggggcaactccagcatagggcttgtgcaaatctgcggaacagggctcatcaagtgacagctcgggacccattgcttggcggagagatcttgcgaagatggaggtgctgcgaaggtgtgtggagaaaggccatgagaccttcagctagaagatggtagctgactagcggcacgctgccagtgacttgtgaagagtcctctattgattacgctactgtccacacaatggtgagccgctgaattgtacttcataacggcagactggatgacatacgtgccaaggttgagttggagcaagggggcttgggcaacagggtttgtgggagcaagatgttgggagtctcgggaagtgcacgcgaagcatagggacatggggcagtgcctgtagagtgtaaatggaaacaagcgcagcccaaggtgagggaagacccaggggcttcaagtttgcgctgacagaaaaccttcgacgtttgcttgggacacatgcattccgattgtagacccgttgggcaccccagggggccaaaggaattattcggccacaacaaaagtagggtcctaggaaatgtctggtggacatgttgtaccaggagaaattttgggcacaatcggtggaaaactctgggtgggtacgagaacacaacttttggagcgcagatgaagaaggcgactcctgtgtggagaaaagaacaaggtgcacaacacaagcggtttgttagaccacaacttttcggagcgggtgcggcaaaacaaaacacggccccagcagagcgagggacaacaaacagcacgcagccgctttttgcgcggggacaaaccaaagcacacgattattctagtgcgtccgggcggcaccacacacaaccaacgcgcacacgagcgcgaaacacaaaaacggcagccccaccacccccattatgttgggtagaggatagtgtagtgaccaaaacaaccgaaacattgcgatcttgacccaccgacaagttatatcattagagggggcgggaggggcagaccaccaccacgcacgccaaatcatctaattggaggagcgaagaagagcgaggcagaaaacaaaccacaaataaaagcgaggcggaggcggggcgggaacaacaaacacgcaagatggatttcacaaaataactggggagggaaggacgaaatggaaaaaatagggaaagaggaacacaaagcaacaaactacaggaacagcggcagcacaacgaacaaacacacgaggcgcggagcagacaagaaacgacaacaaaaaacaagaggaagagag

SEQ ID NO: 565964 - DNA, 234 bp, Homo sapiens
acgtcgtatagagccgtgtgtgtttctaagtaaacaatacagaatgatatgttagaaaatacttgaaagctacagataggatgggtgggaccaagatggacaactagtaacagcagcaatcagaggctcacatcaaaaagaatgataattagtgtgtgactccttcactggcaaccaaggtatccagattctctcatcagaactgactaggtggctgacataataacggtcagg

SEQ ID NO: 565965 - DNA, 239 bp, Homo sapiens
tagttgctactagtagacttgtccacctttcccactgttcgggattgtttatctctcaagtctctgctgtaggcacggatttccgaatccatgatcactaggcttttcccagtcttattgcaaggaatgtagaaggtgaatactggggattttctatctcatcatcgcttatttcttgaagacaggtcacaatgccaggaactgatgatggagtcacacaggctactacttcactgaaa

SEQ ID NO: 565966 - DNA, 824 bp, Homo sapiens
gagtcggcgtgaggcgctatgccgggtcgaaaaggttctcgagtccgggcattgtacaagcgcgtcttgaagtctgcaccgtgttctgcccccggactcaaatccctgggtgaccagatacgtgaaagacgaattgaggagacataagaccgctcggttctgacgaggcactaggctgttgtcttgcatagaatggtcaggtgtatgcaaacacgggttattgcacaccatgggctaaccgaagacagaacaaatttcaagtggaatcgcttgtcttggcactcttcctcccaagaagaaaacctttaatggactttcggtgatgaccaaattggacagttgcaggagctgatgcaagaagccataaaatccattaggcaattgagtatttgctagagtatatgaaaccaaaattttagtctatacaacaaagcttattatgacatgcaagaatttagaacccggctagtttaatggtcatggggtttcgaaatatatttaagcttgggaataagtgagcttgataatctgcaagattggttcagaaagattgtaattgtgggggccgtgagcgctaaaaatctgaaaaccatggtttgtgcgcgcagcgggccagttgcacacggaagcggtcacatgctggcgctaaagaacttcgcagtaacatagtcaggagtgccactaaaagcgcagggacacgagtttgtagacaccagagggtccggcgcaagggataacaggccagagcaaaatccccttgtgtggccaagacaaggactgcatggactgtcaacaccgagcgaacatgctcgtaataggcaacg

SEQ ID NO: 565967 - DNA, 534 bp, Homo sapiens
tttgatattttcaacgcagcctggccttggggtgcaagggtgctgcccacttcagggctcttctcctttacaccttttctgtggctctcaaacccttggagccaatgagagctgtctcaaaagggaactggtggcccgacagctgggcacagggcagtgggacagggcatggccaggtggccattcagacccctggcttttcaatgctggctgcattagaacctttgttacattagcagtttgctttgtatgcagtctgtttgttttgtgtgggtgtagttttttttttccacttagaaattgcatttcctgacagaaggactcaggttgtgtgaagtcagtgcacagtgcatgtcagcccacatagtgatggttcccctgttcactgagtataggatgtccctacagagtctcttatccaatggatggaggaaaaccaagccgtggcttcccgctgagccctccatgcccctcccttcaaccattccccatgggaaatgtcaacaagtatgaataaagacacctagtgagtga

SEQ ID NO: 565968 - DNA, 302 bp, Homo sapiens
gaggggctgatgactgtgggacgagagctagcagacgcacattagatgatatatagctcttcctgctggaggaggaggtggtggtgtactatctagtggaactgccgcctccaacagagactgaggacacccccaatggctctgccactgctggaactgaagccacctccaacgccaagaccactgccataggaatagctgcttcctccacccaggcctaagccactgccgacaccactggcaccgccatagccactggagacggtggaccgcaccacagagatgttgcctttcggagaaga

SEQ ID NO: 565969 - DNA, 355 bp, Homo sapiens
cttagtgctccctggcttttcggcagaactggacagaacgtcccacgaccccgatcacacaacacctgccggcttgacatgtcatcggtttagcctcatccgctttcgctcgccactactcacggaatcacgattgttttctcttcctgtgggtactgagatgtttcacttccccacgttccctccacacgccctatgtgttcagacgcgggtcacaccacatgactggtgcggggttaccccattcggaaatcctcggatcaacgctcggttgacagctccccgaggattatcgcagcctcctacgtccttcatcggctcctggtgccaaggcatccagggagcactaagcgag

SEQ ID NO: 565970 - DNA, 212 bp, Homo sapiens
tctacctccacaaacaggtaacagtttgtctttgggtttctccatgttggtctggctagctcaaactcccgagctcaggttatccgcccacctagccctcccaaagtgctatctctgcctcctgggttcaagcgattctcctgcctcagcttcccgagtagctggaattacaggcatctgccaccatgcctggctactgtttgtggaggtag

SEQ ID NO: 565971 - DNA, 470 bp, Homo sapiens
  misc_feature (2)..(2): n is a, c, g, or t
  misc_feature (180)..(180): n is a, c, g, or t
  misc_feature (182)..(182): n is a, c, g, or t
  misc_feature (232)..(232): n is a, c, g, or t
  misc_feature (307)..(307): n is a, c, g, or t
  misc_feature (464)..(464): n is a, c, g, or t
tnggtgtatgaaatgagggtgtttttttgtgtgaatgagggttttttgttgttaatgtggtgggtgagtgagccccattgtgttgtggtaaatatgttgggggggtatagggctgtgactagtatgttgggtcctgtaagtaggggggtgatatttgatcaggggaacgtggttattagnanagagagttttcccagtaggttaatagtggggggtaagggggggttagggngggttgctagaagtcatcaaaaagcttttagtgggagtagagtttgaagtccttgagagagggttatgatgcgantgtgagtgcgttcgtagtttgagtttggtaggggggatagtaatgggggtgtaagtccgtgggggtttttgagaatgactgcgccggtgaagctttagggggtttggatgagaatggctgttaatagggggggtatgtgggtgattgaagagtatgnaatggg

SEQ ID NO: 565972 - DNA, 1314 bp, Homo sapiens
gtactgttgagtgaaaagaaaatttctagtatccagtcctagctgctggcatcactatactactaacagaccgcaaactcaacaccagacttcttcgaccccgccggaggaggagacccacagttctataccacaccacgctattctagagttataacagggtccaccctgaagtcatatacttcttcatccatacctaggcgttcggcaatcaatctcccatactcgctcactatacatacataccggacaaacaccacgaacacacattaggcactacatacaggtactgagtcctgcagctactgcatatcaaattgcgcctacccctcagaggctcaaacatccgatgctgaagccaacaacccactccatatattaccacacgcagcgacatcacgaccggctacgaaacacacgcacagacagaccacatagtagacaaacacatcacgcacataaaccacatacacatcagacaagactactacccccaacacggacagctccaacacagcgaacacgtacacagacgacgaaacgaagccacacaaacaaatcacaacggcaaacgcaaatacagaacaaaatgaaccaacatggccagtcgcacacacgtgccgtcatgaaagccgcaaacaacaggacagtagacaaaccataacacacagacaaacacaacacggagacagcacagtacccaatagacactagggcaccactacagcaactacacgaccaagaacacacaatcacacactacaacaccacaccagcacagcaacaaagcaagacgcaaacgagacaccaaaccagacccagaaaaacaaacaacaaacaccaaaaaaaggctcgaaaaacacacaaaccagaaacaaaaaggcacaacaacagaccaacatctacacacgaccacggcacaatacacaaaaaaacaccacgaatataacaccccaaacacccaccaacaagacataccaacgcaacaagacaacaaaaacacaaaccatcacagcaaacccccagaaacatacaaaagacaaaacaaacaatcagagcagaaacaaaacataagaaaaataagccgcaacgcacaaaccaaacaacagacgggaacacaaccacgagaaaaagacacacacaaagaaacacacgagaaaaaaacacaagacagcaacgcagcacaacacaaacaacccacccacacaaacacgagaagaaacaaaaccaaaactaaaaaacaaaccaaaacaatataaaacaaggaatacacaacacaaacgacacacacaaagagcgctaacaaacacaaaa

SEQ ID NO: 565973 - DNA, 405 bp, Homo sapiens
  misc_feature (12)..(13): n is a, c, g, or t
  misc_feature (18)..(18): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (49)..(49): n is a, c, g, or t
  misc_feature (51)..(51): n is a, c, g, or t
  misc_feature (69)..(69): n is a, c, g, or t
  misc_feature (71)..(71): n is a, c, g, or t
  misc_feature (83)..(83): n is a, c, g, or t
  misc_feature (89)..(89): n is a, c, g, or t
  misc_feature (94)..(94): n is a, c, g, or t
  misc_feature (100)..(100): n is a, c, g, or t
  misc_feature (145)..(145): n is a, c, g, or t
  misc_feature (151)..(151): n is a, c, g, or t
  misc_feature (177)..(177): n is a, c, g, or t
  misc_feature (221)..(221): n is a, c, g, or t
  misc_feature (236)..(236): n is a, c, g, or t
  misc_feature (257)..(257): n is a, c, g, or t
tgggcacctgtnntcccngctacntgggangctgangtatgagaatcgntngaactcgagaagcagagntngcagtgagccantgtcgngccantgtacnctagcctgggcgacagaatgacactccatctcaacagaaacgaanaagaanaagcattcataaataaataggacttntaatcctctggttacatgttgatctaatagaactgcaagcttcntctgaacaccatatnggtcacatgtgttccttctangtcattagtcttttttttttttggggctcacttgggtggtttcctccccgggaccctttttccttttgggaaaagtttgggcctttcctttataagtggccgggatattatttattccttaattcccaacgggttgttggccctttct

SEQ ID NO: 565974 - DNA, 299 bp, Homo sapiens
tacaaaactgcacctgcatttcaatttgccaatctcacgttaattaagattctccaagaaatgaaatgcaaccaatacgggttcatactccaaatgaatagtctgcaaggtctcagattaatacatggaatgtttcatattataagtaattaaaaacactattggattttgttctgttattgaactggaataaagatgttgacattttcttttgaatacttggacactactagattttcattttttccaaagtggttctatcattttttgtcttagttgggtcatagactgtttccgtg

SEQ ID NO: 565975 - DNA, 112 bp, Homo sapiens
aattttaagacaaatggataaaaaggtatgatgaagcaggtatggtaaaatgtttaatggaaactaagtggcaggtatactagtgttcaccgtaaaattttctcttgttttt

SEQ ID NO: 565976 - DNA, 616 bp, Homo sapiens
caggctgtacgcctcgggtttcgggatggcgatgcggggctggagggggcggcgggagtgggtgggcgacgggggtggcccaggtcgcgggccccccagtccacgcctcgtgcttggctcccatcggtcctccgctgggcactggtcgcccgagctgccgctctgtcgcagcagcctgactggtatgcctgggttccggtgaccacgccgtagcgtggtcaggtgtggctggctgtgcttgcgtgccactgcttgtggttctaaggcgtgttaactgtgtgtgatggcactcttacgttcagttgatcctacgcagtactagtaccgtttatgggcctgtggtaagccctatagctcgactttcatcgttgcctgccgtctttgcttgcccagtgagagaccctggcagcttggcacgtcaggaccaatgggttgttgcgcccgggcccgctgtcggtgcaagcgaccacacgctggtagccctttctgtaatcactccacttggggtattcgtcgggtagaacgtcagggatacccgcatggacgctccattgaatgacaaccgtgcttccgtcaactatgtgtcaggaatgaacgtccagggccgtaggtagaa

SEQ ID NO: 565977 - DNA, 431 bp, Homo sapiens
aagcctcttggggagagctggcctcataccttgtctacacagtgtggcacagggttcctaacctctggtcagtcaggaatgtcactttctaacaggtctgggaactaactccatgttgatcttgggaactcaagagaaagactcacacaactcatggaggatacgaaccatggctgggctcggctttaaatgtcttatctgaaattccttgtggaacagtttcttcaaagccaatccaaaaggcatatgtagatgtgaccattcttgctgcacattatgcaaataatcaggccaagtataagactatagtgtattccacccccagcatccagggtcttgtcacaggttgtttgaacccaaaattggtaatgtatagaatgattgtggtacaaatgatttcatgcatttgacattatattttagtctttttc

SEQ ID NO: 565978 - DNA, 404 bp, Homo sapiens
gtcgacatggagtggaatggaatgtaacacaatggaacggaatggaatggaacagagtgtagtggagtggataagagttgagaagagtggaacggagtgcagctggagtggagtggaatgcaatggagtggagtggagtggattggagtggagtgcaattaagtggaatggaatgggatggcatagaatggaatggaaaagaaaaaatgtaacggaacgaaacgggatggagtggaggggagacaagttgagcggagaggatcaggatgcagtggaatggaatggaatggaatggagtgaagtttagtgtagagtagagtactagagtggagtggagagaagtgaagtggagtagaatggagtggaatggaattgaatggagaaaagcggaatggaatggaaag

SEQ ID NO: 565979 - DNA, 696 bp, Homo sapiens
tcaggcccctcaaatcctgccggggaaccagcccaagccccgaatttcctggaaacggtggatttgcaaatcactttgaaaaatttattgatccccagaaaggacaagcgcttctcgggcaccgtcaggcttaagtccactccccgccctaagttctctgtgttgtgtcctgggggaccagcagcatttgtgacgaggctaaggccgtggtatatcccccactatggactatcgaggcgctgaaaaaactcaacaagatttaaaaactctgggtcaaaaagtcttggccaaaaatgttattgatgcgttttgggcctcaggagtctctgatcaagcagtattccaccgaatcctcggacccaggtttaacataaggcaggaaagttcctcttcccgggtcacacacaagcgaaaacttgtggtggccccaaaggtggttgagggtgaaagtccaccaaatcaagtcttccacaagtgtaagaaagcgtgtttaatgtcgtggacgtgttaacctgttgtggtctcccggtgaagattgtaccagacagatgacctttggtgtttttaacatttcacccgtggcgtgtcacacttcttgggcggttcaatgtgcctcacaaaaaacctgttggcaagaagttgttccgggaccttattatattcaaggagccccagtggggcaaaagcccccaaggg

SEQ ID NO: 565980 - DNA, 121 bp, Homo sapiens
tcttggattagacataacgccattgatcacgcagctttgtgaggagtgagtaattgtcgtaatggtgagtcctattcgtcctgagccaccttatttttttctgaggcataagctcagataa

SEQ ID NO: 565981 - DNA, 157 bp, Homo sapiens
tgcgtctgaatggcatacatttgtaaaatgcgtcactattgtcaggagcagcgttttgcacctgaaaacccaccaattaggaagtcaaagttggtacgattgcttgagcccacgaattcaagaccagcctagtcaaccttaatgaaaccccatcttt

SEQ ID NO: 565982 - DNA, 173 bp, Homo sapiens
agtgatcccagtcatatattgggagtgcgagtgtagcactggatcacctgagtgatcaagagtacgaaacagcctgggcaacatggtgaaaccctatctctactaaaaatacaaaaattagctgagcgttgtggcacgtgcttgtagtcccagctactcgggagtgctacgag

SEQ ID NO: 565983 - DNA, 177 bp, Homo sapiens
cgcaggtgggcacccacacttttctgccgtcttttcaatctgtacccttgaccctcctcctttttctgctttgtcagactccttaaggcactgcagaaattaaccatttccagggactttcccgcgtcacacatgagttattccatgtggacagtggcagcctctatgggatgccta

SEQ ID NO: 565984 - DNA, 271 bp, Homo sapiens
cacccaggcgcacttctagcgccaagccattcattcaagaatgactcagggccgggcgtggtggctcacacctgtaatcccagcactttgggaggccgaggcaggcggatcacgaggtcaagagactgagatcatcctggctaatatggtaaaactccatttccacgaaagatacaaaaattagctgggcgtggtggtgtacgcctgtagtcccagctaccagggaggctgaggcaggagaatggcgtgaacccagaagtgcgcctgggtg

SEQ ID NO: 565985 - DNA, 379 bp, Homo sapiens
gaggcggagtcttgctccgtccctcaggctggagtgcagtggcaagatctcggctcactgcaacctccgcctcccgggttcacgccattctcctgcctcagcctcccgagtagctgggactacaggcgctcgccaccacgcccggctagttttttttgtatttttagtagagacggtgtttcaccgtgttagccaggatggtctcgatctcctgacttcgtgatccacctgtctcggcctcccaaagtgctgggattacaggtgtgagccaccgtgcccggcgataaggccctttttaccacattcttgaaaacagtgggcactacccttaacttttgtgttatagttacaggtctatcaatttgtatttggtcgacgc

SEQ ID NO: 565986 - DNA, 451 bp, Homo sapiens
gactgcctcctcaagtgggtccctgacccctgacccccgagcagcctaactgggaggcaccccccagcaggagcacactgacacctcacacggcagggtattccaacagacctgcagctgagggtcctgtctgttagaaggaaaactaacaaacagaaaggacatccacaccgaaaacccatctgtacatcaacatcatcaaagaccaaaagtagataaaaccacaaagatggggaaaaaacagaacagaaaaactggaaactctaaaacgcagagcgcctctcctcctccaaaggaacgcaattcctcaccagcaacggaacaaagctggatggagaatgattttgccgggctggagcgggggtccggcaaccgctctcctggcgccgccccccacaccggccggcggggcacattgcaaacccaagaggcaacagaagttgaaaacttc

SEQ ID NO: 565987 - DNA, 1231 bp, Homo sapiens
gtgtctctgcgtcctcccccccttgttgtgtgcccccccccgccccccgcgcttttttggggggccccccccttgtggtatctctcgcggggaggtctcccccccgtgggtgccccccccctgggccgccccctgcggtgtttctccccccggcgcccccctatggttttttccccgtgtgtttctatcggggttcgcgcacgcccccctggggggtcccaccttttggggcccccccattgtgggcgggacgcgccccccccttgggtgtacgtttcccccactccgtgggggtggttctctcgcgcgctcttcctcatgctggggtgtgtccccttccgccgagaaccgttgtgtttttctcccctctggctcgagggttttcctctcctgtgtgtcttcccccgtcgtctctcgcgcctcctcgcgggccccacacctctggggtgtgtactccccccgctcttttttcctcgcgcggattgccccccctctttcccctcggttttcgctgggcccccacgactcttgtggacacgtggtgaggcccctcgctcctccctacacgcgcgctcttattgttcccactttgtgcgtcatctcgtcgtgccccccccctctattgggggggtcccctctctgcgcgctctctcgcgagactctcttctttgctcttctcccaccgcgcgcgctcccccttttcccaactctctctcttctccctcgtgaacaaaccctcggcgggcgcgcgcggagaatatagagagagactcctctctcagggcgttgcgctccccgcagagaggagggagtcccgctcctgcggcgccccccggcgcccctcccctcgtgtctcccctcacacagagagagatattctccctcccgcgcgccccgcgcgcccgcgggcgggcggttcggtccccgcgcgcacacacgtctctttgttggtgtgtgttctctccccctctgtgttaacccgcgacggtttcccccgcgcggtgcccccccccccccccggccctctccccccccccctctctctatatatatatagacgccccctcccctccgcgggcgcccccccgggggggacccgcccctcttgttttgtcccccaacacaccgcggggggacggtgttgtgcgtgcagaagaccagagggccgcccccccctccccccgccccccccccactcacccacccccattaaaaagggcagagagaaaca

SEQ ID NO: 565988 - DNA, 115 bp, Homo sapiens
caaggaaaaccccacttttttttaacacttttcaccctaaattcctaaaattgttctacacagatgttcccgacatataataaagtcccaatcaacccatttgggcgtacgggga

SEQ ID NO: 565989 - DNA, 119 bp, Homo sapiens
tcggattactcatcttccttctctccttaatgacattaacactatgctcaccagacctcctaggcgagccagacaattacgacctagccaaacacttaaagaccctcctcaaatcgccg

SEQ ID NO: 565990 - DNA, 1759 bp, Homo sapiens
  misc_feature (120)..(120): n is a, c, g, or t
agtcggtctcgtgagtttaccatgtgaagatggaggacgcacgctgatcgtagttacacactgtgatagcgatgatatagtcgtagagtatacatcgctactagttctagttgtcccccntttgcttcgtaccgcgtaacgtcttgccctagcaggactgcttcatgcgacgtctagtatgtgtgtgtacaacgtggcgcacgcagggataatctgcaccctaatcattcgcgcactctggcgtagacatcgaggggtgctatctaatgtcgtggagggacatggcaaccgacacgccgtacttactcaagcaccattacacagagtctcctcccttgctatctggtgcaaaagctcaacgaatccctggattctccacaaggtggacgggcgctttacgttggaattcgcccattgattggcagcgctcgtaccatatctatttgtgagacgaaattggggattgcacgggccgcccatagccaattggggtactatagataacgcattggacttgaggggagactttgtatgggtgcgcaaacaaagtaaggctcgcgcctacctacgtgcaactgcatgcgtctttgtggcctattttctataggacagcggcgaccctgcctaggaaccaatatcaaatatccctcggtgttccatttgagctcatatgatggggaggatcggccagatttagacatcacaaggcgtaacgccattttacccccttggaccagaaatacattggggaaaagaacccagtgggctaaagtcgccgaatcgggatttatccaaccaccaatggagagaccagagttgaacctccttggggtttaccccattcggttaccggtcctggggacctggtttctatcgcacatttgaccaccggcgctaaaaacccttggcactcggagggattccgaggtcacacataccgtgatccgaagatacaagccttatggaaacacgcccaattacaggttatccgccgacccaataatggtttcggctatcaattaagtattacccacacttgcggtttgtgcaacccttttttcgacacacacaccggacatggcggtctcactgtgggcggcaaattaattggtggccaaatgccttttgcttcggcactaattatcccaactccggtaatgtaggcaaccctattttctatttaggcggctatagagctcaggttaccacatttacgcgaacgagaccaactgcggtggggattccaccccaacgccaaaatatagacgggtcagggttccacctagaataaaactgtgggctaatttgggggggggagaggcgccccaatattgacacccagatgcctgtgagagaaagaataatatggccacaccccatgggtgaacacgtcctgtgaaggagatcaccaaccaaacaacactgttgaacccccatgaaggtggattacccaaacgcgttgtggagagaaacggagggttactttatcccacgtcttgggcagcatgacatccacattaggtccaatctgaaaagtataacccccttcctgttttggcattggcggatagcgaacacgcaagcttgtggcgcacaaattagcaagtgtgttgtggcaaccatcttgggaggacctgggtttcggtcataagcgacgtggaacaacgatgccctatgtaggtgcgcccccttggactggtcggagagctcacacagagtgtcaagggtattcggcgaccaattgagagtccaccaatag

SEQ ID NO: 565991 - DNA, 144 bp, Homo sapiens
aatgttgaggaggaatgtgttcacttaactcccagcaaacatactcctgccacttaggaggaaacacctccctatgtgtaccatttatgtttctcatgaaccagctagaatcagtgcctagcgctgtgcccatgcaaatatgtt

SEQ ID NO: 565992 - DNA, 439 bp, Homo sapiens
  misc_feature (150)..(150): n is a, c, g, or t
  misc_feature (158)..(160): n is a, c, g, or t
  misc_feature (164)..(164): n is a, c, g, or t
  misc_feature (166)..(166): n is a, c, g, or t
  misc_feature (379)..(379): n is a, c, g, or t
  misc_feature (436)..(436): n is a, c, g, or t
cagctgaaggaggccaagcacatcgttgagtattcaggccgcaaatattaagaggtggccaggaagctggtgatcctggaaggagagctggagcgctcggaggagaggtctgaggtgtccgacagccgagccaaacagctggaggaggancttcgaannntggncnaggcccttaagtccctgaaggccctaggggaggagtattcccccaaagaagataaatatgaagaggagatcaaactgttggaggagaagctgaaggaggctgagacccgagcagagtttgccgaaaggtctgtggcaaagttggagaaaaccatcgatgacctagaagagcccttggccagtgccaaggaggagaacgtcgagattcaccagnccttggaccagaccctggtggaactcaacaacctgtgagggccagccccacccccancca

SEQ ID NO: 565993 - DNA, 186 bp, Homo sapiens
tttgttttaacttgctccagattgagatgcatattaaaccctgtattacaaattcaattgaagtgtctctcaagtctctttcattcatgggtacccttctacatcagttttcccccttgtaattcttttgttaaactagagtagtttattctttagcgattccccagacctagcattttctcgact

SEQ ID NO: 565994 - DNA, 123 bp, Homo sapiens
tgttctgtggtctctctggtgactgagaaagaggcgtcccattgattgattgattgagagagggtcttgctttgttgcccaggttagagggcactgacatgatcatggctcattgcagcctcc

SEQ ID NO: 565995 - DNA, 445 bp, Homo sapiens
  misc_feature (92)..(92): n is a, c, g, or t
  misc_feature (385)..(385): n is a, c, g, or t
  misc_feature (442)..(442): n is a, c, g, or t
taattcctgcaggcccagggggccaaggttaaggggagcaaaggggcagttagattgggtccccaagggaaggaaggtgaggggcccagggnaagtaggggttgggtgttctacggaggcaaaatgaccaggagcctacggggtcaaatggaaaaattaaggatttgtggtagcgctgtactgatggggtgtgtgtgtccccaaaagtattcccccaaagaagataaatatgaagaggagatcaaactgttggaggagaagctgaaggaggctgagacccgagcagagtttgccgaaaggtctgtggcaaagttggagaaaaccatcgatgacctagaagagcccttggccagtgccaaggaggagaacgtcgagattcaccagnccttggaccagaccctggtggaactcaacaacctgtgagggccagccccacccccancca

SEQ ID NO: 565996 - DNA, 580 bp, Homo sapiens
tgcagtggctcacctgtaatctccgcactttgggaggccgaggcaggcggattacctgagggcgggagttccagaccagcctgaccaatatggtgaaaccctatctctactaaaaataaaaaaaactagccaggcatggtggcatgcgccctagtcccagctatttgtgaggctgaggcaggagaatcacttgaacccaggaggtggaggccgcagcgagccaagatcgcgcctctgcactccagcctgggcgacagagggagactccgtcccagaaaaaaaataaataaaataaaaaacatatcggtcacatgaagcaactttttaattttcttaattgtttatttttttgagatggggtcttgctctgttgcccaggctggagtgcagcggcgcaatcatagctcactgcagcctccaactcctgggcccaagcgatcctcccacctcagcctcctgagtaactgagaccacagatgtgcgcccccatgcccagctaatcccgtattccctgcagtaatagggtctcactttgctgccaggctgcgctcgaactcctgagctcaagccatagagctca

SEQ ID NO: 565997 - DNA, 733 bp, Homo sapiens
gaaagtactgcatacctattagaatggccgaagtcgctgggcgcggtggctcacgcctgtaatcccagcactttgggaggctgaggcgtgtggatcagaacagcctggccaacatggcgaaaccccgtctctactaaaaatacaaatattagccaggcatggtggcacacacctgtaatcccagctactcgggagtctgaggcaggagaattgcttgaactcgggaggcagagcttgcagtgagctgagattgtgccactgaactccagcctaggtgacagagtgagactccatctaaaaaaaaaaaaaaaaaaaaaaaaaaaaaaaaaaaaaaaaaaaaagagagggggcgcgcgcggccaaaaaatatatctcccccggggggggcccaagatattatacgcgcggccccgcacggtttttgtggagaaaagggggtgcgcccacaaaaaagagggagggcgcgccattatataaacgacgaccaagcagacgctgcggccgcgcgacgattaacaacaacaatgctattgtgatagtgtgggggaaacacaacttgtgtgatacataggggggggggagacaaatctttggggtggagcaaagagaggacccactatatatattcaggggagggggggggggggagaccaaatatatgtgggggaaaagaaatacacttagaacgaggagagattattttaagagcttataggaggggaaaatattttag

SEQ ID NO: 565998 - DNA, 219 bp, Homo sapiens
  misc_feature (133)..(133): n is a, c, g, or t
atcccgatatctgtctcagtggatgttggataatggatggatggatgaacagatggatggatgagtggatggatgaggaatgagtgagtggatgaatgaatgaatgaatgagtgaacgaatggattcatgaantaatgaatgggtgtctgaatagtgggtgtattgatagatggatggatgactgagtagatggatggatggatgagtagatggatgga

SEQ ID NO: 565999 - DNA, 434 bp, Homo sapiens
taggcaactgtgctatccgagggagcaacgcccttcgtgcgccacatgacgcatactcacctgccacatctcacgctcgtccaccgtcggcgcgcaccacacttgcacgcccttggcgtacatcgccgtacgcagcagcggcatcatgttttcccagcacaccgcgccgctgacccgccctaccgccgtgtcgatcaccggcaaggtggagccatcgcccttgccccagatcaaacgttcggtgccagtgggcatcagcttgcggtgcttgaccaccaggccgccagacggttcgaaatacagcacggtgcaatacagggtgctgccactgcgctcgatcacacccaggaccaggctcgcgccggttcgggccgacaaccccgccagcgcctcggtcttggtgcccggccttccttggatagcacagttgccta

SEQ ID NO: 566000 - DNA, 225 bp, Homo sapiens
tataggcgctatatataggcctaggtatggtagatcatgactgtaatcccagaactttgggaggctgacatgggaggatcgctggtgtcaaggagttcgagaacagcctgggcaacattagggagactgtctttacttttaaaacacacacacacactcacacacattaacaacataaaaccctcattcacacgagaaaacaccctcatgttcatacaccaaggc

SEQ ID NO: 566001 - DNA, 349 bp, Homo sapiens
ggtgtacctgcagctctctctgactggagactatgagacgtacgcaatgggggctgatcttcgctggactggccttcatcggtggggctcctcatccgcctcagcagaagattccgctgtgggggcaataagaagcgcaggcaaatcaatgaagatgagccgtaacagcagcctcggcggtgccacccactgcactggggccagctgcgaagccaagcatggccctgcatctggcgcctcccccattcttccctgggctaaagaaccttgtccccgtcactgccagcgcttgaggtgaagggaaagctcaagactcaatgtgaccccaggggggatcggcaaattcctg

SEQ ID NO: 566002 - DNA, 129 bp, Homo sapiens
aataaatattttttcccccttaattgagggttttttttttcatttggggattacaccttaggttttaggcacccataatttaacctccaataggtttaaaagcaagaaggttacccctaataaaagagg

SEQ ID NO: 566003 - DNA, 962 bp, Homo sapiens
atctgatatcagcaattcatggattgtagaacttgtgctgatatttgaccttggtattgaagtataactgtaacccctatggatatattgtttaatacacctgtacatgatcttatagagctttacgaaaccatttagattacagtagtgcgactatgggatatcactctatccgtggtgcctgatatgggctaaaggaacacggctagttcctattgttcgacgaagagaccacagctacgtaagatagcgccgctgttgaagctaggaaaaaacgtactgggctagcttgcgcgctccccaggtcccaaggagcccgcattaccgttggaattgcataggttgctcaatcgtggtcgcaatttaagcgtttcttaacaacgccgggcgttggttattgcgaaggtatgcgaagcccactggccaagcagcaatagcgattaatacaagcataggaggctggcaacacgtttagttgctcccgccttccctttaagcctaaagggcaggcctccaattcgtgtagactcccataacatcagcgtcaaatgaacagccctcctaaaaggggcaatcctatggggggcttctacctagtgtggggccttctccgaattgatatgccccccagcggaatgggatatgccattgcgactgcaagcaaggggcatttctgggcaagaaatcgtgctaaccccccaaagcaatgggtagccgtccgacatctaagcttaggggaacactccaccaacctaaaatagggggacgacttttcactcttcattatagcgccccccccggcttagactgtttgagagtagcacacccaatttacttgatgaaggcgcatcccagttttctgctccaacgcgtcttcgggcgcatttgcgcccgatatctattttactcttgcagctctgttaccctcactctcccaataggtggttgcataaaacgacgac

SEQ ID NO: 566004 - DNA, 132 bp, Homo sapiens
gatccttgagaggcaggacactgaagatcaccatcacggggtacgaaccgcttacagttgctatgagcacagtgtcttccttaaacggagagcccgaacaaggggttgccatggaagcggtgggccagaacg

SEQ ID NO: 566005 - DNA, 243 bp, Homo sapiens
ccggtatcccacccctataccacatataaagtatctcaaatgattcttatataaaaatcacaaaagatactttatatactgcctgacatgcagaaagagctccacaaaggttgacgaattattcaaaccagcaacgatgtgtttaaagaaaaaaaaaggtgggtgaattaaatataactttcaaaaaggcaaaacatttccaaccactctaccagtaaactagtatacctatagaaaacatgt

SEQ ID NO: 566006 - DNA, 327 bp, Homo sapiens
  misc_feature (8)..(8): n is a, c, g, or t
  misc_feature (210)..(210): n is a, c, g, or t
  misc_feature (272)..(272): n is a, c, g, or t
  misc_feature (280)..(280): n is a, c, g, or t
gtgggtgngggcagggggagggagtgtatcaagataaacagctaatgcatgctgggcttaatacctatttgaatgggttgataggtgctgtaaaccatcatggcacacatttacttatgtaacaaacccggcacatcctggcacatatgttcctagggacttaaaataaaataaaataattaaaaattccaaatgggctacaggcaaagnactgcttgcaaataattgaaattcatgttccataggacagtatttccttttgccgggaatgnacttttgntcccctaaattaaaccctttttcaacataggctatttacttcgttga

SEQ ID NO: 566007 - DNA, 578 bp, Homo sapiens
aggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagatcacagtggatgtcttccactttgctaatgactttcgaagcctggtgttcctcccctgccacctgaaggtcaccctagctgagcaagacccagatgaactcaacaagggcctgttccttcatgaagcctttacaacagcttgtttcccaggggaaggctcggctgacatctgtcaatgctgtaacaaatgggactggggcactttaaaccatttcagagaggcatccttcatgtcatgagcctaaggtccaggtctgcttacccgtaaccgctagctagtgacagaagaagcaaatgtccccggggggccccttttctttttg

SEQ ID NO: 566008 - DNA, 914 bp, Homo sapiens
  misc_feature (414)..(414): n is a, c, g, or t
ctccataactccttcatagtacccatgctaatcgcaatggcattccttaatgcttaccgatagcgaagaaatactagggctacatactaggtatgcaaaggccccaacgcttgtagggcccctacgggctactgtacaactccttcgctgtacgccatgtaaaactcattcaccaaagagcctcctaaaaactcgtcactagtctgccatcatgcctctacattcacacgtgccgaccttagctctcatccagtcgcatcgttctatctagtgaaaccaccctctcaccacatagaccaagccccgtggtcaggcctcaactgtaggcctcctatattattggctacgccaggctctagacctagaccggtgactcaacttcgcttctggatctagggctcgaggctgcagaanctccagaaatgaacggcccagatgctggtcgcatctggcaaggcaaggaatgcccaaaaccagacctccatgatgaaggtgcagcgcctgagccatgcatcttctaaacttatgcgacaccatttaccttaaattcaagtcggacataccccttgtagacactacttccacaccccgttatgcaataaacacaaatgaacctaccatctggtagtgtagctcctcttggcccactacaatggagccccttgtgggcccagtagagtactggagttctcatcttcaccaaggcacatacgcccacagaagaagcccaaaagcggaaaccgcccctaacgaaccctttgggccctggaagggcgcgaagttacgcgaatcgaacgatcctgcagggctcttcataacagaactgatattacgctcgcgagagacccctttacggccgcagtattcctccaataccgcgcacgttaacatctgaaactctactcttggattaa

SEQ ID NO: 566009 - DNA, 606 bp, Homo sapiens
aggtactctagaggatcccttgagcacgaatgtaatgcgctcgatctcgtcctggctcagggtcgacagggtcagcatctggggagtgatacgctcggcgttggccgggatgccattggccggcaccagcacctcaccggccttggtcgcggtgtattcaccggccttgatcagttcgatcagcgccggcttgtgttcacgcaaggcggccaatatcgccgggtcgctcaaggcttgcttgttgccgttcaccgacaactgctcgcccttgagcgccagttgcacatccttggttttcagggttgccagcagctcgaggatgttcacaggacgatctccattcgttcggtcattgcggcgtagccggctagggtcggttgttcgaacaagccccgcacatcggcttccatgccttcctggcgcaggcgcccgatcaagctcacggcaagcaagcgagtgcccgcccagttcaaagaagttgtcgtggcgccctacccgctccaccttgagcagctcggcccagagttggccaggaggatttcggtgtcgccttcgggcgccgcgtactcacgtacctgcaacgcgtccataccacattcgtgctaa

SEQ ID NO: 566010 - DNA, 180 bp, Homo sapiens
gacgtccttccagacctcacgccaccatcttggattgttctcgatcccgtaccccagctacgcatctttggttcgaagacatccacctcactggccggtcctcctgccgcctggaggccgagcccttctgcgcaccgtctttggcagccagagcatcacgatgtcaccatgtccttaccc

SEQ ID NO: 566011 - DNA, 152 bp, Homo sapiens
gcggtgctctgagaagccggactacgacggcagcggctctatcaaagcggagccgggcagttttttgctcacagttttctgccaccatgcagtcagcagctatacatgcatgcagctgcagttcttgagagcaagatcaaataaacaactag

SEQ ID NO: 566012 - DNA, 500 bp, Homo sapiens
tgtggagacggggttcatatgtggcccaggtgggtcttgaactctcagcttcaagcgacccttagcctgagcctcccaaagggcgaggattacagtggtgagcccccaggctgggctgccatttagtttctgatgatcattttcctgcctttttttttgggggtgcaaaaaaaagggttttagtcctcagcatcttaccggcatcaggttcaccaagggggccccagccggagggttcctggcctcaaagcaggggaccatccatctctcccaggagggctcggtagcaccggagagcgcagtgagatagccggggattggagaaaaaccaggaacccagacagatcacagttggcagagctcagggtccctggctgtcctcggagagcagtgacctcccagaatcttccggcgggtccaggtatggtgaagcctcagggcccaaaaccagcctttgtgcttccatcctggcagtggggtggccacgagtatggccaaat

SEQ ID NO: 566013 - DNA, 222 bp, Homo sapiens
  misc_feature (70)..(70): n is a, c, g, or t
  misc_feature (101)..(101): n is a, c, g, or t
gacagtgacaaataaaggatttatcacacagaacaagatatccagcagtacacagtccaggcctggtatngcaagcacttaattatgttatcagaggcccngggtcttttttttttttttttttttttttttttttttttttttttttttttttttttttttttttttttttgtgtgtggggggagagaaaagagatttttttctcaaaagagagagagaga

SEQ ID NO: 566014 - DNA, 506 bp, Homo sapiens
acaaatcccaggaatctcatgattttaggagagcccttcccagtgagttaaagctcattgctcatcagcaaactcaaacaggagtgagaccctactgatgcaatcaatgtcaaaaagccttcattacaaattcagggcttgtgtatcatcagaaaactcatcatagagaagggaaagtctgtacatgcagcaaatgtggagaagttttcccttggaagtcagaactcattttatgtcaaagaaatcattcaggagagagaccgttcatttgcaaagtatgtgataaaggctttgtggttaggacacatctcactgtacatcagagagctcacacaggagagaaaccatatgcttgctcagattgtgaaaaagccttctcaaaaaaggctttattcatgattcatcagtgaattcacacaggagagataccctattaatgcattcaatgtcaaacagctttgaagaccagatctgagctcagttatcctcagaaagttcttcatagg

SEQ ID NO: 566015 - DNA, 645 bp, Homo sapiens
cggcgtctggcgtgctttgagacagccccaggtcgcggagctgctggcgaggtccggcgagctctgccgggaggagttcggggccgagtcccgagctgggcgtgtgaggcgccgggcctgggtctaacgcgtcatcggggaacaggacggactacaaccagggcctggtgctggctatggctcctgcgagctcatgaaccggtcgctgtgtgggcagcctgccggaacggagtgagcgactggtgtcgctcctcgagcacctctggaggggtgccgatgagcccgagcggctgcagtgtcgactgcccacagtccagcgctcgctggagcctgggactcctcgcgtgggccaactatgtcaagggagtgattcaggtactacccaggcatgtcccccatccctggcgttcagtgaaggtaggtggtcagctcagtgcccctgggggggtggccgtgtccagctcagcatccttggaagtggccacgtacagccttcctccagcagcttgtccagactcgggcacaatagctgtccgcgcccaggtgtgtcagcaggtccgagcacagcttcgcagggatgccctgtggcatcatggaccaggtcatctcacttatgggacagaaaggccacgcgctgctcattga

SEQ ID NO: 566016 - DNA, 167 bp, Homo sapiens
gtctgtgaaaaggatgggtctaaaaaggtggggacgctgtgggagaagcggggtttagtggaaggaatttctacctgaaggccaggacatgggtgcattcgtcgctgaacagaagggtggagtatacccggggagaggagtcggaagccccttggccgagagggcac

SEQ ID NO: 566017 - DNA, 1145 bp, Homo sapiens
  misc_feature (290)..(290): n is a, c, g, or t
  misc_feature (343)..(343): n is a, c, g, or t
  misc_feature (381)..(381): n is a, c, g, or t
ggaggtcctggtgcttgatggtcgaggccagctcctgggccgcctggacgggcatcgtggctaaacaggtactgctgggcctggaagggtggtgcgtctgtacgctgtgaaggcatcacacgaattttcgtggcgaatttctacgagaagactacagttgaagatacgcgtggcatttccttcacgtcaagtcggagtgaacaccaaaccctgtatccctgagggcctcatactcgactgtccggggcccctctagccgtgatcttctggtgcggaccgatgctgacggntaatagcttagacgcgcacaagatagccaagcgacgaggggcctagaggcccntgcgtctttggagcgccgatcatctaacggatgttctntgaccggggtgatttcgccatctcagcccgtatccgaaccaaagggacagaaacattgctggggaaatgggggttagggggattcttcgccgttggggctttagagcacccccttccaccaagggattcggggttggggccggcctccttttggcaacaacggggccaccattaaccccaggaagcacaacacatacggcgttatacatggtcccgctttaatatcctttggacgaagggggcctggaccccagtggggggcctggttcaaaagcaggagaaagtgggcctttgggggggccgcataggggccagaagaggttgacaccacaagggtccacaagcggtgggccaacaaaaggggcaccgcaagcggccccctttggtggcaaagggcggacacgacaagaaggcaaggcgggcaacacacacggaacggagaacaagacggccggccggaaggaccggagacagtttccccccccaaagggcggttttaaggcacctcccggtgtggccacacaaagggcgcaacccaacgggggcacacaagtctaccgccagaatgttggggcaaattacccagacaggttttgagacacaaaagcgggcggcaatttcaacttcgggccggcggcacaccaaaacagcacctctagggtggcgggcaccacccgggacaaggttggaccgcacgttgggaacggacaccctggttggtgttggcggttaaatggccgcaccacaacgaggggaacaaacac

SEQ ID NO: 566018 - DNA, 1714 bp, Homo sapiens
  misc_feature (68)..(68): n is a, c, g, or t
  misc_feature (609)..(609): n is a, c, g, or t
  misc_feature (1132)..(1132): n is a, c, g, or t
  misc_feature (1693)..(1693): n is a, c, g, or t
ccagatgactcagacgaggagaatgactttcggcaagatctgcagccaggagagcagcagtttgcagntgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaaaaaaaaaacaaggatgtttatcccagctgcagcagcaccaccgccagcacagtgggaaactccagctcacacnacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacagtgagggggagctcccagcctgagagttgtgacgtgcagtctaatgaagactaccctcggaggcccctaaccagggccaggagcagactgtcccatgtactgctggtatctgagtcagaagtagccaaaacaaagccacgtnacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcaggctggatggacactatagcaaacatcaatcaagagctcattaaatatgaattcttccctggaaggccacttcgaagtgaaggaaggactttaaagganatacccccaagtacccctggg

SEQ ID NO: 566019 - DNA, 342 bp, Homo sapiens
acatagtgatgatcccatctctacaaataaataaaaaaattagctggacatggtgaatgtgcacctgtagtcccagctacacaggaggctgaggcagaaggattgcctgaagccaagagtttgaggttgcactgagctatgatcaagccactgcagtccagtctgggcaatagaatgagaccctgtctcaaaacaaacaacacatataaaaagaaacagaaaaaacaaaattgtgtgcgttgtgtagcgacaaaaaacaaaacaacaaaaacaacatacaccccccccacaatatatagatacataacaccaaaaacccataaacaccacacccttttcttt

SEQ ID NO: 566020 - DNA, 1509 bp, Homo sapiens
  misc_feature (106)..(106): n is a, c, g, or t
  misc_feature (1488)..(1488): n is a, c, g, or t
ttagtctgtaggtagtggctaagttaatgacagcggagatgattaaatgagattagaactgaccttagtatgtcggattttatagctaagaaccactggatccttnctgtcatctagcgctctcctttcctctgttgctgtcctcaacaacagttccccttctttccaccaagtcacaaaaggagaaaatgaacgtgagaggcgggagtctctctcagtgtttaaatgtcaagttagttacattagattgcacaagacgatgatgacatttgggtcaaggatgttacagatgtctgtgaaatgttaagatcagacaaatgagcctgtggttttataatcttttccatttgatctctctcaagttggacctggttgaaatctgcagtgaaaattggaccaggttgaaattggagattaaaacccgagaaggaaatatttttctgaagttgatatactagttcagttaaatgtgtttattatatcaaaattacttttttctgacttcatgttttatatgtcaaacagaaaaactaatcatgttttagatgagcatttcaatagaactttaatgttctgtgtctacactgttcagtattatggtaaccactaaccacatggctactagattggactgaatagctttagaccaaagtatccaaatgtgtttctgggtcttttttttcaaggttctacttttacgtttgtgacaggaattaaaatccaactctgctcattcctgagagtgaatgtaaggtaacataggtgaattatttcaggtctgactattgactataaaaatgtataatagttactcattttttaaataaatatttcctaaacagtttctgtctgggcaagtcattttctgagacttggttttcttaacagtaaaatcttagaaaaaggcactttaatgccccttctaccttcttttgaattgaacagaaccacattttcaaatttttttgttaactgtgatttgtactctatgatattatttgacctctgttaaagatgtttgttactgcagtattttgtgccaacaaaaattaggccatctctccaaagatgatatgtacggagcttaccattgttttcattttgtagctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcaggctggatggacactatagcaaacatcaatcaagagctcattaaatatgaattcttccctggaaggccacttcgaagtgaaggaaggactttaaagganatacccccaagtacccctggg

SEQ ID NO: 566021 - DNA, 717 bp, Homo sapiens
ctttttctgctatttttttctcttgtcggttgttgtcttctctgtggtatccccctccctttgtcttgctttgcctggacttccgtgtgtctttctgtcgtcgtcttttctgtgtttggctcttgattccccccttatctggcgtctctttgcctggcttcttgcttcctctggttttgtcttgtatttttttttttcgcgtctggcccctagtgccattattgaccctctacgctggcccgtaggcagctcagtcttttgtccccgtcgtcccgtcctcacgcctgcggcgcctctgcgacccccgtacaccccgggtctaacgaccgacacggtcccagcgggcccggaatgactgacggacggccaaggcgaccgagaccacccgacgtggaccccgagctgttgaggtacttgcctgggacggaattccttgacgggaagcgcggactccgacgggtgtgagcacgccccgcgccagcctccgccgtgccagccgacacacgagtgtgggctgctgagcctgcacgccctgagggcgtgctgggggcgctgactgcgtgtgaaacgcctagagacccacggcgccccaggtgcctgcacgccgcctcttgccaacctgagcactgcccggatcccgtgcatcatgggacccagaagtgcccaccgccatcccgccacaaggactgctccccgccagacgtcagagcaactgac

SEQ ID NO: 566022 - DNA, 209 bp, Homo sapiens
ttgttggcattgatacatttttattcatttgagttatataaatttattaaaatattactcaaacttctattatagtctgctgtcacaaaagatttcctattaacttttctgaactaccctccacttgatactatggcaaaagagagatcacactcagaaacttttccttaagaaagatacatggagagagcctaagaattttaagaatt

SEQ ID NO: 566023 - DNA, 170 bp, Homo sapiens
  misc_feature (25)..(25): n is a, c, g, or t
  misc_feature (65)..(65): n is a, c, g, or t
  misc_feature (72)..(72): n is a, c, g, or t
  misc_feature (98)..(98): n is a, c, g, or t
atataaagtgttaaattaattgatncccagatttcactggaacagtgtcaactgatagtttatgncaaaagnacatacctgtaatattgaaattaganagtgaaatttgtcataaagaatttcttttatttttgaaatcgagtttgtgaatgtccttttaagagagggag

SEQ ID NO: 566024 - DNA, 680 bp, Homo sapiens
tcataagccaggcccctcacccgccttatcttcacccccaagctttctgccccaggcctgaaagaggcttaggcctggactttcctgccactcaaggactttgcagccggcacacgggtctgctctttctctgcccgtgacagacaggctcttagcagcttcccagattgacgaccagtgctgaaccatggaggaagagggacagatgaatgccctggattgcacgtggcctcttgagccgtggctggtcccgggctagtgacttgtgtcccctgatccctgtgttgtctctagagccgggatttacctctgcactactgacatgtggggcccggtcaccctttgctgtgaggctgtcctgtaccttgtgggatgttcagcactgtcccttgcctcaatgcccgtacgcgtcttcctgagtggtgcccaaccaaaaggtttctcaggtgttgcccaatatgtcctggggtataaaactttcctcgcctgacaacccctggtctgtagggatttttggctacacaccaacccgtatcgctcatagatcagccaaccggggcctaactagagtctgaacagctgtaatctatgaattttaagtgaaattttataaaattgttaatttttcctatattgccttaattttaaaaaataaatctgaggccaatatggactctcca

SEQ ID NO: 566025 - DNA, 117 bp, Homo sapiens
tgctcactccccgcccattcccatgtctagaccaccgctactactatgtcctatcataacatttccatatcataccttcaacaaccaatgcaacagggtgcagttccatctgttaaa

SEQ ID NO: 566026 - DNA, 283 bp, Homo sapiens
gaggatcccccaagctgaacttatctcaagttagatgccttgtcctggatatactgatggctttttcccaagttatctgattttataatggatgctcaatctgattcctcatggttacctcttatggaaaaagacttcaggtgattgtttgctctgccactttgcattctttcgatgtagagaaactgtccgataatattatgcattttcctacataggttgacttacaaggagaagactctgttccaggaaccccaccatgatgtccatgaatcccattatg

SEQ ID NO: 566027 - DNA, 211 bp, Homo sapiens
aggaaagacacaaggtataggaccccggtattatttttatatgaaagaagccaggcgtataagaagatgatgaaagagacggtgccacggagctgggaagcctgatcatctgtgctactcagcatgctggagagcatgatcaaagaagccccgaccacacatcgcgcctgacaggcagctgatgatggccaactgcagctcctggcatggc

SEQ ID NO: 566028 - DNA, 354 bp, Homo sapiens
  misc_feature (78)..(78): n is a, c, g, or t
  misc_feature (337)..(337): n is a, c, g, or t
tatacatatgtatatataatcaaactaaaatgaaaactagacatcataattacaggtagaaattcaagctgggtgcgngtgtcacgcctgtaatcccagcattttgggaggccgaggcgggtggatcacgaggtcaggagatcgagaccgtcctggctaacacggtgaaaccctgtctctactaaaaatacaaaaaattagccgggcgtggttgcaggcgcctgtagtcccagctactggggaggcagaggcaggagaatgtcctgaacccgggaggcagagcttgcagtgagccgagatcgcaccactgtacttcagcctgggcgacagagcgaantccgtctcgaaaaaaaa

SEQ ID NO: 566029 - DNA, 596 bp, Homo sapiens
  misc_feature (1)..(1): n is a, c, g, or t
  misc_feature (55)..(55): n is a, c, g, or t
  misc_feature (65)..(65): n is a, c, g, or t
nttataggaggttcagtatgaccactttgaaagttttaacctccaggaggacccncttcatgggnaacccccccatttttgttagcttacctacatgagctcaattagattctccaagtaaatattgcagaaaaatccctatgtgttctggcagggggaaggtgaaatgaaccattttgaaatatgccagagcactgtgctcttcttaacaaggtctgcccccaggagaaattagttagctaaatcctaacctgctggggtattattagagcctgacccaagggaagggaaatacctaactcttgtcagctctaaccttctgcatcagagaagggaaatactaaactccagacaactctagccatcctgtcctaccaaagaggggagaagaatactgaggaaacacttagaagtttgtacaccagaggcatatgcttactaaaagactgagacttaatcataggatgatagaatgtctcccctcccctttcccccacctaactgctacattgctaaaagctgatttataaaagttccttttacctggtacatcatgtccagctaccaagaaaaaattaccaggcataccaaaaggc

SEQ ID NO: 566030 - DNA, 414 bp, Homo sapiens
  misc_feature (161)..(161): n is a, c, g, or t
cccccttcctgccgtttttccggtttaaagggggaatcgggtattgagtttggcccttttccgccccccggggggggtgacccattaaaggaggtgggggttgggccccccctcccaatttggggggaatacccccggggggccccccccccaaggttggnaccgaaattttttcccaggggggttttttccaggaaaggggccctcccaaaagtagttttgagggggggggggggttttttgccccccaaaaacagccctggtcccaacccctggggttctttgggccccccccggcccccctaaattttgcctgaagggggggggggggggcggtttgggggggttggggtagttttccccccgcgggaaaaacccgggggcctttgttttttttaaaaaggggtggcccca

SEQ ID NO: 566031 - DNA, 132 bp, Homo sapiens
cgtatatcattaagagaggtgggattatgagactggaggattttgaacgaactcttaaagtgacatacatgactctgctacaggatcattacattctgaccactacgactggcgaagcttctggccttccat

SEQ ID NO: 566032 - DNA, 134 bp, Homo sapiens
cggtcgcggccttcgcacgcacgacaacggggctgtccctgatagctcccgatggagatttgaggtcgtgaaacctccgcacgagactctggcccggcgagacgaggcgccgtccgatcgacacaagaccgcga

SEQ ID NO: 566033 - DNA, 392 bp, Homo sapiens
agaggacccgagacggtaactggtagattctatgtctttgctatctgaagctgcagtgaacatacgagtgcatgtgtctttttttttagtagaactatttattttctttcgggtatatacccagttgtgggatttctgggtcaaatggtagttctgtttaatgttctttgagaaatttccacagttttctgcagtgactgcttttctccacaatctcttcaggtttttattttttttttacttttaagtaatagccattttgacaggtgtaagatggtatctggtggatttgatttgcatttctctgatgattagtgatgatgaccttttttcatatatttgtgggccacatatatgtcttctttggcgaagtgtctgtccatgtccttggc

SEQ ID NO: 566034 - DNA, 186 bp, Homo sapiens
gacctttgcttacgttttcctgctgaccctcctccccaccataagcctgtagtcctgccccattcccctccctgagatagtaaaaagagtgatcaataaatactgagggaactcaaagaccagtgccgatgcgggtcctccgtatgttgagcgccggtcctctgggcccagtgttctttttctata

SEQ ID NO: 566035 - DNA, 639 bp, Homo sapiens
  misc_feature (404)..(404): n is a, c, g, or t
  misc_feature (445)..(445): n is a, c, g, or t
  misc_feature (452)..(452): n is a, c, g, or t
  misc_feature (461)..(461): n is a, c, g, or t
cacctggtctacctcgctagcatgtctgggcctgcggcaatgactggctggcaatggccctgcgccaaggccaatgtctgctgctcgtcgcgcgccggcctccagttcccagtgggcctgtgtacacctggctgctgcggaagggccactacgccgagcgcgttggctgccgtgcgcgccagtgtacctggcggcagtgctggagtacctcacctgctgagatcctggagctggcgtggcaatgctggccctgcgacaacaagaagacgcgaatcatcccccgccacctgcatgctggccatcctgcaacgacgatggatgctcaacaagctgctgggcggctgtgacgatcgcccagggaggcgtcctgcccaacatccaggcctgtgctgctgcccaagaangaccagcgccaccgtggggccgaaggcgccctcgggcggcnagaaggncacccaggnctcccagtgagtactaatgaggtgccctgctgcctgtggccgggccgccatggcctccccaatgccacccacaaatgggcccttttaagtgtgccaccaaccgcccctcatggacaagagctgagcctgcttcagactgctgttgcaactgctggtgccgcggttcccgttccggcgg

SEQ ID NO: 566036 - DNA, 152 bp, Homo sapiens
atcatacatcacagcactaacaataacaaaagtaataaatcgagacggtccttcatatccggcgtatatgacttttctgactctgacctagggaaggcaccattatccccattttactgctaaggggaactctgctatgagatgttggaagg

SEQ ID NO: 566037 - DNA, 255 bp, Homo sapiens
ctcttgaggatccccggcgcccccgcaagacgagagggtatctgcttgaccgtggatccctggggatctactcctgagttcggagatctcctgctcgggccgcccctcctctgagcggagctttgtggcgctttaagcttacagggcaaggaaaagcctcgccccggcgtctgattcgcggtagccgcgcttgccgcagcctgggatttcctccacgggacccccccgtgagccgccgagtcttgcgtggggctg

SEQ ID NO: 566038 - DNA, 676 bp, Homo sapiens
ggatgggggataaggggtatatgtgggcaatctgtttgctccttttaaaagtaaacattgaataggctgttttaacatgcaaaaaattaatgttttgttcaagaacctcccaatgcctacgggtggaatgttcccccccatcaagcccggggattcggcagtcattacactttgcatagcatagtccaacattcgttgatcccactgcaggcgaacaccctggtcagccttttgaagtagaactgatcaatatagcttgacgagattacaagttacctattccaatgttgtcctgacagttaccatagatctgtctatgcagataagaagtaccgcgtgtctcttctgtgtataacgactaggcagctgttacaaatgcctaagagcagtcatagtgggacatctaaggtcctctgtaaacagttgattagcccacctcagccaaagtgtttcaacccggatttttttcgtttcatgggtctatgaagctgttaagttttttcaagaatggagtgtcccaaccttgagtccaactcaacacttaatgcaatgtcctgtcttgccaatttcttggaatgttaatgaaagccttttaatgtaattagcatggcgctcctcgggccctcacctccttccctggcccctccttgtttgactttaaaaaagggttgttctg

SEQ ID NO: 566039 - DNA, 294 bp, Homo sapiens
gcggcggcggcggcgggggaggggggggccctgccccccccccctccgtaacctttccccgggacctgtgccaagcctagcccttgtgatgcccccatgccccgagggccctttttcagttttggggggatgactccagtccctgcccgccctggccccccctttccggttgtttcccagggggccaagctccagcccgggccagaccccggggccccagggcctttgttttttttttgttccccgcctgccgggccccgggggaaataaacctgcccccgttgttgtttttta

SEQ ID NO: 566040 - DNA, 685 bp, Homo sapiens
ctgaggaagaccggaaagcttatggggccacgtgagccacggccacggcgcataggcaagtcgaccggaagctgccccggcggccgcggtacatgctggttggtctgcatcaccaccggatcaacgttcgacaaataccacccaggctactttgggaaagttggtatgaaggtcattaccacttaaacgaggaacccagagcttctgcccaatcgtgtccgaaccttgacatgattgtggagctctgtggtcatgtgaagcagacagcgggtgaatgcgtgcgtagagaagagcaagacatggggctgtctcccatcagttgatgtgagtgcgatcgggctactacaaagttctggtgaaagggaaagctcccgaaatgcagcctgtcatcgtgaaggccagattcttcagcagaagagctgacggacgaagattcaacagtgtcggcgggcggcctgtgtcctggtggcttgaagccacatggagggagtttcattacttgctaagctactcttgttcatagaatagaaggagccaatgccaagaaagcctcgtggcgtccttcttcctcggggctgcggtcaacaattcgcgtttgcgtgcatggcgctgtttggtgtgtcactcgcttgccttgccccggggttccgtggtgcccccagggggggattgttccaggggtcct

SEQ ID NO: 566041 - DNA, 382 bp, Homo sapiens
tttttgagagacggggtttccatatgttggccaggttgttcttgaactcctggcctgaggcaatcctcctgcctcagcttcccaaagtgtgaggattacagcaggagctacggtggtctgccaacgctcattagcattctaaatcacacacccaccaggggcatgatagtcccagaaacactgatatttggtgtaaaaatgggtggcatcacagtttgagaaatcactacttgcttccaagatttttcatgaatggggccgaggctgaagatttcactctaacatcccaaatttgggaatgtgagcggcttaataaggctttcatcaagacaagagcattctttttctcgtcgacgcggccgcgaatttagtagtagtaggc

SEQ ID NO: 566042 - DNA, 96 bp, Homo sapiens
aattcaagcttctaacgatgtacggggacatgacagtggggatttttttaaatgtctacattctttctaataaactgttggaagacaaaaaaaaaa

SEQ ID NO: 566043 - DNA, 134 bp, Homo sapiens
  misc_feature (44)..(44): n is a, c, g, or t
  misc_feature (46)..(46): n is a, c, g, or t
  misc_feature (53)..(53): n is a, c, g, or t
gcgacctgctcctgtgtatcctccacatgcactaaaaaatcaangnaaactcnacctcttaactctaacacctacaaatactttgttttgatcagtgtaaatcttgtttgctagtgaggcagtttcatgcctcc

SEQ ID NO: 566044 - DNA, 902 bp, Homo sapiens
  misc_feature (902)..(902): n is a, c, g, or t
agatattatactagcatataccatctcacttctagagaatactaatatatcgctcaggacctcgagtatcctaccctaatatgcctagaaggaatagtactatcgcagtccattatagctacctctcataggccctcaagatccattccctcttaggccattgattgtgcctatctgtcacggataactaagttcgtttaggcccgacctgtggaggacatgggttggaggctagcccctaacgttagtgctctagatgctcctagagcatcattattggactgaacagtgacggtgacatgaaggctatacacctaatctgcctaatgtctcataagatcttaaatcgtcgccgaaccaatttatgatttatttagcgaaatggatcatgagttgccacaagagaacacatagtttgaattcaacacaaatcgatccaacagggctatttcttaggtagtcattgcccctcgtactagtatttgttagattcgattgtgcagtcaggagacactattatagcttgttctccccaaacactatattgctcacgaccccgactaagcatgcccttcttcgtatttacataactggcttgagatcactaacctcttcaagaaactggaggggcaagcccaatggctactaatgccacgtgaaaccctactaattccaggaaagaagaatattgcattagccatcttcgttataacgtgaaatcttcacgctaatttaactcttccctgtaaaatttatggataatttcaaccaggcaacaagagaatacatcattgattgtcaatattccttgcttcgggaaatcgatcgaacttaatatcgcctagcgtgtgggatattcgatcaaccccgactgagggcacacaagggccaggaaaagcctn

SEQ ID NO: 566045 - DNA, 259 bp, Homo sapiens
atattttttaaagggattacctataatcagaaagacatcccacctgtcatagcaacaacaaccaaaaaaacagaaaacagtagatcagtactttcaaagtgctgacaaaaaggagttgtcaacatagaattttgcagtcatttaaagtagtgttaaggaataacgtacaaataaagatgttttcagacttatcaggactaagagagtttaaaatttatagatctcatgaaaagactattgaaggatgtatttcttgaag

SEQ ID NO: 566046 - DNA, 546 bp, Homo sapiens
atctcactatagtgtgtttcctaatgtctctgtcagataattccactgtgcatgttattgactgcttggtgtccactgaatggccatttgccataccagtggctatttttgcagcttatccttgaattctcagtaattccgatatgtaccctcaacatgtgaatgctatcttatgagactctgtgttatttgtatccaacacaatatgtttatatatttatttggctatctgtgaactgaggtcttaatatcagctcattttgtctttgcagtggtattcggatctatcctgtgtgtgcctatgagattgtgtgcagtgtatcctgttagctccattctcacggcgttcgaatgtgtattaagaccaccgcaatgaatgctcaagttaaggttgggcgcttgaactcatgtatggacactggaattttgcagtgcctataccttatcttgaactataactaaattgttacatttgaagaatcgtctttataaatgtaccagtatccttgacatccggtaatgttattatccggcacacattttatc

SEQ ID NO: 566047 - DNA, 223 bp, Homo sapiens
cgtctgactgacgtgcatagtctggactctttcaacttatccattctcctccccaaatcctgttatatctgcaaggaaccactttagagggttatctagcccagtcctgccttgcatgatccaggaaaccaaaatctcacagacacagctggccactgacacatgtgaccacgagcacatgtgcaccactgacacatgtgcaccactgacacgagagcaccgt

SEQ ID NO: 566048 - DNA, 372 bp, Homo sapiens
  misc_feature (67)..(67): n is a, c, g, or t
  misc_feature (97)..(97): n is a, c, g, or t
  misc_feature (235)..(235): n is a, c, g, or t
  misc_feature (256)..(256): n is a, c, g, or t
  misc_feature (278)..(278): n is a, c, g, or t
  misc_feature (289)..(289): n is a, c, g, or t
  misc_feature (306)..(306): n is a, c, g, or t
  misc_feature (310)..(310): n is a, c, g, or t
  misc_feature (316)..(316): n is a, c, g, or t
cccccgggtttacccgccccacatccagtttaaaccccgatatccagccaccattccccctgtccanccatccaaggtgttgggcctcagatttaanccttaattggatgtttaaagccatgtacctacccttgttacagttggtttagtgtagtggattattgacatgacatcatgagaagatgtgtaattttatacccacatttataaaacatgattttgttttctacccttncaaggtaacacattccgaatngcctggtcccttgtgtacttgnacatgcctccncgaatttgtagttgggnaatntaatanatctatatatgaaaatgtcaaaatcattttaaaagtattattttcaaataaaatgg

SEQ ID NO: 566049 - DNA, 220 bp, Homo sapiens
ctggaccctcatcattatacttcctcaacgctttatacttcctcaacggcttatacttctcaacgctttatacttcctcaacgctttatacttctcaacgctttatacttcctcaacgctttatactttctcaacgctttatacttcctcaacgctttatacttcccatttcatttcccggtatgaagtataaagcgtttagaaagtataaagcgtttag

SEQ ID NO: 566050 - DNA, 226 bp, Homo sapiens
cccaggtggcagagaactgcagcagacttcatggtgttaggggaacaggaacctaggagagccaggtgacatcgttttaaaatcaacaacccatcttgtgcgggcgcggtggctcaagcctgtaatcccagcagtttgggagaaaaaaattagccgggtgtggtggtgggcacctgtaatctcagctactcagggggctgaagcagaattgcttgaacccaggagg

SEQ ID NO: 566051 - DNA, 104 bp, Homo sapiens
gcccgtcgtggccgagcgggagaccaagtccgtcagcgtcgagggcacctacgacaccgacctgaccgaccgcaagctgatggccgcgctgctcacgcggcagg

SEQ ID NO: 566052 - DNA, 362 bp, Homo sapiens
tgatctagaggatcccttcgattggcgggcacttagtgaaagcccgtctctagtaaaaatacaaaatttagtcagacatggtgggcaggagagagcatgtgcaggcgaacatccatttataaaaccatcagacctcatgagacttattcactaccatgagaacagcatgggggaaactgcctccatgattcagttatctccacctggccccacccttgacacatgggaattgttacaattcaagatgagatttgggtgcggacagagccaaaccatataattcttccccggcccctcccaaatctcatgtcctcatatttcaaaagcaatcgtgccttcccctaagttgcccgccaatcgaa

SEQ ID NO: 566053 - DNA, 309 bp, Homo sapiens
aaattaaccccctaataaaattaattaaccgctcattcatcgaccttcccaccccatccaacaccttccgcatgatgaaacttcggctcaattccttggcggcggcctgattcttcaaattaaccaaaggctttttcctggcaatgacattattaacaaagaggcttaaacccgcccttttaataaatcgcccacatcactcgagacgtaaattatgggctgaatcatccgctacctacacgaccattcgctctcattatactatatctgtctctctctacacatcgcgcgaggtctatataacgcatc

SEQ ID NO: 566054 - DNA, 133 bp, Homo sapiens
tatctggctttgatcattcctagaactctttcgtttctaagagggagtccatttctttgcagtcagatccagcacttttttctggttggaaactcctctttgcctctatgtcttagccatacatccttagcag

SEQ ID NO: 566055 - DNA, 207 bp, Homo sapiens
gatccttactgtgtgtacgtgtcggactgttgtatgcgtagttgagacctggggatccttatcaattaatcgccaaagcgagtgtggaggacttcagcaagctgggggtggcgttcctggaagacagactgcagatggctaatgggctgatagcccaaaagatcgtttgtaagtaactttagaacatgtgtcatacgtgtgggtgtc

SEQ ID NO: 566056 - DNA, 1052 bp, Homo sapiens
caacccacccaccgactaatatattgaagcatgcatcctctcttactatttgtcatatcgaagagtcacacaagcacaacccatattctattgctttgtgcctctagacgttcactccgaaaactcataatatagtgtcccctcgtaaaatcatacatctcacactgtaccattctttttacccaccctccataaaattcccagtgcgtaaacacgcgcgaagtcctgaattctcactgcacgcggatatgctacctacgtcaccgtgaatagaagacctgcatatgcctctctaggtataataacttcctacctacatggtcgtctgttaaattatataacatagcataggtcggtgaactatctcatatatcactgtcttactttgaacagaagagttaatgctccaagcttggcgtactcaatcatccgagtgatggtaacgcacaggagagggcgtgaacgcaggaaaataattgcctatttcttagaatcctgaggtagcgactacgccaatatggactcaatgctatgcgatggtaattattacaacaaccctgacagcctaatggtcagcttaaataacttctaactcatatcaagtcttcaagggccaagaagctattcaagatctcctgcaagccatacactatgatgctggctgatgttaaaccaatacattgatcatgtagagaatgcctgcgttaatcacatccatggtatgatttccctaaaagggttgtgagaaaaacaactaccgcggatgcaaatagtatttaccgtgggtgtactaaaccaagaccgtgggaatatatcacgtgaacgtggtgtaacctgaatacccgaatcaacgtcccggtgtgtccggagcaatatgttcaggacagtgtgaaaaacccaagagggggatcataacgcaatgcgggggaggaacattacaacctgagggggaaacaaagaggaacaaaacaaagagaggcgggaaatagagacacggtaaaagagacacaaagacacctgacgctaccaccccaaacaataccctatctgag

SEQ ID NO: 566057 - DNA, 1285 bp, Homo sapiens
gcagcggtggcgagcctggtactgcggggaatggtgaatcctaggtccctgagctgatcacctccccccgcctccctggcccccgacatggtctcaggatgaagattggagctaagacctaggatgctgcctccggtgtacggggcgggatgctcctggcgggagtggacggtgtgcagacgagttgagtcggcaggtgggcctcacggaggtctaagcagcgcacccgcctgatcacatcggaccgtcagttgacacgttacgtccggtagttccaggtccgaaggcgccgagcctgccatggtcggaatcgagtcacaagcggattcccgagaccgccacggccttgcttgcctgtccgtgccttcccctgtccgcatgtcagctagcacgccgcttgcagccatatcgaaagcaagaagagggcatggacttgatcatagcgacgtatggacggtccacgaacgggatggtgcataccgggcaatgcagcataatggcctactctcctggacaggagggtttcagccttgagtgacaacgatcggtgcgcagaagatccgtgcttcccccaagtcgcgatcgatgtacattcactgtgtcactcgagcaaccggtcatcgcactcgggggcacttggggaagcagtgcttatcggcggcccattcctttgcgaacagtttcgtgtacaagtatgcaagcgggacttggcactccaaagacccgtaatttcccaagacaccaggcggaccccggattgttatccaccccgtgagaaaaggccaaggaagcccgccgtacgcagtcggccttgaggacccagagtcgttcctttgggacccacttgagccgccgacatcacttggtcgacacatgggacaacctcgtactattcacaagcccgagagagaattccaccaaggaggaacattagcactcgacgaatatgcgatagtcagtttccttagaacgcgttcggccaccgcagcacggttccagaaaatccctgtgacatggagcggagcaggggtaactcgtatggggaaattcacgcctttgtatgtgcgagaggcagccggtcgcgaggctgaccgcggaatagctcagtgggatacacgaccacactacatccgatcaagcggtcaagcgactattcacacgcgcgacttctcccgctggttcgtgatcacatgtcgcacaggggagcgttatgccaagtgtacatccaccgtcgagtgcaacattgtggtggctacaggggctgaaaccacagtgcgtcggcaaa

SEQ ID NO: 566058 - DNA, 92 bp, Homo sapiens
agttgcgggtccctcactcggcaacggaacgcaaatcagccacttagaattaaggctaagccctatactagaccaaggggacttaaacccac

SEQ ID NO: 566059 - DNA, 201 bp, Homo sapiens
aatgtggacacctttctgtatgtatgtacacttaaagaagaaaggttaatttaagataaatccagaatgaaagcctctttagtcaactattatgttatttatacccaataattatcttcactatcaagccatctgtgtgacctttggaaaatcacttaatgatctgtgtctatttcttttctttgaggggaaaagaccctg

SEQ ID NO: 566060 - DNA, 312 bp, Homo sapiens
taaaaaaaatgagggcatagggggggggaaataaagtctccctagcaaagtataaaacgacaaaagctatggttcccatgtgaataagattaaatatatataaaacaagtacactgactgtggggtaggttgggaggtgccggaggaggaaagtattggtgctaaaccaccagaaaaaggggctggggggagagggggcccccaattaaaccatcaacgggctgtgctgtccagtgagggcttataaaaaaaaagccgactgtttataaaagaaacggagttggatttgtctccggagcaggtggttaacgt

SEQ ID NO: 566061 - DNA, 755 bp, Homo sapiens
tgcatatttcatctgatatcaaatgtgacatttatagtgctaatctttacctcaagacttcacatctttctggtcgattgcatctttctaggctttatagcatgctaagctttgcatgaaaacaccatgggctgtcccatttcagtcaagaattaatgttcattgattgtgcttctgccctttcatgtcactattgtatgaatttgtcttatatgtttctattgcatgcggaagtaattgtatccaatcttctatataactcaggaatttactctcaaacaacactgtcaattagttacttatctctctggcaacatgatcgtgggacacactggatgagcggacacacgggaggcacacggggcaaaatctgaccacttaaatctaagcatattagattcattttatgctagaaatgtcctgaatgatgtgactttcgtctcttgtaacaatccacctcttctccatgagattcatggcccaacatcagtcactatacataatgagtgggtgacacgtgaactgcatttgcaatatagttcatatcattgctccatcttaactacgctagttcacaaacgtgtgcaatgacatattggtgatccatctcaaataaagaatacatggggaacagaatatgttctgtcctgtgacctttaaagtcttgcgaatattttacatctctgataatgggtgcgtttaataatgaacccttgatactcttggctatcgtatccacctatgcctttctccag

SEQ ID NO: 566062 - DNA, 151 bp, Homo sapiens
  misc_feature (15)..(15): n is a, c, g, or t
caattgtgcaggcanagggctctgaagggaatttttaattggggggcagggagcagttgtgtacgagggaggatttgggccctctggcttgtaggtgacctcttgtcagacaggggaaggtgcgttgctgatatcacagggagcctctaga

SEQ ID NO: 566063 - DNA, 476 bp, Homo sapiens
attccacctccgctaccataatcatcgctatccccaccggcgtcaaagtatttagctgactcgccacactccacgtgaagccatcatcgaaatgatctgctgcagtgctctgagccctaggatccatcttgtcttttcaccgtacgtggcctgacatgggatggtattgagcaaagtcatcactcagactatcgtatctacactgacacgtacgtacgtgtgtacgctcatctgtccactgatgtcgctatcgaactaggacgctggtcattgcgcccatcatcaggaaggcttccattcactgggatttcccctgattcgtcatggctacgacctcttgagaccataactaggccaaaatccattgcgatatcatatccatcggcgtaaatctaactttcttcccacaacactttctcggcccagtccggaatgccccgtacgttactcggtactaccccgtatgcatacaccat

SEQ ID NO: 566064 - DNA, 353 bp, Homo sapiens
ctgtgccgcaggaactgtggcctccaccgacacctgcttcttccctcacctcgcagactttcacacctgtggatctgacactctgtcccgctgtcgcccacgagtaacctaaggcttttggcctgattcgagctcacttcggctaaacctctaaatgccgtgcgaaattcgcatcaacttctctttacaggcatctttatacggaattcaacttgtgccccccacgtggtgtagctctgcttgtggttttgaataccggggcctctttgaatcagaagccctttgtgtagagataagtatcctttaagccacaatcaggctccatttttttcgcagtcccatttcctcccggt

SEQ ID NO: 566065 - DNA, 89 bp, Homo sapiens
  misc_feature (32)..(32): n is a, c, g, or t
tctcagtgagggccatccttgtacaatattcncacaggggtaaatagttacatgaccaacaggcacgacacctggatctagtactgtcc

SEQ ID NO: 566066 - DNA, 1424 bp, Homo sapiens
ctcttcttctctgtttgtgtggttgtcgtctgttgtgtttcttctgctgtcgtagtctgtgctgtgtcggtgctgtccttttgttctcatggctgctgctcctggttgcgggattgtgtgtgcgttctgttggtgcgtggtcggcgttcgttttctgtggtggtgtgctttggttgggtgctctgttcgcgggcggctgtgcgttgtgtcgctctctcgtcgtgccctgtgtttgttggttgccgtttgtcgcgtcgctggttctgttgtttccctgtcttgttgcgctgtcttctttgttgctatttgtgcgggggccggttctcttttctgtttgactgttctagtttggtgtgtgtgttagtggtttgatgtgtgttgtgttgtctttgtttgtagtgttttgtgtgttggtgttttcgttttctttgttttccttgagtgtgtgtttgtttgtctctgttggtgtctttcttgtttgttctgtggttttgtatgtggtcgtttgtgttgtggtgtgtttcgttggttggggggtggtgtgtttttgtttgtttgtgtgtttatgtgttgtggttgttttcgggttttgttgttgttgggtttttgtcccttttgcctgtgtatgtgggtttctgtagtgtcgtgttcgtccgcggctttgttgttgtctggggtggatgttggggggttctcgtgtgttgtcctgtgttgtgtgtttgcgggattgttttttgttttttgttcttttgtagttgtttatgttgatttggttgattggtttgtgtgtttcccgtgctgtcgtcggttatttttggcttgggtggttgttgcgttggtgtggtgtttggccgcgggggttggttttcctgtgtgcgcctccttgttcatgttttcttggtgtttggtccgttcgttgtatgtagccctgtggtcttgcgttgttgctctaccgctgttggtatgggtgttggtgcagggcgcggcggatgccgctgcggtgcccgttgtgtcgggagcttcgcgagtggcgtgttctcgtgccttgggctctctgttgctcttgccaagtcaagtttgtcttccccgtggtaccctgtattgtgttagcggtagtccccgtctcttgtggtggcaggtcaccgtgtagttgtatcgttttcctgtcaggttgtccgcgctgtctccggtacattccgggtccagcggtaccccttgagtgagaatgagtgtggatgtgtaccagttcacgctcctggacggcacgcgggagtctgggactttcccagtaccaatcagagacttcatctacctgttgagtctagttcggaatttttagtatgaatgtgagatttttctcctgacttgtcgaccttaagaatataataaacattcgtgatttatcagtaaaaaaacaaaaaaaa

SEQ ID NO: 566067 - DNA, 411 bp, Homo sapiens
  misc_feature (27)..(27): n is a, c, g, or t
  misc_feature (200)..(200): n is a, c, g, or t
tgaatgtattaatgcctcctgaattgnttcactttaaaaatagcctaagtttatgttatgtgaatctcccctttcattagggaaaaaaagccttttaaaaaagtattggcccaggtgcccatggcctcatacctgtaatccccagcactttgggaggccgaggcaggcacatcacctgaggtcaggagtttgagaccagncctgaggaacatggagaaaccccatctctccaaaaaaatacaaaattagccaggcgtggtggcgcatgcctgtaatcccagctatttgggaggctaaggcaggagaatcacttgaacccaggaggccgaggttgcagtgagttgagatcgcaccattgcactccagcctgggcaacaagagtgaaactccatcacacacgtccaaaaaaaa

SEQ ID NO: 566068 - DNA, 551 bp, Homo sapiens
  misc_feature (33)..(33): n is a, c, g, or t
  misc_feature (80)..(80): n is a, c, g, or t
  misc_feature (87)..(87): n is a, c, g, or t
  misc_feature (96)..(96): n is a, c, g, or t
  misc_feature (98)..(98): n is a, c, g, or t
  misc_feature (105)..(105): n is a, c, g, or t
  misc_feature (107)..(107): n is a, c, g, or t
  misc_feature (123)..(123): n is a, c, g, or t
  misc_feature (153)..(153): n is a, c, g, or t
  misc_feature (171)..(171): n is a, c, g, or t
  misc_feature (181)..(181): n is a, c, g, or t
  misc_feature (192)..(192): n is a, c, g, or t
  misc_feature (212)..(212): n is a, c, g, or t
  misc_feature (215)..(215): n is a, c, g, or t
  misc_feature (226)..(226): n is a, c, g, or t
  misc_feature (255)..(255): n is a, c, g, or t
  misc_feature (261)..(261): n is a, c, g, or t
  misc_feature (285)..(285): n is a, c, g, or t
  misc_feature (292)..(292): n is a, c, g, or t
  misc_feature (325)..(325): n is a, c, g, or t
  misc_feature (342)..(342): n is a, c, g, or t
  misc_feature (381)..(381): n is a, c, g, or t
  misc_feature (389)..(389): n is a, c, g, or t
  misc_feature (398)..(398): n is a, c, g, or t
  misc_feature (430)..(430): n is a, c, g, or t
  misc_feature (449)..(449): n is a, c, g, or t
  misc_feature (451)..(451): n is a, c, g, or t
  misc_feature (475)..(475): n is a, c, g, or t
  misc_feature (477)..(477): n is a, c, g, or t
  misc_feature (479)..(479): n is a, c, g, or t
  misc_feature (486)..(486): n is a, c, g, or t
  misc_feature (514)..(514): n is a, c, g, or t
tagatgactccattctgtgtagggggtcattcncatcttagctccagaacacggaggacctgaagattactcacggattnctccttnaggcagggntntgctttnanatgtggttgctctgtntctgtctccagggccctgaacaccagcctnaggctcttaccaggtgtntggacaggantccaggctccntgcaaagtcctgtggtaccncgngcaccggcagnccggcttatggatgtttttattgtgtgtntttttntagtgtgttttgttttataaagcngggaggntagtgtcgaaaatgaaaagggggttttttagantataattggctgtattnggttagtttatttgtattttggaagtagggagggtaganagggtagnagtgggggnggagattaaatggtaggtgaatggaatggtgnagtggtaagtagatggagngnttgaatgtttgtcacagatgttanantngaagggntttaactccgagtgggtgatgctgtgtngctgaaggtaggaaatgtaatcgaagaaccttgagca

SEQ ID NO: 566069 - DNA, 1226 bp, Homo sapiens
  misc_feature (317)..(317): n is a, c, g, or t
  misc_feature (414)..(414): n is a, c, g, or t
agcgggggccctcccggcccgcgtgaggccgcccgcgcccggcggcggcggcggcgcgcaaggggcccggcgttcgggaaccgagtaaggaacgcgaaggaaccaacggccacggagaggaagaagaggccgccagggcgtggacaggccacccaagaaaggaactcgagaagagcagagctggcggaagaggacacagagccgaggtctcatacggggaccaggcaacggctggctggcgagccgtggggtgtgggctgggagcgaatcttctggtgtaaaaagcgcataccatatgtgtggaaagcgcagatatnagaggggtatcttgggcatttggttggatatgggtggttgcatagggggaggaaggggggggcgcgaaaagagaggaccccccgggcaaaggcgtcntgcgaaagggggaagacgcaaacaaaccggatatgggtgtgaaagacaagggcgccaagacccgccaagagggttgtcgaccgggagcaccaatctccagagagaacccaagccgcttgtagaaagaggaaaggaggcgagaaattggagaagcccgcacattgggtgtgcggcccggcacattgaaacgacaataccgctggtgggtggcgccccccccccgggtgggatagcgctgggcggcaaaacaccgcccggaggagaaaaaccacagggttccacagaacacgtggtggatctcttacccttttcccggtgaaagtgtgtcgtgactagtgcaaaaggttgtgccccgtgaaacgtatttgtgacacttttccgctcttgcccgggaaaattttcctaatggggaagagccctgttgcccaagggggccctcacctggggagagcgaaagggatgtggccacagggagactgtgcgcgttgtgcccttgttgctttaagcgaaaaagggcttttgcgacaacgaagaaagttttaccaatagggctggtgcaatttggagcactggtgtgttggcccccagacggtatcgcttttcgcccttggggaacaccacaggaaatccgcggacgcgtggtagatctacgacggcgccagggtgcttgtgacacctatatgtgttgttcccccaagaaggcggagaattacaaagggggaaccccttggcgctttctcggggatgttgccccgggtggtttctccctgtgaagccttttccctgtggggaaaatattctcatgtgggagg

SEQ ID NO: 566070 - DNA, 181 bp, Homo sapiens
gaattatcatacggggcagctgcaaaggtgggggtcatttgcactgggtccagcgagaaggttttcctttgagttccaaggagcggcttcactcagaccctgaggctcacattcagatgctactggccgccgctttacacattcaagataccagctggaggacgaggacagccaccatcga

SEQ ID NO: 566071 - DNA, 227 bp, Homo sapiens
gggtgggggtttgcccctcccaacaaggcctttgtttcccttggaggggcccgtgtttttttcccccccgggtcccccccccccaaaaagccagggggtcctttggcattcccctttccatgtgcctttgggggggggggcctttttggttttttttttttttgtccccaaaggcccccacccctccctcccccaaacggggggtcaataaaccttttttgggcgga

SEQ ID NO: 566072 - DNA, 336 bp, Homo sapiens
  misc_feature (19)..(19): n is a, c, g, or t
  misc_feature (72)..(72): n is a, c, g, or t
  misc_feature (77)..(77): n is a, c, g, or t
  misc_feature (84)..(84): n is a, c, g, or t
  misc_feature (92)..(92): n is a, c, g, or t
  misc_feature (121)..(121): n is a, c, g, or t
  misc_feature (123)..(123): n is a, c, g, or t
  misc_feature (128)..(128): n is a, c, g, or t
  misc_feature (135)..(135): n is a, c, g, or t
  misc_feature (144)..(144): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (173)..(173): n is a, c, g, or t
  misc_feature (201)..(201): n is a, c, g, or t
  misc_feature (203)..(203): n is a, c, g, or t
  misc_feature (209)..(209): n is a, c, g, or t
  misc_feature (221)..(222): n is a, c, g, or t
  misc_feature (232)..(232): n is a, c, g, or t
  misc_feature (239)..(239): n is a, c, g, or t
  misc_feature (259)..(259): n is a, c, g, or t
  misc_feature (271)..(271): n is a, c, g, or t
  misc_feature (309)..(309): n is a, c, g, or t
acagaagatagcatttgtncagcttcttgggaactggatttgtttattaatgcattttatggccacatgtgnaagtnctaaggntctttgancaacttccttaaatgatgtaatatctttntnccaanaattggnctgggtgtnacacttgtatgcntttnanaggnactggnatgccttttcattttcatcaggcttttnantctgcncatttccatatnngtgggcatanagcctcnagatttctccatcatttgtnactcttgaagtnactctgccaaataactcctgcagctttcctttgaggcnagttgcaacatctccacttcgatcagt

SEQ ID NO: 566073 - DNA, 122 bp, Homo sapiens
  misc_feature (23)..(23): n is a, c, g, or t
  misc_feature (40)..(41): n is a, c, g, or t
  misc_feature (49)..(49): n is a, c, g, or t
actgcctgtacaccagcatttantgagcagcgccggtgannatgaagtntgggtcgagtgtttgggacggggtgagcggatgcgggaggcggcacggtgggccacgctaccatctatcttcc

SEQ ID NO: 566074 - DNA, 528 bp, Homo sapiens
  misc_feature (15)..(15): n is a, c, g, or t
  misc_feature (196)..(196): n is a, c, g, or t
  misc_feature (470)..(470): n is a, c, g, or t
  misc_feature (481)..(481): n is a, c, g, or t
taaggcacagacgtntctccctttcttatttgtacaccttttctcttggcatctcagttggcaagaatctttctccattcctctattccaagcctataaccattttcatttccctattccaaacctttagccatcttcccagccagagagtgccctatagccagagaacaccagggtgtgaaggcaccatttggtnaagcattcatatgttacagacagggacactgaggttgtagaagaggccaagtgaccggtggcagctctgggcctagagctcagagttcctgaatcctcccagatcctaggtcagaggtcttctcactttagctcccctggctttgagatttcaacctgctctgcttcctcactgtcccagattggggagattggactgactttgagagacagttttttgtgccatgaatctccagtcctctgcatctggcagtgggtgaaagtcctttgtaaangctgcctgcanaaggccaggcgggggttttttgacttccaaggagggcatcctgaagc

SEQ ID NO: 566075 - DNA, 443 bp, Homo sapiens
gcatacccataaccagactgattggtaccttcatttttcctaattgctagttcatctgattcattcagcttgtactgctagctgtctcgtccagatcttcctccgtgtcactgatgtttatatcttcttcatcttgatgctgggtctcatcttcatcctcactgctgctcgctgaggtcattgaatatctcccgaagctcatcatgttctaatgagtcatggccctgcctgtgaccagacattcctggagaagagatatccaggccttgattttctgcctcctttgtttcatcttcggcaattatttcccaccgagtactaacagcttcagcatctgtactcagcaatcgtttcacttctttttcaacatctggagattcaatatatttcttctttgctgtcttccggaaccttctcttcctgacattctttagaggcagagt

SEQ ID NO: 566076 - DNA, 541 bp, Homo sapiens
aatcagcataattagtccaaagctatgatctcagatgtaagaagaacagcaaaatcaaataatataataccaaatagaatcttctagtctctctgaggtactaactcatcagctacaaccacctaaaactgaaattatacagtaacatatagtttctattagtacaacaccttcattcttaatgcttcttagggcatcaaaggtatcagaaattaatgtattataaagcattccacagtaatgctcacttacaaacaactgcaatatacatctgcatgtaacactgacatacaacacataagtataaagacacacaatcaaacatatagactcaaataatacaatacaaaaagctacactggacataacaacacagaacttttgaatatccccttatacccaatagttaacaggtagtaacttttaatctaaagagcaagtgatgaaaaatccaaaatttctgcatccagtgtttgactccaactttctacttactcgactcctggatacaccatatcctagaatgagcggggtaaaattt

SEQ ID NO: 566077 - DNA, 214 bp, Homo sapiens
tcctagaggatcccgagcccgatcagtcggagaccatatgatatttttatggtacctgtttcaaaacatatttattctagtttttactagtagttgatgttaattaaactcttggcaatattatcttctttcttataggaaaatataccttaactttttttcttttacactgtgaaactatacactgtataacttctgttactcctctgttatt

SEQ ID NO: 566078 - DNA, 352 bp, Homo sapiens
  misc_feature (5)..(5): n is a, c, g, or t
  misc_feature (282)..(282): n is a, c, g, or t
  misc_feature (333)..(333): n is a, c, g, or t
  misc_feature (344)..(344): n is a, c, g, or t
cgatntcttgacctcttgatctgcctgccttggctcccaaagtgctgggattacaggtgtgagccatcacaccagccaacacacacacaaacaaccccacaactcattgaacagaaacccttgttgccaagggactccagagaaagtctgaaaactgagttcccagccatgactggacaggagcccagacacaccttgttatacccccttcctcactaaccaccatgaggctttcttcccaaagggctaaacaagcaatcagccctttggggaagactccancactgacatcaaccaagttgccaagactaatggccccttccaatttttttncgggtttccancaacaact

SEQ ID NO: 566079 - DNA, 274 bp, Homo sapiens
aggtcggggggtcgacgtccggcctggtggtcttacctggcggccccggtgcgggcaggtcggcatcctggtcagcctgcacgaccagcgcctgtacgtgctgcgcgatggcgtgatgatcggcgagtcgccgctgaaggccgacgccctgccggcgttccagggcaccaccctgttcgtgatggggcagggctacagcgatacgcccagcccgttggacgcgaaccagcgcctgcaccagtggacagcctatccgctgctgggccaggaccgt

SEQ ID NO: 566080 - DNA, 217 bp, Homo sapiens
gaaggttaacgtataagattatacatcatattttaaagtggctcagaatgcattttctggcatagtgtaaatatagactttaaaaaataaaacggttacattgttttttgaaatgtatcaagtggtatgtaaataccttaatgaatagataattaccacgcccaggtaatcttttggattttgatttatttatcaggtcgctcatactactggtggt

SEQ ID NO: 566081 - DNA, 306 bp, Homo sapiens
  misc_feature (166)..(166): n is a, c, g, or t
tgtgagctccttgataaatatccctccattcagaagagaggggactgtaagcttcaaccagagaagagatctgctcctatggacttcccaggagcaagacccctgcccctccaagggaaggccactcctcagggcattcctcctggtgtcacgaatgacctgcgtnttgagttctggcgctttgcacacttactggatggcgtgaaccttgagcgcagtcactgtaatctcgtttaatgcaaggcaggctcacatgtcaagtgaggctcacattgtacacaggaggctcacatgtgctgggttacc

SEQ ID NO: 566082 - DNA, 584 bp, Homo sapiens
  misc_feature (30)..(30): n is a, c, g, or t
  misc_feature (110)..(110): n is a, c, g, or t
gaagaaagctcgagggttctgggcctctcngcttctggagccaggggaaaaaattgccccaggctgaagacaggagggaccagattgctgcttggtgatgcgatctcacngcagaggcagccaggagaccctcctgagacgaatcggagagtccatgctgcttttacacacatcctagttcttttataactagccttttcctattaacggacatcattcaaaagccagttttaagcaacataaatattgaaaacaatactatactatttagaattaattataagttttgtttttaaagcctaaatcttttattgttgtttgaaccctgggcactgaagctaataatgtaacttttctcccttctttcttctttggcatagatttaaagaactgttagactcatttaaaatgctattaggcattttaaagagtaattgttaaatgtgttgtctcttgtgggactggaaatgttctgttcttatctggcgctggttacatcctgtttttcatttgggaaagtgcattgagctggaaatttatatgttcaatttctgtatgtaaattgtacttcagtaaaaattttc

SEQ ID NO: 566083 - DNA, 122 bp, Homo sapiens
tgggtatcattgttggttgattgttataagcttttgacgtacagtagggtccacagtttcccaaggttctggatttttttttcgatcaaggatcacatcggttttccaaagagaatacacag

SEQ ID NO: 566084 - DNA, 108 bp, Homo sapiens
aattaaatgactccgaggctgggacgtctttagaaggcaccgtgtctgcgccgttcggcaagttccaggcagacggtgaccatttgggagatcatcaactcggaatac

SEQ ID NO: 566085 - DNA, 433 bp, Homo sapiens
  misc_feature (136)..(136): n is a, c, g, or t
  misc_feature (192)..(193): n is a, c, g, or t
ggtaagctgatgatacggcactctagttcctaaaactgactgtagttgtcagtgaccgtgtgaggactccaggagaagtcgtggtgagatgcccgctaggatgcttgttttcatttcccagtgatgccttcaactngggcagaactcaggccattcttagagatcggcctacactaagggcagcttcgttgnnagaacacacagcattatttgagttaattggtgcaatctcctgctctggtttgcgagaccatttttgaaagggtttatcaaaacacatctctctatccaaaaaatgtggcagtaacaaatgacaactccttccaaggtaaacgcctgtcataaacttgtcactgtttgtactacatttaaacaaaagtcatcagcagtgttcattggacttgtagctgtacagcacccttcaagggggggt

SEQ ID NO: 566086 - DNA, 334 bp, Homo sapiens
gagacgactatttttaattcgaataatcttaaaaacacagtcatactgttcaattttactaggaactccccattactacaaccatcgctcctgtgaactacacaacctgacacgcatgagggatcgagcacgtgtacacacacagagttcttaaaatctgagccaggtttcaatcacaaagcatcgtaaactcatttctaaatatctaaagacagacaatgcctactgcagaaagagaacctgtcttataaacccaatcccaaaacatttaaaaatatttgggcgcctatattttgctagacttttattctacaatgagatagataaaaatggc

SEQ ID NO: 566087 - DNA, 1354 bp, Homo sapiens
  misc_feature (161)..(161): n is a, c, g, or t
  misc_feature (308)..(308): n is a, c, g, or t
  misc_feature (313)..(313): n is a, c, g, or t
  misc_feature (576)..(576): n is a, c, g, or t
  misc_feature (640)..(640): n is a, c, g, or t
gctcctcactttcaccggtaacaccacatgaagctgtgggaccagctgaatcagactgaggtcacagctctttcatgtcctcgttggtggcacttctctcttagctggcgagtgcacttgctgaggggcttggtgatccctgttcgtacgatgcgactagnagagatctcgcccggtgggcagcatgtctggcctagaaagaacagatgagaaacaaacatatgatcaacggatcgagcgcctaagctttgcccattatagcatcagctcatctataccagtcggagtgttagcttactgccgtatcnaatcncattgattacacagatcaagctgagagacttgaaagctaagatctcgaaatagcgcacacaaaataatcttgtcgttcgtctcgcctagaatgtagcgactttcggcataaactatggtcgtatcagacaatctaggctttcctactcacctcgcgtgtgtaatctcgggaaggacctagaaactatcatttcgaccagcaatggtatagactacaccttgcctaatgcgggtccgccaataggaacaacttttattcgagantcgcattacaaatcgcgcagagaaacttccggggtggatagggcctaccaagaaaatacgcaanagccatagggggccagtcccccagctgcaaaagtcgttcttcttcctctagttaaaccaccgttccaaagagccagttgtcaaccacgagaacccagcaaccacaagcgctttcccccagcctcttgaatatcgcgcatcgcgagcaccacctgggaggggcttggtaatcgctgcaagtgcgtgagcgagctcgcctttgtaatagcctttagggaaggcgggaattggaaagagttataggaaccgagttagggggatgagattcaaaaataacgttttgagttaatccgaaaatatctaagcacaaggccaatattcaacattgcttttaaaactttctgagtggggacccacaggggaaaaagtaaggggtataaacgagaaaaaaaggcaatgaattcaaaaggcgctggaatttaaaaaccggctctgggggcagtgaacaagggagcgggggaatacttggtgggggcacaacacgagtctctggctcggggcattttcaacagggggtccttagcagcgtaggccctttgtgtaacggacggcaagacaacgaacctaacggtaatttggaaaagcctttccctggggcgtcaggcagaacactcggcggaattacagtgtgcctttccgcaacacttggggcgccaaaaattcgggcgaaagaacgtaccacaccgtttgttggaacccgattcctacatcggca

SEQ ID NO: 566088 - DNA, 296 bp, Homo sapiens
ctttgatcctgaaaagatctgggtcagcaggtaagaatacaggaaatggtttgacatgttaattacagtaacaggaagaacacaaaggtagaaacctgtaatggaacgaggaatgaggatatgaaaatgcacacacctacctacaacagtgtagaccctgcctaaggagggccacaaatctggctctaaactagggatgtccaatctttttgcttccctgggacacactggaagaagaactgtcctgggccacacataaaatacactaacactaactacagctgatgagcttaaaa

SEQ ID NO: 566089 - DNA, 364 bp, Homo sapiens
gcccactggccagtgcatccaaaacacattcaggaaacccgagagttgtaagttagcacatgtgtggaccatacagatgacttccatgtagataacagggctgagcaaggcaggactctccaccagacattaaagacattcaaaccaactcatgacccccaggaccgaacacatgacatcgtgttcacatgatcgactgccacagcatggccacctgtgttcagtctccatgaaggattcaccttcatgctctcactgacatctacctatggctacacaaatgtgcaggtgtctcattgtcaaagctaatatttcttattctaaataaacatcctttaatacacatcaaaaaaacaacaaaaag

SEQ ID NO: 566090 - DNA, 289 bp, Homo sapiens
aggtgggaggatagcttgaacccaggaggttgaggagcttgatgctgcagtgagattgtgccactgcactccagcatgggtgacatagcaagactgcctcagggggaaaaaaaaaaaaaaacaccaaaaaaaaaggtatatggaccctagttttggccaggctgtaatcccagcactttggtaggcccaggcaggaggatcacttgagcctaggagttggagaccagcttgaacaacatggtaagacacttgtctctactaaaaaaataataataaataagtatcttgg

SEQ ID NO: 566091 - DNA, 336 bp, Homo sapiens
cccaaattaagttttttggtttgattgcccaccattaaattttttaaagcagttctgatttttggctggactaaaactgtgtcttaatgtatgtgagaaggacctaaaaattttaatccatgtggtcccccccctttttttttttttttgcattgtatgtcaaaagcgcttgttctttcgggcatgtgtaagatttaatggttccattgtattatttgcccatgacattttggagaaacattcccagctgtaatgttgggtatggtagttctccctggatgctagagttttcaaaacccctattcttttaataaattttgccgtgaaaaactgtta

SEQ ID NO: 566092 - DNA, 380 bp, Homo sapiens
  misc_feature (178)..(178): n is a, c, g, or t
  misc_feature (274)..(274): n is a, c, g, or t
  misc_feature (280)..(280): n is a, c, g, or t
  misc_feature (288)..(288): n is a, c, g, or t
  misc_feature (336)..(336): n is a, c, g, or t
tgacctgtaagatagaagcatgaactaagataatgtccctgtgtaagcttcttttacatgagagaaataaactgtgtgtataaatcattgttattttgaattcccaagttgtatgcaggcaaagtgtaatcccagatctagccaggatattggtattattcattgataatgagcttcnatatattcagtgttgacatgttttcctttgatttggcccccatgatgatatggtatttgtgaccaatgacctgtgtaggctatccatgtgtacttnggctcncctatagngagaatccatggatgaaaatggaatgattacagtaggcagcctcctgnagccaatgatacggtatagtgtagggtaggtatgatgaaggacg

SEQ ID NO: 566093 - DNA, 293 bp, Homo sapiens
acccccctcagactgcgcccgatcagcacaggtatctacaaagaagtctgctctgttcctcacaccagctctcagtacctatagcagggcatgaactgatgttccatttttcaaaaatgcacattgtcaagacattcatcggaaaagtgctgccgggctgtcgataccctttggtgtatagcataagctctcccccaaccatcccgatcccttggcacgccacatgcactaagatcaaccctgctatcacaccttgcagagcaactatctggctacgtcagcataacgagccc

SEQ ID NO: 566094 - DNA, 979 bp, Homo sapiens
  misc_feature (337)..(337): n is a, c, g, or t
tattgatggattataactatctccaacattgtggtggccgtgtaggtgctgccttctaatcgtacgatagcatatcatgagacctagtatcatcgcgctagcttcatcatctgtccatcgttcggcgaaagttggtgctgatctattacctgtacgatcatacccattgggattctcccgtaggtctttgaaattcctgttcgagaatgtcctctgcgtctctagagcgtgagatgaatcggatggtcttgcctcgttctatcgaatcttagtgtgtggcctaacccatgacatgaatcttggatcgtacatgaaatatatattcttcccacgtgantctccaaatgaaatatggatataggatctaactgtgttgtgctgttttgttccgtatattgaggcttatcgcgcttgtgaacgttcctgtggcttgcatgtcacgcgggttgcttgcttgccttgtatggaacgaatgtcttgctggtcgcgtggtccaaggagctgtcggatcgaccatggttgtagtacatgtcttagtgtgtatttgacctgcacggcccggagttcttatggcagtctataggtgcttcttttgattccctatatgccctaggcaaatggtgctgccgcttgatctagtccgttacgaaatgtgtatcgcccgtcaacgggttgtcccgtataccgtccgttgctgggtgatgcctgccctgggagaccactctggctcgtgtgtcggacctgcggcctatgtttcgatttgctgagctctatgtcgaacccttgcagtcatcttgccagatcaaactggttatcgtgtcccttgctgatttttggtgcgctcttgccgtttccctggatgtacggtcaggttgggcggggggacctggaccgcagttggttcagtctagtgcacgggggtgcgggggaccggggtaaattcccctgcgccctttgtgggggtgccccccgttttgtg

SEQ ID NO: 566095 - DNA, 263 bp, Homo sapiens
acaggatcatatttattccacttttggcccggggaccacgttggagaagaaacgaactgggggtggaccatttggctttattttcccgccctttgaggaacagttgaaatctggaactgcctttggtgggtgcctgctgaataacttctattccaaagaggccaaactaccctggaagggggataacgcccttcaatcgggtaacttccaggagagtgtcacagagccggacagcaaggacaggccctacagcctcagcagca

SEQ ID NO: 566096 - DNA, 252 bp, Homo sapiens
aaaaaggaggatgaggatgaggactaggatgaagataaggatgaacggcacgatactgggtagaattgacgaaggaactggagagggatcctgcttctgtcagaccgagaccggctccgctcggaggtgaaggctggtatggagcgggaactgggaatcatcatccaggatacagagatagagctggacccagatcggcttgacagaaggagtcatagctgcttcctgctttgtaggatctccacatctcct

SEQ ID NO: 566097 - DNA, 784 bp, Homo sapiens
agcgggtttatctcgttggggactaaggcgtcggttggcgcgcaacggtgttctagcgctgctaggcagcatcgaggacgccgcgggcccgccccggctcgagcgctgggagatagcagaggcagcaggccgtgtcctgggggggcatgtatgctgtaactcagtggtcccaggcgatgttacggtggactagtgcacctggtagggcgggccccgcagggtgaaccatgctgcagctggctgtcgggcatcgtggttatactccttcgggggttacgtgctctggtgaagactatgagagactgggtcagatagatgtgcacatgttcaatgcagtgtccttgcgttggacaaagctggccccggtgaagtctgccatccgtgggcaagctcctgtggtagcctacatgcgctatggagcactcgaatgcgtgcctctatcgacgacacagtgctcctgttggggcgggcggaatgacatccgaaggggtcctgcaatgtgctctatgcctttgacgtcagcggactgtttttccaagtgacatgcagcaagctagataccagcgaccatgacatggactcttatctgtgcaaagggcaggcctgcacgctggagggacttccactcaggcacaatgctgggaagtcacatgtatgtcgttgggggccgtgccgatcgtttgggcatgccattccaacaatgagattactgaaccgcatacgagtctatgacacagaactgaggcttggctggactgtccccgactcagtgctgcttgagggc

SEQ ID NO: 566098 - DNA, 751 bp, Homo sapiens
gtgaggcggctgtggaaggctgagtgagctcaagcccggacaatcccacgttcctgggcggagcctgaccctgcagcgtacctgggaagcgaaaccggcggatgggccgctgagcccgaatcgggcactgtgtggagccccctggagctgagatcaggatgttccgcttcatgagggactgtggagcctgagtgatcccatgttcctgatggcatccctttgctattcacctgtcagcatattgagccgtatgtttgtcacggtggcttttggatatagccccttcctcagcttcacagatggcgacattgccaagggaccagtgccttgcccagccggcggggatgcgacgcaggctggaagcttgtctccccctttgggatgctggcgaatgtcgggtggtttcatggacatgtctggggatggatgaatgacctgatctggaaacatggaacacattgacacgcttgggaggcaattgccagaccttctcatcattccacatgtcatctccttactccaatacgggtgatggtagccccccaaggtctaccaagagacatcacgagactgccgctcggcaccccagggcgggactccgggcagacaagggaggaactgttcgcggattcacaccgtgggcactgtccgccgattgtacattggcccattcacaatccggggcacagggctcaattccttcagcgctccccgaacaccaatcgccacggggtgaccagtgcaggcagcg

SEQ ID NO: 566099 - DNA, 253 bp, Homo sapiens
gcacgagaagaagtttattttggttcacagttctgcaggctgtacaggaagcatggtgctagcatctgcttctggtaagggcctaaggaagcttccagtcatggcagaaggccaagggtgtgcagacctatcacgtggtgagaaagggaacgagagagagaggggagagatgccacactctttttaaacaaccagacctcatgtaaactcattgccacttattattgtggggtaggcaccaagccattcatga

SEQ ID NO: 566100 - DNA, 494 bp, Homo sapiens
tccctgtttaagcttccctcttgatgaacattcttacagattgtggtccacagatgacctgcatcagaatggcttgtgatatggttaaaaatatagactctcagagaggattgtaggaagatggcagagtagcaagcaccaggaacttttctccttacctagacaataattgcacgggcagaatctgtctgatacaactatttgggagttcaggagtctatggaaggcttgcaaatttcagggacagctgggacaataaagtacagttaatttcagtcagtttcaggccttagcacagtaacagcttctccattcttccctgccaaccaagcccatgacaagcagctgtgcatatgtgtccccgaaaaactggcacacagcttataggagccagggtgagcaaagaggaacctttcctccaaataatgggatccatgctgtggtcactgagtgctgcttctgatcacagaagtacagacaaagaggcagcagtc

SEQ ID NO: 566101 - DNA, 474 bp, Homo sapiens
tagaggatccccaagcttttaccgcctgtataattaacgtaattcttagctttcttggattaggctgcaatggattcctgcatctcaatgatcttcgttccttccacattctgaattatttttctgtcatttcagccatctcagcccagttcagaacccttgctggagaggtagtgtcatcatttggaagaatgaaggcactctggcttttgtgttgtcagggttcttgtgcttgttttttctcatctttaggagctgatgttccttcagtctttaaagtggctgccctttggattttttggtatcttttattcaatttatgctcttgagggtttgactgtggtataaggtgggttcagtcaactggcttcacatctctaagattttagagagttaaggctccactcccaactcttggactgcatgttctaactctggggaacttgtatcaggccttgaattcgttttctggct

SEQ ID NO: 566102 - DNA, 265 bp, Homo sapiens
tatctcttgtacataatgcaacaaaaaaacatttaaaaaataaattagaaagctacaacacagagataatgggccctctggttacaagggatcccagcattctagttcagccacctgtgacagattagactttgacataatcagctccagtgaagggaactctctcctgagggagcccattctatttttggagaacttttgtaaggtccctccttgtactgacccttgaatccttctctctgcaattcttgccaattagtccaag

SEQ ID NO: 566103 - DNA, 150 bp, Homo sapiens
cactgtctcacgttttcatatacagccagatcaggttagagcttagcttatgacagatggaggatattcaggagactaggggctctcagctggtcgtattcttcacctggactgggccacttagctttgggggtgagtgctggggagact

SEQ ID NO: 566104 - DNA, 178 bp, Homo sapiens
agtgatctaatataaacataaaactttaaagggtagtttacagggatttttgtgtaactctctatgttgatatttaaacttaaaagagaaaagttgcaagaacagaacagggaactttcttattccttttacacagattccctaattgtttacatttcccccatccgccttatgtatt

SEQ ID NO: 566105 - DNA, 273 bp, Homo sapiens
  misc_feature (138)..(138): n is a, c, g, or t
tttagatcaaacctgttgtcctcagggctgtagttctcgggtggtacgccgtgtgagcgggtatcttgtgtctgttcatggagtacttggagaaaagccgttactttgtcagcgacctgtctcggggtgcagatggtntccatgccgaggagttgcaaacatgctgagggccatttggcaccttctgagtttccataacgaagctccgatatgtatcccattcttctcgtggctggaccctgtcataccaaggctcacttgcgggcgggccac

SEQ ID NO: 566106 - DNA, 1546 bp, Homo sapiens
  misc_feature (272)..(272): n is a, c, g, or t
  misc_feature (1275)..(1275): n is a, c, g, or t
acgtgaatgatgactcccttacctggctgaacgatccctgtcccctgctctgatgctgcactcacccgtctgtgctgaatttcaatgatgctgtccgttgccatgctgtgccctgctgtgtgctgcccaatgttacttttcttcaacgtgtctatacttgtgactcatcgtgactctctctcgtgtgtgcattgagttgaatcgtgaatgacaattttcactgacttgaccaagctgcccctgccctcccctcctgtcctatcaacctgtgnaacggtgttgtgctacctcccttgttgcttgtgttgtccctcatcgataatctccccaaaccctgatcgattgtgccccccttccatgctccactgatggccttcgttgtgcatgacaccttgtgcctgccattccatgacccccatcgcttttacccttccatttttgcccaaaccctgaatgatgtgaaccaatgctgtgccaatttgtgtgtgacctccaattgtgcctctcatcccttttacgcataccccttacaattgttgtcccattgcatgcccaaatagacgacactcttgtgatgccccttgatcgaacatgatacacccctgacgtcaccgtacggttgtcaacttgcagtgctggcgatgctgtgcccatctgccaacgcgatccacgcaccacagcatgtttgatgccattgggcctgcttgtgtgtgtgccaacatgtgacctttggttgtgccccgcttccaaatggcttgggaatgctgcccaaccctttgtgcccgtgattacagaagatgctccttcctacaccttcgattgacccatgcgaagcttgtgaagaagttaccaagtcttggggtggacctctgtgaactgaagtgagggacacccatttgatgcatggtgttccatgacaagccttcccactggtgaagcacagaaggcaagatggcccagttcccctgaccattcccttttaaacgcaggcccaaacctgggaccgtgccgaaaaagtggaaacgccaaagaatggcccaaccccccgcccttagtgaacgaactgtgaccggttcaattccctttccaggccaagccgtgatccacaccaggaattatccccgcgaaatatgggtccttccttcaaagatattcacattccacacacggcgccacactgccaaacacagccactgccacgatacggtaaccaacacatatacccggggcgaaaattctcatccaactggtgtttgggtgcacaaaagtcgacancgacagccgtcgggacaacacgcgtaagggcaatacatcacaatggggcaccccacacaagtcaaacggcgtctggagccatagtatcatagagcgcgacacgcaaccatttgaaacccaggaggacagaagcacatacacccggcctacaagaacatgaacaacttacgcaaacactagcagcacaatatcaccgtagcccgaccgccgccagtctcttacacccaagctgcacacaccgtgacgcagcgacaacaggagcggacacacg

SEQ ID NO: 566107 - DNA, 139 bp, Homo sapiens
tgactttcagcctgcgagccttcttcccagggcgccataacgccccaattccctactgctaaagtagagtggtcttgactagacatgtctcagatagtgacttctcgattcccgacgatctacggccgagactgactac

SEQ ID NO: 566108 - DNA, 111 bp, Homo sapiens
  misc_feature (64)..(64): n is a, c, g, or t
ataagctggaggctgagcagctgtagttactttgtggcatggatccccaacaatgtcaagacangcgtctgtgacatcccacgctcgtgggctcaagatggcagtcacctt

SEQ ID NO: 566109 - DNA, 338 bp, Homo sapiens
  misc_feature (306)..(306): n is a, c, g, or t
cagtggtgctgagccgcctggcgctcatggccttcagcgtgggctggccactggccgaaggtctgcaacaacttccgctggtgtttgtctcccgtcacggcgaaaccccgcgcaccctcgatattctcagcgacctggccaacgacgagccgctgtcgccgacccagttcagcctgtcggtgcataacgcggtgattggcctgtggtcgatcctgcgcaatgaaaccagtgaaatgactgccctcgccgccgccggcgacggcctggaacacggtatgctcgaagccgcggcccttttgaatgaangcccaccggctgtattgctgatcattaccgaa

SEQ ID NO: 566110 - DNA, 441 bp, Homo sapiens
  misc_feature (71)..(71): n is a, c, g, or t
ctcagaggttcccgagtggcagtgtcttcttgtcaacggccttgtattagtgatagtatcttgtctctttnccgtactctagtgcacagcagagacattgagtataccattggcatcatgtcaaagtgacttcaatctgaggaacacctcgggctgcaggaggtatgctgtgagttcaacttgccagcaggttgttatcttgtcatggacgctcgccttcataaactgaataagcacaccaggctggttgtcagaataggtagtgaaggtctgtgtctgcttggtaggaatggtggtattacgcttgatgaggacagtcatgactccaccagcagtttcaataccaagggaaagaggagtgacatccaagagcagcaaatcttgaacattctcagacttgtctccagacaagatggctgcctggacagctgcaccataagc

SEQ ID NO: 566111 - DNA, 326 bp, Homo sapiens
  misc_feature (13)..(13): n is a, c, g, or t
  misc_feature (153)..(153): n is a, c, g, or t
  misc_feature (173)..(173): n is a, c, g, or t
  misc_feature (181)..(181): n is a, c, g, or t
  misc_feature (210)..(210): n is a, c, g, or t
  misc_feature (213)..(213): n is a, c, g, or t
ttggtgctaaccnagctgcttcggccttcaaggtgacctccctccccacggatcctgctctccgggtggaagagcagctttctgtctcccagaaggcatcgcttttccctcttgagcagatcggagcccctgggaggtttggaagctgcctcnaagcctaggacacggaccgnttgccggnggcgtctggcccctgacgctggctgagancangccgtggggcggggttttggggcgtgaacaaggctggcagtaagtggacaagctgctcccctgctaagccctgccctgccctcagccagaggtgccatgccatgcctgcacac

SEQ ID NO: 566112 - DNA, 238 bp, Homo sapiens
  misc_feature (28)..(28): n is a, c, g, or t
  misc_feature (62)..(62): n is a, c, g, or t
  misc_feature (64)..(64): n is a, c, g, or t
  misc_feature (106)..(106): n is a, c, g, or t
  misc_feature (116)..(116): n is a, c, g, or t
  misc_feature (196)..(196): n is a, c, g, or t
  misc_feature (199)..(199): n is a, c, g, or t
  misc_feature (228)..(228): n is a, c, g, or t
tcaaaacaaaaaaagtaggcctttcccntttttttgggggggggggggggggggcagggctntnccctctttaaaggcatttacttgtttaacccttgtccagctncagtgggggncagtagctggctattcccaggcatcatcatagccccctagtttcatattattttccttttgagaaattggaaactctttntgntgctattatattaaaaaagttggggtttnttttttggta

SEQ ID NO: 566113 - DNA, 419 bp, Homo sapiens
  misc_feature (102)..(102): n is a, c, g, or t
  misc_feature (245)..(245): n is a, c, g, or t
taggagctgctgtgagaattaactaaaattaaaaaacccaacaaaatgacaggcagttagatagactgaaatcttttctctttaagagttgtgcttatggcntgagtgcagtgggtcatgcctataatttcagcactttgggaggccgaggtgggaggatcacttgagcccagcagttcaagaccagcccagagcaacatggcaaaaccccaactctacaaaaaatacaaaaaaattagcttggnatgctggtgcatgcttgtagtcccagctactagggaggctgaggtgggaggatcatgtgaacctggggaagttgaggctacagtgagccatgatctcaccactgcactccagcctgctgggcaacagagtgagaccctgcttcaaaagaaaaaaaaaaagtcgtgctatgaatt

SEQ ID NO: 566114 - DNA, 186 bp, Homo sapiens
  misc_feature (44)..(45): n is a, c, g, or t
  misc_feature (158)..(158): n is a, c, g, or t
aataggtgttaggatatgtataaatcttggcttaaaaaaacagnnggataatggaaccattcacagagataatgaacacaggaggacgaacaaaacaaattggggtgtgggttggaaggtgcaccaatggtaggggagttgactgcagtatagaacanctttatttaactatatacttatttttgg

SEQ ID NO: 566115 - DNA, 557 bp, Homo sapiens
aatcctctccccagggcatgaacagaagcttaatgtttacaatgtgcttgaattgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagtggtcctacgaggttaaagaacacacgtgtccactgtatggcttgggccctgagtggccaggaggtcaacttgaccctgccagtgtgcggttggacttactaagacacaggaatcatggttttccttgaccagggtctcacaccctggaggaactgttacgtacacagaaagaacctctttcctgaatatggacatgtcaaaggaccaaagtaattttctggaactctctgcaattctggagaagtctccaaggcaatctaccggggatccaagggctgtgtcacgccatttttccatgaggactttcatacattggactctctcagtcacaggttccattgatgtg

SEQ ID NO: 566116 - DNA, 1645 bp, Homo sapiens
ggttcctatgttctgtcgtgggttccttgtcggtgttagtctctggtgtgggttcttctctctctctggttttttccgttggttcgtttgcagttgcgtctgtgttggtcacttttctttgcttcgtgtgtggttgttgttgtgttttgcttagtggttttgctatgtttgctctatttttgttgtctcggttttgctttgtgtcatcgtcactgtttttctgtcttgtcttttttgtccctctttgtttcttttgcctctctgtctacgatggtctttgcagctgttccctctcgctgtgctctgtttgcgatcctacgtacttgtcccgactcgtgtatatcgtgagcttgtgtttggtatttatgtttattattgtgtatatgttgttgtttgtgtggttgttattgcaatttgtctattagttttttattgtctttgtttgttttttgttttgtgttgttatgttttgttgttttttttgttgaattagaggtttagtgttggtcatgatgtgattttggttttatttttgttgtggttcgattgtttgttttgattggccgtgctacatccaattcgtttgtgattctttctgtggtgccttgtttgcttctgtactgctcctatctttccgtgagtgggtgccccgcctagcgctagtgtctacgctattcgcttatcgaatcagtattgctatctctgtttggtactgttatacgcttagtgtcgttccctagtgattggccgctgccgattttcttcccttctggtcgtgcttaacagttactgtgtcttggtgtcctcgcagtttgattcctctgatgaagccactgtcgtcttgttctcactctgttttagtccgttctttcccctatccggcctctcctgtgttcctctgttttatgtttggtaccgtcttgtttgtgagtatccttgtgtagtctcttgtgccacttatgatcttgtttgcctaagtcagtgtgtctgtgttggcggcgcgtgatcctatgcgcatgcagatgctttacatgtgctcagtccattgtgtagcgttcggtgcgatcgggtttggtcacctctctagaggctcattaaatctggtgactcttgtgacgctaattggaagtaggtacgtggtagggtacttggcgacagtctgttgctcgtggtgtgtgttagtcgtatcttcgctgttgattcttctctggccactctgtatggtaatggcgcttgggcaattgtgcacttgcaagctctctcgggtccgtcctgtcatcaccaacgtatccatctgatggtggtctttgctccaagctgagccgtggtggctactatcagcatagcagtcattggtgtcctgttgtgcgacaccctagactactcagccagctgctgcctatacctgccctggcctattgtgcactgttttgagggggcactaggcaccacacagtcctgggagttggggagatgggtctctgctggtctcacccagcttctctgagttcatgttccgcgtgcactgaactgaatatgtcaccttgctcccaagtacacggccctctctaggaagctcccggagtccccgcctctctcctccgcccacagggttcgtggctacagtacttcgtgggactccccg

SEQ ID NO: 566117 - DNA, 453 bp, Homo sapiens
  misc_feature (453)..(453): n is a, c, g, or t
tttttttacttatgattcgtccgacaaactgggtcgtggacttacctggcccgcgctactccatcttttggcctggaggctattcagcgtgctccaaagatttaggcttactcacgtcattcagcagaaaatggatagtcaaaactcccgaattgctatgcgtctgggtttcatccatccgacattgaagatgacttactggagaatggacagagagatgaaaaagcggtgcatacagacttgcctttcagcaaggactgggctttctatctcttgtactacactgcaattacccccactgaagttaagtgggatcgagacgtgtaagcagcattattgaggtttgaagatgcccgatttggattggatgaattcaaattttgcttgttcgtttttaatatgaaatgctatacacttacctttatgcacaaatgtagggtataataatgttan

SEQ ID NO: 566118 - DNA, 1079 bp, Homo sapiens
  misc_feature (210)..(210): n is a, c, g, or t
  misc_feature (259)..(259): n is a, c, g, or t
  misc_feature (269)..(269): n is a, c, g, or t
  misc_feature (271)..(271): n is a, c, g, or t
  misc_feature (283)..(283): n is a, c, g, or t
  misc_feature (296)..(296): n is a, c, g, or t
  misc_feature (298)..(298): n is a, c, g, or t
  misc_feature (323)..(323): n is a, c, g, or t
  misc_feature (326)..(326): n is a, c, g, or t
  misc_feature (333)..(333): n is a, c, g, or t
  misc_feature (359)..(359): n is a, c, g, or t
  misc_feature (361)..(361): n is a, c, g, or t
  misc_feature (370)..(370): n is a, c, g, or t
gacgacaggccttgaggcccagcgctagctacccaggctctgtccagcagtgtaagctccagcaagctgttctccagcagcactgcttcctcatgagacctcctttggagaaagaggtggaggtgcacagatcgtacttgatcattgacctaactacagccatttgagagtgcgtcatgcccaccaggtttctgcagaatgaatatgccnctcaggtctgagtttcgcttgcaaggcatgtggctaaagaccccaacanttacttcatngngggcacagcaanggtgtatcctgangnggcagagcccaagcagggtcgcatngtngtctttnagtattcggatggaaaactacagacngnggctgaaanggaagtgaacggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaatttttctggggggctgaacactgccctataaacatcgctagagatgtcacaaaaggatagcgctgccaccacttgcctcaaggagccggcaacaccttccaagaagagcagaacatcaaccaccatcggagcacactctggcaaaaaggcatcgccacaggatcacccggcaactagcaacaactcccagggcaacgaactaaccacccgaaacgacagggcacaggaggccccacagcagaacggcaaccagcgacgcgcaacacgcgactccagacaaccccttgcccagaacacgcaatgagcaaacacatcacagcatgaaaacagcgaaaaccgaaccacaaccaggccacaccagcgtcggaaacaccacaagcgcacattagggacaccacaaacacacgcg

SEQ ID NO: 566119 - DNA, 701 bp, Homo sapiens
gctcccagccatggcgtcacgttcgcggcttctgctacatgctggcgctgcttgctcactgccgcgctcatcttcttcgccattggcacattatacgcattctgatgagctgaagactgattacaagaatcctatagaccagttgtaataccctgaatccccttgtactcccagagtaccctcatccaccgcttccttcgtgtgtcatgtctcttgtgtgccagcagagtggcttacacttgggttctcaattattgccccttcttgggcatcattcatacttgcggaggtactatgagtagaccagctgactgagttgggcccaggaccttcctatgacccctacaaaccattccattgaaatttgcagattatctctaagcattatgtgtcagaagggacaggcgactggtggcacaatttcacagctctcttgcatcccttttctagcccatttctcttttataccttaaccctttatttattgggcaatgtgattccctactagttcctgggggatgcgaggccctccttaacgacaccacacccccacccaaggaaccggacactgtgggcccccaggttaaacggcgcccatttgcagagaaaagaggcccaacccaaaaattgaccgggggactcccttatcccacgccaaggaatcccggttcccaaagaacttaggcccggtggaatctctg

SEQ ID NO: 566120 - DNA, 772 bp, Homo sapiens
tagttcgcggctaatatcgaggacaatctcattctcgtactcgtcgatgaaacctgtgtaaattgtgatcgctagggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaatttttctggggggctgaacactgccctataaacatcgctagagatgtcacaaaaggatagcgctgccaccacttgcctcaaggagccggcaacaccttccaagaagagcagaacatcaaccaccatcggagcacactctggcaaaaaggcatcgccacaggatcacccggcaactagcaacaactcccagggcaacgaactaaccacccgaaacgacagggcacaggaggccccacagcagaacggcaaccagcgacgcgcaacacgcgactccagacaaccccttgcccagaacacgcaatgagcaaacacatcacagcatgaaaacagcgaaaaccgaaccacaaccaggccacaccagcgtcggaaacaccacaagcgcacattagggacaccacaaacacacgcg

SEQ ID NO: 566121 - DNA, 580 bp, Homo sapiens
  misc_feature (35)..(35): n is a, c, g, or t
  misc_feature (155)..(155): n is a, c, g, or t
  misc_feature (580)..(580): n is a, c, g, or t
gggggggggggggaggcgtacttaccctatcatanaggagcgttatcacctttcatgggcacgcgctcataatcattttccttatgtgcgttcctaggcctgtgtgcgctttttcctaacactcacaacaaaactaactaatactaacatctcanacgctcaggggggggaaaccggctgagactatcctggcgggcatcatcctaggcctcatcggcctcccatccctacgcatcctttacataacaggcgggggcaacaatccctcccttaccatcaaatcaaggggccaccaaggggactggacctacggggacaccggctacggggggctaatcttcaactcctacatacttcccccattattcctagaaccaggcgacctggggctccttggcggtggcaatcggggaggactcccggtgggagcccccattcggataataattacatcacaaggcggcttgcgctcatgaggtggccccacatgagggttacgcggggggatactacgggcaagggtctgaaatctgggggggaaaccacaggttcatgcccatcggcctaggattaattcccn

SEQ ID NO: 566122 - DNA, 961 bp, Homo sapiens
gttggagacccgggacccggagcagttcggaggaggtgaatagtagctcttcacgtctgcgatctaaaatggcctccgaatcaaaactactagttgcagagccatatgggataaaccatgagaatggaaagagtcaagtacgtttgccagaggcagagcctgcaacgaattcgtcgatggcaaagcacagtactatatcgacgtgtactgaatggcgaaatgtggaaatatttcctgaatagtggaatgggatttacacgatgttgatcatactagttgggagacctgatagaaaatttatgacttgtcccagaactcgatttgaagcttgtttcttaatcgtctcatgagaagttggcaatagagaaaattagatgggtcatctataaaacatgtacatagaatctttactctgggatcagttgcatatcgtgattgcactagtgaaaatctccgagacatggaataagaagattgctgtggtgacaaaccatagaggatttgtcagaagggtcttgatccttgataagaaattaattgggtgagctacaggaccatgttacggttggaagtaatttggaatgttcttccttcattggaaattggggcaagaggcatttccggaatgtagggctagaacctctgagtggctggggaaaaggaagggcaacattattgaaatgtgttccttcaattttggttcaattggcgtgtattgaattgaaagaaggaggaactaaacttggtgaattactttgttccatgaaggattgacagtctcaagttaaagttgttcaacaatttgttccttaataaatataataggtaattaatatagttattttagggatatggggcccgtgagacttttgggatgttaacttagttgtgaagaagaagtatgatacaatgcttaatttgattgaattagaggttgaaaatgcgggtgatggaaagtatc

SEQ ID NO: 566123 - DNA, 151 bp, Homo sapiens
gtagactaacccaggtccctgtcaaatcaaacctggccagagcttcaggctgggttggctagaaaaaccatcaactatgtacgtgtgtgtgtgtgtgtgtgtgtgtgtgtgtgtgtatataaatgcttgtgcctgggttaggtctacctgg

SEQ ID NO: 566124 - DNA, 921 bp, Homo sapiens
  misc_feature (26)..(26): n is a, c, g, or t
  misc_feature (69)..(69): n is a, c, g, or t
  misc_feature (84)..(84): n is a, c, g, or t
  misc_feature (96)..(96): n is a, c, g, or t
  misc_feature (131)..(131): n is a, c, g, or t
  misc_feature (265)..(265): n is a, c, g, or t
  misc_feature (297)..(297): n is a, c, g, or t
  misc_feature (306)..(306): n is a, c, g, or t
  misc_feature (308)..(308): n is a, c, g, or t
  misc_feature (316)..(316): n is a, c, g, or t
  misc_feature (318)..(318): n is a, c, g, or t
  misc_feature (321)..(321): n is a, c, g, or t
  misc_feature (324)..(325): n is a, c, g, or t
  misc_feature (328)..(328): n is a, c, g, or t
  misc_feature (331)..(332): n is a, c, g, or t
  misc_feature (334)..(335): n is a, c, g, or t
  misc_feature (339)..(339): n is a, c, g, or t
  misc_feature (344)..(344): n is a, c, g, or t
  misc_feature (358)..(358): n is a, c, g, or t
  misc_feature (370)..(371): n is a, c, g, or t
  misc_feature (373)..(373): n is a, c, g, or t
  misc_feature (378)..(378): n is a, c, g, or t
  misc_feature (385)..(390): n is a, c, g, or t
  misc_feature (395)..(395): n is a, c, g, or t
  misc_feature (397)..(397): n is a, c, g, or t
  misc_feature (403)..(403): n is a, c, g, or t
  misc_feature (406)..(407): n is a, c, g, or t
  misc_feature (409)..(410): n is a, c, g, or t
  misc_feature (412)..(412): n is a, c, g, or t
  misc_feature (429)..(429): n is a, c, g, or t
  misc_feature (431)..(431): n is a, c, g, or t
  misc_feature (439)..(439): n is a, c, g, or t
  misc_feature (447)..(447): n is a, c, g, or t
  misc_feature (460)..(460): n is a, c, g, or t
  misc_feature (462)..(462): n is a, c, g, or t
  misc_feature (479)..(479): n is a, c, g, or t
  misc_feature (486)..(486): n is a, c, g, or t
  misc_feature (492)..(492): n is a, c, g, or t
  misc_feature (494)..(494): n is a, c, g, or t
  misc_feature (505)..(506): n is a, c, g, or t
  misc_feature (521)..(521): n is a, c, g, or t
  misc_feature (529)..(529): n is a, c, g, or t
  misc_feature (564)..(564): n is a, c, g, or t
  misc_feature (576)..(576): n is a, c, g, or t
  misc_feature (590)..(590): n is a, c, g, or t
  misc_feature (594)..(594): n is a, c, g, or t
  misc_feature (603)..(603): n is a, c, g, or t
  misc_feature (637)..(637): n is a, c, g, or t
  misc_feature (640)..(640): n is a, c, g, or t
  misc_feature (653)..(653): n is a, c, g, or t
  misc_feature (665)..(665): n is a, c, g, or t
  misc_feature (670)..(670): n is a, c, g, or t
  misc_feature (692)..(692): n is a, c, g, or t
  misc_feature (730)..(730): n is a, c, g, or t
  misc_feature (732)..(732): n is a, c, g, or t
  misc_feature (757)..(757): n is a, c, g, or t
  misc_feature (807)..(807): n is a, c, g, or t
  misc_feature (844)..(844): n is a, c, g, or t
  misc_feature (847)..(847): n is a, c, g, or t
  misc_feature (857)..(857): n is a, c, g, or t
  misc_feature (919)..(919): n is a, c, g, or t
tttttattccataatccatttaagtntttaatcaaatacaattaaacatttaaaataaaaatcaactanagtagaaccagaggnggttgtaggatngattttatcaatgtgattaaaaatatttaaaaggnggaacagcttcagaaaaggaaacaaaaacacaaaaaaaatattcaaagtgtttatcaggaaaagaaacactgaatagcactcctagaccacaggcttcttaacatgaaacccaacgaatattcaaaattcaaangtctcagcccttgatattgaggcagtccagangtagaaatncnccctaaancnccnccnnggnggnngnntccnggtcnccattttatcatgntttccattccgnngngggcnatccggnnnnnncttcngngtctgnggnngnngnacagggggcggcacggncnggggggcnttcctccntttccccttcccncncctttgctctagaatcnggaagancatcantnaaagtccccanncccctacaggggggntccagtgnactagtaaaatgcgggctaatcaagataaagtggntccaagaaaggnctttcatggtttgncggngaatcttcnctggtcacccttctggcattagggaaacaaggtngtntgtgttcttctgntgtttctcctcngtccngctcttccggttcccctggggnttctgccccagtccaagacccgatgctggtgccaacananagggtgcaggtcctgccctagaggngctcagcccttgggtctaatccatgattcctttggaatagagcggcccanatggcaccactcaacactgactgcagtcgcactgaanacnaggccagaanaagtgtgggttctactcctgaagcaggcttctagagatcagtatcctcatcacttcattgcnac

SEQ ID NO: 566125 - DNA, 205 bp, Homo sapiens
tcagcctcaggccctcgggcgtctcttcctcgaccagcaggtagcggccggcgcgggctatcacggccgcgacagtcacgttggggcgaaacctctctgtaccagccatgaaacttcctctcgaattcccgcaccgggatggcgcaggcattgtgtaagctgccgcgcaccccagcccctgcaaggaaattccatgcaagttcgg

SEQ ID NO: 566126 - DNA, 133 bp, Homo sapiens
ataaaaacccaattttggggggggttttggccccctaggataggggatggggtggaatttaactttgggaggtgggggggggggggtggtcttttttttccctcccggcccccctaattaaatttccttttta

SEQ ID NO: 566127 - DNA, 112 bp, Homo sapiens
aggttactcgtggggggtccggcgcggttcgcgcggcttgctacgccgtcctccccccgctcttcgtgggcgtcgcgtttggccgtccttgcgcgccggcttctgctgcgcc

SEQ ID NO: 566128 - DNA, 236 bp, Homo sapiens
ggtgtaaatcaggaggcggatctgcgtgagcccgagatcgcaccactgcactgcagcctgggtgacagagcaagactccatctcaaagaaaaaaaagtctacaattaaattggtaaaaagagctggcacagatggctacacacttgcaatcccaaacacttggagaaggccgaggttggttggctttgccttaagccctcaggagtttcgagaaccttccctgtgggcaacatgtg

SEQ ID NO: 566129 - DNA, 122 bp, Homo sapiens
cggcgacctagaggatccccctgcccagcagatgattcacgcaaggcaaccgcatccatatccttctaatagctatcctcttcaacaatatactctccggacggagtgaaccatacaccaat

SEQ ID NO: 566130 - DNA, 583 bp, Homo sapiens
ggaaatatgtgtctcagatattatcctaagacttagagtggagatcagagcctcagctgttgacgaacgctctagcacaagagcagtagagaggggccagttcagaacagataactggcaaagagtgctatcgtgggacatatcacagctgcacgcaaatcacgggtgcacgaaacccactggcttgagtaggaagcctgataggagatatagcaatctatgtactgccattgctgccatgaatgcagccggaacgcaacatgacttcgtaaccacactgcctcatgtacaagacacgcatactgtcactaaaagaacatcaccccaggacaccaaacttcctaacctattaacaaatgacacttaaaggcctgacaacaaaaaacccatgcagcaacactgcccgacaaaacgcaccatggagatagggactgtgacacgcaataatcattcatgcgaaacaaatcgagcttcaagatgtgaacaccatacaacagaatcatgctatctttcacactactctaattacacaagacaccagaggaaaataaccggttacacccagaaaagcaccccagaccca

SEQ ID NO: 566131 - DNA, 123 bp, Homo sapiens
gctggtttaagtaagctaccagtgagacccatgtgatatgcccagctgagccctgtcaacccagaaccatgaggcagaagcagagtggctgctgcctgtttcagtgcctctgaagtattgggg

SEQ ID NO: 566132 - DNA, 334 bp, Homo sapiens
cggacccgtataaaccacagccctgacaagcgtgagtgcatgttgtctgtcggttttttgacaaaggacccagggtttgacgatgacacagggggctgtctttggccataagcaacctgaaatgaggcttggcctccttcccaggatcccacaccatgcctcacatggtagaccccagcgggaagtatgtgactgcctgactcaggtgcctctcgtgagccaagacatccccgccctgtcccttccctgggtgtcgccagacctggagcccctgctccttcactttgcagcctcctcttctgtcaccaactgggaacccacctcttcctgaaag

SEQ ID NO: 566133 - DNA, 231 bp, Homo sapiens
ggcgattttctatattctgatctcagatacacgatcattatatcgagaaggtttggaataaatgggtatatgacatgagatttactaaagggtcccaagatgtccctcgaccaatttgaaattcatcaagactgtccggattctttcggatgtctacacgtcgaattgatacggtctatatcatacctattacagtcgattaccgtcgattcgacctagatatatgagcat

SEQ ID NO: 566134 - DNA, 101 bp, Homo sapiens
gatctacactgggttcgagtcgagatcagctgaggaaggtggcaaaaccctgtctctctaaaaaaaatacaaaaatgggcgggtgcagtggctcactcctg

SEQ ID NO: 566135 - DNA, 377 bp, Homo sapiens
  misc_feature (280)..(280): n is a, c, g, or t
tataagcaagggggtgttcaccaggcggggccagggcatatcaccggagggcagggagtccaaagatcagccgggccaacagggcaaaactccgtctctactaaaaatacaaaactgggccggggcatgggtgggcacatggcgtccaggtcccacctaacagtggggagggcgtggagcccagggaaaatgggctggaacctggggagggtacagagggtggcgcaatggagcgccagggtccatggccacctggggactcccaggccggggtctggancagtggagagaactcgtgcgtcctcaaaaacaacaaaaacacaaaacaacagaggggcgggggcgcgcctcaagagagagaatactccccgagagag

SEQ ID NO: 566136 - DNA, 614 bp, Homo sapiens
  misc_feature (43)..(43): n is a, c, g, or t
  misc_feature (62)..(62): n is a, c, g, or t
  misc_feature (69)..(69): n is a, c, g, or t
  misc_feature (99)..(99): n is a, c, g, or t
  misc_feature (105)..(105): n is a, c, g, or t
  misc_feature (121)..(121): n is a, c, g, or t
  misc_feature (136)..(136): n is a, c, g, or t
  misc_feature (141)..(141): n is a, c, g, or t
  misc_feature (144)..(144): n is a, c, g, or t
  misc_feature (174)..(174): n is a, c, g, or t
  misc_feature (196)..(196): n is a, c, g, or t
  misc_feature (205)..(206): n is a, c, g, or t
  misc_feature (215)..(215): n is a, c, g, or t
  misc_feature (218)..(219): n is a, c, g, or t
  misc_feature (230)..(230): n is a, c, g, or t
  misc_feature (274)..(274): n is a, c, g, or t
  misc_feature (305)..(305): n is a, c, g, or t
  misc_feature (310)..(311): n is a, c, g, or t
  misc_feature (317)..(317): n is a, c, g, or t
  misc_feature (321)..(321): n is a, c, g, or t
  misc_feature (353)..(353): n is a, c, g, or t
  misc_feature (422)..(422): n is a, c, g, or t
  misc_feature (446)..(446): n is a, c, g, or t
  misc_feature (461)..(461): n is a, c, g, or t
  misc_feature (508)..(508): n is a, c, g, or t
  misc_feature (522)..(522): n is a, c, g, or t
  misc_feature (535)..(535): n is a, c, g, or t
  misc_feature (542)..(542): n is a, c, g, or t
  misc_feature (565)..(565): n is a, c, g, or t
  misc_feature (600)..(600): n is a, c, g, or t
actccccctcccccggccatttctggcacagctcctaacccgnccacttcccaatggcacanaaccccnaggccgcatcgtggaaacccaagcataccngcgcgnccagaggatgaagccncccactccaggggtnccccncancccccccgcaacccaggcatgttcatgaanccggggaccctgtacgtgtacntcatttacnncatcgcacntcnncatgcacctcnccacccagggggacggggcttgcctcttgctgcgagcactggancccctggaagctctggagcccatgcctcacntcccnncacccnccgnaaaggcacccccagccgtgtcctcaaggaccncgagctctgcagtggcccctccaagctgtgccaagccctggccgtccacaagagctttgaccagagggncctggcacaggatgaagctgtatngctggagcgtggtcncctggagcccagtgagccggctgtagtggcagcagcccgggtgggcntcggccatgcaggngagtgggcccggnaaccccnccgcttctatgtccggggcagcncctgggtcagtgtggtcgacagagtggctgagcangacacacaggcctg

SEQ ID NO: 566137 - DNA, 421 bp, Homo sapiens
atttgcccttccggggctgaagccttgggatgataatttctaacccctgtagaagggccctggctggaattttacccatgaaaagcctttaactgttttggattcccaactagccgccctccaatgctttgctaaagctggtaaaatggaacccaatcccctcttcaatgggtttggtccccctccaccccctggagctatgccttgattactacggggccacccacgttttcctttgtgaaaatccattacctgccccctaatttccacttttttcccttatgccgaccgggattataatccaaaaacctgtttctgttaattttccccggaaaagctaaaatggttaaaaatgtttataaaaagccttattaaaaaaggatggatgacttaaggatttccaataaaaatttttcttata

SEQ ID NO: 566138 - DNA, 351 bp, Homo sapiens
ctaacacggattcttggtcgattatcacggtctggtgcacgtcacgctagatggagatatccgtcgtaattttggtccagtcgtcacgttgccattcgtagacattcattcattcctattgttatatattacatgcccgaactgccacttgcctcttgtacccaaattccaatggactttcttaccctatcgctggcttgccccatccgtggttttccccagctccgtgttatcggttgtgttttcatcctggacttcagcccgtctccgttgtctccttggggagtagcgggcactactcccttttcgctgtcatagctttttcctgtttaaaaatggggattcccggtg

SEQ ID NO: 566139 - DNA, 2444 bp, Homo sapiens
caccgccaccgcctggtccaggcccaagcccaggccctgcgcggagcggagcggcgcggcgtccacccgggcccagccagccggcgcggcgggggcgggtccaggatcttcggcggatcttcggcggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggttctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctatcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgccccta

SEQ ID NO: 566140 - DNA, 211 bp, Homo sapiens
  misc_feature (37)..(37): n is a, c, g, or t
  misc_feature (123)..(123): n is a, c, g, or t
  misc_feature (172)..(172): n is a, c, g, or t
gggcaatcaccaatctgttctccatttccctaatttnggtgtgtcaagaatgctaaataaaggaatcgtacaccgtgtagcctcttgggattggctttttccaccgagcattaattctctggngattcatccaggttgttgcatatatcagtagttcattccttggatattncatccgggctatggatgtaccaccgttgatttaactctt

SEQ ID NO: 566141 - DNA, 195 bp, Homo sapiens
  misc_feature (18)..(18): n is a, c, g, or t
  misc_feature (53)..(53): n is a, c, g, or t
  misc_feature (61)..(61): n is a, c, g, or t
  misc_feature (81)..(81): n is a, c, g, or t
  misc_feature (161)..(161): n is a, c, g, or t
  misc_feature (172)..(172): n is a, c, g, or t
agctatgccgatttgtgnatgctcgtcccaccccacttctggctccatctacncccgcaancctacaaaaatccatatccntgcagttttgacctactcatctgtagaccttgctcaagagtaattttcgctgggtattaacctttgtacaacaaagttgnttgccaacagntagcattgcaacacggtctctca

SEQ ID NO: 566142 - DNA, 962 bp, Homo sapiens
catactttaacttctatagttttctcctttagagggtcgtctatcagattctgagaggtttacttctcccttgcctttgactcatgggactagtgcagaggctataaagtagtttaaaatgggcttttgcttgtctaggtcataaaacgtaattaattgtagtattctttagccaatagtggctgagtttcgcacttgattttcaatattttatagtacagaaatgacagactgctttgtttcatttcataaacaaactctgcattatagatcactatatacaggttgttaagatgaagattgactgtatctcttgttactcgtaggtacagctgatagtgaaacttgcacattagtacatatacttactgttctcagatgccttaattgtgtaaaatctctggcttcagagtatctaggggaaaggtcgagatatagctcacatataagattccatgtagtaatatactaggtaacatcacaaaatgtatcatggtgccatggcctgtccacgtataaagtgagtgctgtaggattacattcgaaaataggcagaattccattactcacaggtggacacaatacactatactgatgtaatgacatataactgggatgacttccagaaaacatcatgtcaacatatgtagcaattgtgagaaacaaataacacttgaacacaggaatttgaacaatggctagtacagctaaattaactaggaaaatagacagtacaaagtgatctgaacaaatcaagcgataactattgcactattacaaggttattctgagaccatatcggggagaaaaacaaggtatttacacataaatacacaatgtagtacatttctaagagtataataagaataacacacggtataccattacgataaacagataaaaaacgtatgaaacagtctcaatgagctgataaatcgacctccactcctcaataaagtaaa

SEQ ID NO: 566143 - DNA, 265 bp, Homo sapiens
ggccttggacatcgctcgcctccagtacctgtgtggatcctcggcgaagttttcttgggggcctatgtgaacctcttcgaccgcggggacattaaagaccggcgcacgagtgggactggcgcgcgctcgccctccggagcggacctgggaagcgcgagaccggcaggcgcagtaccggggtgccgcccaggtgatcgcatgcgcaccgggtagcagacgtagcgctactcagtaaaaatccaatatttccattgaaaaaaaaaaa

SEQ ID NO: 566144 - DNA, 675 bp, Homo sapiens
gggctgggcaaggcatcagcctcattggtgggtcccctgtgaatcaccacctgagctgcccaaaatggttgctccaaggcacatgtggctatttaaatgtaaataatttacattaaatgttaaaattcagttccttggtcatcccagcctcgttgcaagtgctcaatagccacaggtagccctaacagccatcatatcaggcagtgcagactagaatgtttctgccaacgtagaactgcccttacgttcttgttctggagggaccacgcacaatggctgtgcagtgattaaaagaatcccgcaaccagcaccctgcacctgcctgctttgtgcccagctctgtgcctgtggaagttaaaaatggggatgcaggccccctcttcaggcaacacggtctaattgtgccagtaaaaataacattaaatctcacatattagagatgtgaagaaaaaccttaaatggcacactattaatacccatgatagacttttgaaggataaagaccaatcaaaactagagttagaacctaccatggcacccgatacgatttgacgcttgagttataatggttacaacccagcttttgcaaaggaagtgaacggaagggcccccctgctcctatggaccatcatattcccacaagcactgggaaacgcagcggggggtaaaagccca

SEQ ID NO: 566145 - DNA, 139 bp, Homo sapiens
tttttaaagctgtaataagaataaatcacttttttttttgtcttgtgggatggagtctcgctctgtgttgcccaggctggaactcagtggcacgatctatgggtcacgtgcaaccatcgtgggtaccggagctcgaaat

SEQ ID NO: 566146 - DNA, 142 bp, Homo sapiens
cctcatccccttaccatccaaggggtcacaccctatggtaggatgatctatgacagcacaggggacaggtggcacaccatgagaggtctgcccaggctgtgaacagtgtcactgtgctagcaagagttggcttctcccctgt

SEQ ID NO: 566147 - DNA, 375 bp, Homo sapiens
gagatatgttgtatataatcaggaggagaggaggaggcttaccatttgatatttgctgtaggtgcaagttttgttctcatagggaaatctgacccacctgtcatgttggctctaaggacctcctgttgtagcgctcatcaagagttgactcacgtgcttgttgggatatggaaaggaagaagcacagactcccatcagtcttggaagattgggatgatctcacagcaaaatgactaagttatgtatagcacactctaccatccatcttcagctgactgaatgtgtatgatagccctcctcaaagcagaggtagatgtcaggttcacatggatttctacttattcgttttggatcagctacagatccaggcccttt

SEQ ID NO: 566148 - DNA, 337 bp, Homo sapiens
tcagcgatcttctgcttggatccaaagtgtactttgtatggtgaactaatatagtttactgttgaaacaagtgataaggaattgtgttgaggatagatgttcttaatcgctctattgtaaatgaaacttctcactgagaatatctgaatggttacacccccaataacaagtttatccagaaagcatgtgtcggttatctgcatttcattaaaaaaaatttggtgtagagatagggtaactctgtggcctgggctgtagtgcagtggcatgatcatggctcactgcagcctcaatttccggggctcagatgatcctcccaccgcaatcaagtgggagg

SEQ ID NO: 566149 - DNA, 392 bp, Homo sapiens
ctcatttcagatcgcctcatttcagtttgatattggctgtgggtttgacatagatagctcttattattttgagatacgtcccatcaatacctaatttattgagagtttttagcatgaagtgttgtcgaattttgtcaaaggccttttctgcatctattgagataatcatgcggtttttgtcattggttctgacaaaaaaaggcaggggttgcaatcctagtctctgataaaacagactttaagccaacaaagatcaaaagagacaaagaaggccattacataatggtaaagggatcaattcaacaagaagagctaactatcctaaatatatatgcacccaatacaggagcacccagtccttagagacctacaaagagacttagactgccaca

SEQ ID NO: 566150 - DNA, 194 bp, Homo sapiens
ctccacaggcagctgccgttctcacactgctctacttagactccaatagcagcaccattaagtatctagcactttgtctttgctgtgcaaacatgcaaaaccgcattttatctgcaggcagtgcacaccatccagcatgtatcaggttcatggctccgttttcagcattgcacactaacaatctccagctcact

SEQ ID NO: 566151 - DNA, 399 bp, Homo sapiens
cttgtattatcctcgtccactctactaccaatgccaccaccacatagaatttgcctaaagtacagcagcagcttctggcatggcctcctggactctgactttgcccatggacagtctattctccacccaaaagccagaatgatctttctatttttttgagacagagtctcactctatcacccaggctgcagtgcaatgatgcaatcctggctcactgcaacctccacctccaggactcaagccgattctcccgccctcagcctccagagcagccgggaccacaggcctgcaccaccacacccagccaacctttgtatttttagcagagacagggctccaccatactggtcaggccggtctccaactgctaacctcaagcgatccgcctgcctcagcccc

SEQ ID NO: 566152 - DNA, 156 bp, Homo sapiens
catgagagacagaggatcactgcagcacaccccatgttcatgaagccctctgtataagaccccttattttcctcatctcgtgatagctggatttgtaatttagtagaactactgcctgatcctagagttaaatccattcattaagctttcgctaca

SEQ ID NO: 566153 - DNA, 1070 bp, Homo sapiens
  misc_feature (305)..(305): n is a, c, g, or t
cggacggcgtgggtcgacccacgcgtccggcggattaaacaaggtccgtcatgagtcgggacgcttcgatcacaattgatgacgcctttagaaggatccgagagatcgcgatcattaccattacaggaacacaggaccagatacagaattgcactagtgattatgctgcgagaacgagtgtggaagcagtattctggaaagtcttaccgagacttagttgaagaactgcacaggagtcctggcaatctttgtttactagtatgtaatactggcgttctgtggtgaaagaggcgcccatagattcnctcttgctcctatcagtgttgttcatgccattttgacgggcttgtagctgaaaaatcgttggctggttccaccccaggcatttgtagactggggtgttgcacgtatcgctgtgacgaaaaaccatgggttctgagcggggagtgagagcaagcgtgcgctagcaaaaaaaacttaagctagttggagagatcttgggcagacagcgaggcgacgccaacaagctcgtaggtgggatctctctaataacttattatatcggcggaagtgcgctgaggggggggtgtcctgagaaataattttttcgacccgctaatggtagatttatgttgatagcaaccacccctgtgtgcgataatgaggtgggctcaacgatgctcaacaacatctttcgtgagcgtgagcgttggttgaccaacggggacgcgaaaacagttaaccagaatagcatcgcaccaatgtgtgcgctctgggcccattctgggtttgccagccaagaccaaagttgtttgcccagggaaaagcgcgtaaaagtgggcttccttgtggtgtggtcacagaaaaagaccgctcctctaattggaattgtatatgtacaccaaactttaaacatgttcaggtgttggaaacccttgaagtaagcgggagggggggggcaccaataagtagtgaggtggtcacagagcggacacaacgtccctgtgtttttaacacacatggggtggggccttgggggatatatgccccaaaacccaaaccccgcgcga

SEQ ID NO: 566154 - DNA, 266 bp, Homo sapiens
ttgccatggttctctacctagagccagggatatcggctatgtcgacaccacccatgggaagtgtctacgtatagccagaggggtccagccttgggtcatctgcgatggccccggctttctcatgaactggtaggaaatacgaccttgtgcacatggaacatgtttccatgagcctgaaaaccatggtggaacgggggcacacacaatcaaaaaccaaaacacgcatgaaactggcgttgcgtggggggtcgggttacacttcagtt

SEQ ID NO: 566155 - DNA, 151 bp, Homo sapiens
  misc_feature (42)..(42): n is a, c, g, or t
  misc_feature (139)..(139): n is a, c, g, or t
tctttgcagggtcgcctgtttccaggcagtgcctcacccgangccacctttctcaacacgctcgggtcatgcacatttggcagcacttgtcaaccatgaatcttacaatttttctcatagaatagatcatttgtctttnggagagcttgtt

SEQ ID NO: 566156 - DNA, 219 bp, Homo sapiens
acgacgatgaggaggacaaggaggatgatatgaggaatatgtcccggcaggccaggacgagcctgtacgacgatgcctgtctccagtggctggactgtaggcctgagcgctcttgccgcagagcttgccgcgccatataatgtcgtttgtgacactcaacatctttgcatttttttccaggctggttcggatttggggtggattttggttttgttcccc

SEQ ID NO: 566157 - DNA, 320 bp, Homo sapiens
ggggccaggggggcccggggggggggggggcccccccccccttggggtttttttaatttttttcccgggggcccccccccccccgggggaaccaggggggtttttttttttttgggggacccaaatttagcctttgggggggggggggggggggaagggaacaaccccttttttttttttttttccccccgggggggaaaaattttttggggcccccccccccgggggggttttttttttttttttttggggggacccccctttttccccccggggtttttgggccccttgggggggggggaaaggggggccccccttta

SEQ ID NO: 566158 - DNA, 363 bp, Homo sapiens
aggctagggcatgaatgatactaggaaactggagaccagcgtgagcgacatagtgagacagcatctctactgaaatagattagccgggaatggtagcccacgcctatggtcccagccactcagagaggctgagctgggaggatctcccgagcgcaggaggtcaaggctgcagtgagccacgcgcacgtggccagttctctctctttcatctagctaggagagtacaggtgatagaattacagactctgtttcgtatctgttggagagataactgtatccaattcaatacaactctcctactagaagctaatggccttcagtaggtggaaagctacagctataaagaaaatttcctattgcttg

SEQ ID NO: 566159 - DNA, 340 bp, Homo sapiens
ttctattatattgcatgctcattaaattaaaaaaaaaacctgggtaaactttccatactacacatcatatcagtataaatgtggtaattttaatttcttttcctgatatatacaggcatacttaacaaaatatctattttactttatatttttattattttcatgttttcctttattattattatttttctcttctcttccttaattacatcctttgcagggacatggatgtagctggaggccattatccttagcaaactaacacaaaaacagaaaaccaaatactgcatgttctcactgataagtgggagataaatgatgagaacacatggactcatag

SEQ ID NO: 566160 - DNA, 517 bp, Homo sapiens
  misc_feature (130)..(130): n is a, c, g, or t
  misc_feature (301)..(301): n is a, c, g, or t
tacgagtgtcagtatcaggctgcggttcaaagcgaagtggtggttggatgtgaagtgcaattttagttgtcgtagtaagcacactgtaggaaagtagatccgatgattacgtgcaacccgatgaaatccntgtagccacaaagaaagtggatccatacactccgtcggagattgtgaatggtgcttcgtaatattctgaggcttggaggagggtgaagtatacgcctagtgcaatggtgatggatagtgcttggattatgtgttttcggtccccttctattaggctgtgatgggctcaggnaattctgggcagagaggagtgggtagaggtgaggagtgatgggacagcattaggggttccgggtactgtacgtagaattgcccggctataaagtgtgaggagagaaaggagtggtggccagtgaaactggagacggacagggactggataacgtgtctcagatgccatgtgtagcagttcggatgtttgtacacgtaggctgtgggggcagtccgc

SEQ ID NO: 566161 - DNA, 1802 bp, Homo sapiens
taacgcgacgcaggtcttactactgtcagggtaagacaacgttatgactgtggatctggctgttaaggacgaaccaaacggagcttctacaacggtttgggaggtttacctggtagtacacctacttctacggaacactactttactgcttcttacacgcgtcgatgcttcaccatgcggttctatgtaaggcaaggcaaccatagtccaagtagtagcataggcattcaacgtctcattatcagtcgtttctaccatctatgtagcagtagtcaggcaaatctagacctagccagtgtccagtatagatagtgcacaagcagcatcacacagaacagccaccaggtcatttctcacaacatcgtcacaagccagcattccatttgcatctagcaacaacgcacagtcagtgcacaacacaattcatcagcatggcattgtcttctgcttggaaatcgtaaacgaattcagctccatatatccatgcagcaccagcagtggcctcaagcaattactcttcactgttagctaagaccatatctgaagcatacatcacgttgagtgtgccatagcacctttgaaaacgtaacgcttttctatctcttagtgacattgacagtttacattcccaacagtatattacctcatgtatctcgttgataacgctgttacgaaacaggttccctctttggaccatttagacttcatgggccttgaacactagtatcattacaacacgtcagcagcaaccaccaatcgaggtgcacaggtgctgagagacacagataacacattcacatcgactgctgtgctcatactcgggaccccaatggctcacacccgggcgttccacagcacttcggcaaccccagcattcatacaacactgcgctcagctattctaaaaggcatactgaagggcggcgcacaaataaaggggcgattcaattggaaacgaaaaaatcggggactttaccagcatgtatgcacatacagacacacaactggaatacaaatgaatcattataacagtacaaggaggatgcatataactctgacaacatgacaaccgatcaaggaaaagcaagcgacacatcgcaacaaccacaacacacaagtacaaacataacaaacagaatcaaatgatagaaaactaaacaagcatcagacgacgtgttccgtctcctcctcttcctctcctcccttatttttctttccatcatagaaggagcagacaagcagacgaagcagaggaagacaagaggaggcaagcggcggtagaagagaagaacacagcgagacaagagagcgagagaagagaagacaaggacgagaacgagggaagaggaaggaaacgaaagaagaaacagaggaaagcgaaggaagcgagcggcaggagaagaagagagaagaagaagaagaaaaggacggctagcgaagcaggggagaggagaaggcgagcgagaggacgagggaaaagcgagaagacaggagagcgagaggatgaacggaacgagcaaggagagcgaagcgagagaagactgagcaaaaacagagcagagcgaaccaacgaagaaagaaggaagggagaagacaagcagaaagagcgaggagagacaggaggagagacgagagaagaggaacaaaggagaagagaagagagagaagaacacggcacgaactggagacggaggaggaaagagagaacagaagagcgggacagagacgagagcgagagaagccaaagacagcgcagcagacgacgaacagagaggaggcagaagcggaaagagaaggagaaga

SEQ ID NO: 566162 - DNA, 211 bp, Homo sapiens
cggatgacgaagtgaggtgtgcgtactttcgatgtccgtgccgctcttatcggtctagatgtcgccaacggatgtgtgcgtcttatgctgcgcggcgtcacgccgttagttcggcctgatgatgtactgcgagccttggccacaaggtgtccggcagtcgatgcggcgcgagtgacgcggctggcccaaggggcttgtaacgagggtgaag

SEQ ID NO: 566163 - DNA, 577 bp, Homo sapiens
  misc_feature (265)..(265): n is a, c, g, or t
accagatagtccaacatgaaagtatgtcaccattttccagaccgtgactacagagccattaaacccagcactgggccctgtgtgactatacttgtcgcatgttcatgaagttgatggctctgagcgcttgggtttctccaatggggcttctggcatttttggtgaaaccagtttttccattgtgccaggaccatttaaccatccctggccccccatgcactacatgcccactgtaaccaattcaaaattcccccatgtatttctnaaatgtcccccaaggaggagattgctgctcttcccactcaaactctctagaggtgaccctcccaccgtggtaccagcgtatgaacccaatgagccactaccagagttgagttaaaaaggatttccaaattctcatatccccgggaagccagaattatgatgacttttttcgtattgtccaaataaataatacccacctaccttgatgatgaaaccaatatttgagataaccatttaaaggtggttagtgggttctatgtgtcacatataaatggtagttgactccagatagatgcccatttctgatagttta

SEQ ID NO: 566164 - DNA, 132 bp, Homo sapiens
  misc_feature (79)..(79): n is a, c, g, or t
  misc_feature (97)..(97): n is a, c, g, or t
gatttttacttaaaacgtagaatctgtcactagcagacctgtgctacaagaaatgctaaatgaagttctttagacagangggaaataataccagatngaaacctgaatgttcaggaaggttgggtgaggctc

SEQ ID NO: 566165 - DNA, 121 bp, Homo sapiens
ggcgcgaagatacttccagcagctttgacaacctgtatattgacaggtatacagaggatcaccattgcggcccaaggtgaacaacagtcagaagaaaacgcaattactaaaaaacttgacc

SEQ ID NO: 566166 - DNA, 797 bp, Homo sapiens
gagggcgccccgcaccccagcagtgtgttgcgctggcgccccacataatgtatcccccggggggccacagagggtgtcacaagggcgccccaacaccaagtggtgtgcgaaggcgggcccagatatgccgaacagactcgtgtccgtgtgtggaacacaaaataagagggagcggcgccccaggggaaatagagcccgtggggcggaagagaagagaacacacaaatcgttcgctcggggccacacgtacaccgctctcagatgggtaaccgccccgcagacgattacgtcccaaagaggactagtcgcccttataggccccccgagagaccaggagagcccccacaaagtctctcctgaggagagagtccccccccagagagacgggcgcagacccccaaaaggcgcctgcggggtgtgtgaggtagagagtctgatgtgaaagactgttagaaaggccacaccacagggtggcaacaaacgccccggtgggcgcactcctatggccctacggcgaggcccgccagcagcgaccacacgagtttgaggaagcacgctcccacgacacgcgacagaaagatacactgtgcgtggtgtaaactgtctgtggaccgcataggtaggcatcgacagtgcgcccacaagtggtccgatgtcgagaggaagttcgtgtttcatacacgcaggattgaaagtccatctggttatggttaatccatctcgcgctgggcccgccctgaggaattgtgtaccgcacccacaatcaagcccaagctagttctggccactgcccgcag

SEQ ID NO: 566167 - DNA, 284 bp, Homo sapiens
cgtagtagatatgactcgtatcgtcatattagtaccacgaaagctgagactctggacgagtaatgcaggcgagcttaataagagtgtgacactgactgatgatgactctattgtagtcatcttcaatcgtctgatttcagtgcagctcgatgcgaagttttaatcctgaattgataagggcttggctaagaagaagatcgaggtattgattagtcagaatatggccaaaagtggtcttaattgcaaacattaaaaggaagctaggccagcgtgtagagaagatg

SEQ ID NO: 566168 - DNA, 151 bp, Homo sapiens
  misc_feature (8)..(8): n is a, c, g, or t
  misc_feature (12)..(12): n is a, c, g, or t
gggcgtgngctngcgcccggccctagttgaatcatttttaaaatccattcttgagccgggcgcggtgggtttatacctataatcccagcactttgggaggctgaggcaggaggattgcttgagctctaggagtttgagaccagcctgggca

SEQ ID NO: 566169 - DNA, 712 bp, Homo sapiens
  misc_feature (18)..(18): n is a, c, g, or t
  misc_feature (63)..(63): n is a, c, g, or t
  misc_feature (89)..(90): n is a, c, g, or t
  misc_feature (92)..(92): n is a, c, g, or t
  misc_feature (96)..(96): n is a, c, g, or t
  misc_feature (171)..(171): n is a, c, g, or t
  misc_feature (221)..(221): n is a, c, g, or t
  misc_feature (259)..(259): n is a, c, g, or t
  misc_feature (282)..(282): n is a, c, g, or t
  misc_feature (284)..(284): n is a, c, g, or t
  misc_feature (302)..(302): n is a, c, g, or t
  misc_feature (313)..(313): n is a, c, g, or t
  misc_feature (324)..(324): n is a, c, g, or t
  misc_feature (329)..(329): n is a, c, g, or t
  misc_feature (337)..(338): n is a, c, g, or t
  misc_feature (346)..(346): n is a, c, g, or t
  misc_feature (365)..(365): n is a, c, g, or t
  misc_feature (369)..(369): n is a, c, g, or t
  misc_feature (382)..(382): n is a, c, g, or t
  misc_feature (401)..(401): n is a, c, g, or t
  misc_feature (432)..(432): n is a, c, g, or t
  misc_feature (450)..(450): n is a, c, g, or t
  misc_feature (462)..(462): n is a, c, g, or t
  misc_feature (488)..(488): n is a, c, g, or t
  misc_feature (495)..(495): n is a, c, g, or t
  misc_feature (499)..(499): n is a, c, g, or t
  misc_feature (519)..(519): n is a, c, g, or t
  misc_feature (526)..(526): n is a, c, g, or t
  misc_feature (530)..(530): n is a, c, g, or t
  misc_feature (533)..(533): n is a, c, g, or t
  misc_feature (567)..(567): n is a, c, g, or t
  misc_feature (569)..(569): n is a, c, g, or t
  misc_feature (582)..(582): n is a, c, g, or t
  misc_feature (590)..(590): n is a, c, g, or t
  misc_feature (592)..(592): n is a, c, g, or t
  misc_feature (595)..(595): n is a, c, g, or t
  misc_feature (608)..(609): n is a, c, g, or t
  misc_feature (612)..(612): n is a, c, g, or t
  misc_feature (615)..(615): n is a, c, g, or t
  misc_feature (651)..(651): n is a, c, g, or t
  misc_feature (675)..(675): n is a, c, g, or t
gccaactggttttgctcncaagggttcacggcttcagtctgagaggtcctgggtttgcgctgngggagcccctttttgaatgaaggcgnnanaggnctggactccatgctgactccagttccattggtccctgcagagtgagtctggcctctttcaatggtgtttcctggngcctgaaatggagcactctgatacctggaaccagatgaataccacgagcngtttctgtaacgacccatactgtcatgccgcccttggntcatggggtcattggactttaananttaaagcctatagccctntactcctcgtntgtaccctggnaatanctcccganntggctggnagggctggccactggagtntgcnatggctgcaggantctctcccggtgcaaagtntttcttgttagcacttgtaaggctggggggngaggcacaggtggaagangaagcagcagangcatcacttgggctactcaaggacanagatgtnactnagctacatcttgtttctggncgaaaanctgntcnttggatgagtacacttgttccaaatgaatcaatncncttgctttagggnctctgcgnanganaggtgggccgggnnaancgncccagatcctcatcatatttacgttcactaacaaantgcttgatatcagctctgagctcnaccaatagctgctctgacattggacagccacatgagt

SEQ ID NO: 566170 - DNA, 686 bp, Homo sapiens
  misc_feature (244)..(244): n is a, c, g, or t
  misc_feature (249)..(249): n is a, c, g, or t
  misc_feature (252)..(252): n is a, c, g, or t
  misc_feature (271)..(271): n is a, c, g, or t
  misc_feature (283)..(283): n is a, c, g, or t
  misc_feature (351)..(351): n is a, c, g, or t
  misc_feature (354)..(354): n is a, c, g, or t
  misc_feature (356)..(356): n is a, c, g, or t
  misc_feature (373)..(373): n is a, c, g, or t
  misc_feature (378)..(379): n is a, c, g, or t
  misc_feature (381)..(381): n is a, c, g, or t
  misc_feature (402)..(402): n is a, c, g, or t
  misc_feature (405)..(405): n is a, c, g, or t
  misc_feature (422)..(422): n is a, c, g, or t
agatatagtttatagctgcctggttagaaagtagatatgaagttagttcgtaagctgcttggataaaagcttagatttatatgataggttagacttttatgatagatatttagaataataaacatcaaatgtcatgactatttgtttaaataaacaaacaaatctttcgacaaatatcgttaatttaattagcctaaataatttattctcagttgctaaaaataccaactgttcaaatgacatnttctnacnaaacatggatgaggttacntcgagatgatcnaaaatatcgagatggtgtggaagctttcctcaattttgcggaattttcaatcaaaagagacaaaatgncangnccttgtatgaagtgtgnaaatnnanattttgaggatagaacaatcntgnaaacacatttaattgtntttggtataagacccgattatgatttttggtactttcatggggagaagagacctagaagtaatgacattaatgatgatactgatgatgctgatgatgatactgataatgatgatatcgagaaaaatgatgatgttctacaacaagatgatgaaatcgagaacactaatgttccacaacaagattatgttccacaacatgatgacgaagtattggtggagacctgtaaggatcagtatatggacgaaataactgaaggatttata

SEQ ID NO: 566171 - DNA, 427 bp, Homo sapiens
  misc_feature (340)..(340): n is a, c, g, or t
  misc_feature (368)..(368): n is a, c, g, or t
gagtctcgctctgtcgcccaggctggagtgcagtggtgcagtctcggctcactgcaacctccacctcccaggttcaagcgcttctcctgcctcagcctcccgagtagctgggattacagccacacaccaccatgcctggctaatttttggatttttagtggagacagggtttcaccatgttggtcaggctggtctcaaactcatgacctcgtgatccgcccgccccagcatctgcaacaagttcccagggtgatgccgatgtggctggatctgggagaccacactttgaaaaccactggggttaggtcaaccttatttaaatgaggagtttattcatgtnaacttttatttaaatgtggacagtggantatgtaatcatgggattacaagtaattacatgtttaggcatttacagattcgtccttct

SEQ ID NO: 566172 - DNA, 618 bp, Homo sapiens
gttagagatagtgcttaaaatttttttctattacttctaaggaaataggtctgtgaagaagttctatcttaataccaaaaaaagttagacattaggaatttattgtagttgtagatataaagagaaaaatcatctgattagggtttttgtctgtttcattcactacttgtagtatattgctagtgttatatgagtgaatgctaaaaatgcattcaacaaaattcaatatccaggttttattaaaacaatcaacacaatggaaaagatactttgacaaaacgattaaaaataaaaagcctacccctagttttcatcatacagttggccctcagtttcataggtgccacatctatggtttcaaccaagcatggattgaaaatattcaaaggggaaaacaatttccccaaattccaaaaagcaaaacttgcattagctgagcaccaagtactatacggaatccacatgaatgaagtgatgtgcaggcatcataataggcactccaagtaacctggagatgatttagagtacatgggaggaggtgcgtaggttatacgcaaatactatgctactttatatgaaggaacttgagcgtccttggatttcagcatctgcaggggt

SEQ ID NO: 566173 - DNA, 289 bp, Homo sapiens
taaataatttttaaataaaagcacaaatggcattgcacaataagagattaaaaatttagattggccaaaaacattctcacttcaaagcaattttaatatcttaaaaaaatgtttcaaaattcttgatgggcaaaaaaaacttttaagaatttccctagaattctatcttaggaaaagaaagaaatatttattttggtgatgaactcattatattcatctttaatacactattcctaaaaaaattcaggagaaaaaacaaacgcctgaggaaacaatagaacctcccaga

SEQ ID NO: 566174 - DNA, 207 bp, Homo sapiens
acggctggtgcgttcgtaaaagtcgtctgagcgagtacgggatggttccttctcattctgagcccgggttacgacgttctgactctctcttgtccttccgcctggacctcgaccttgggccctcactcctcagcgagctgctaggggtcatgagcctgccagaagcccctgcagctgagactccagctcccgctgccggttgccatt

SEQ ID NO: 566175 - DNA, 113 bp, Homo sapiens
tcgagcgcccgggaacgcaggggcggtgtggaccgctctaacttggcgaagtccagggcaaagagcgtaccaggcctgcggccacggcgcctttatggacgggtgcgactatt

SEQ ID NO: 566176 - DNA, 211 bp, Homo sapiens
gggtattgctgcgtagtttatggctcccagtagcctactagaccccggacaggtcccggggtgtgatgttcccctccctgctgtccatgtgttctcatgtgttcaactcccactctagtgagtgagaacatccaggggttgggttttctggtcccggatgttacgttcgctaaagaatgagtgctttccaggcttcatccagtgtcccgtg

SEQ ID NO: 566177 - DNA, 892 bp, Homo sapiens
tctcccctccccccctttaaacaatttcccctgccggaggggcttcccggggaaggggaaaagccggtctaacccggtttatccaagggactagagcagactatatggtaaaaaggaatagacatacatacaaaaaagtgaggatagatgatgaagatatgatatatagagaagtagatataataaatagagagaaaaaattatagtataattatgataaaaaaaaagatagaaagctatggtagtatatacaaaattagaaatcaaaaatactgaagtatgaggacacaacgaaacacacacacagaaaaataaagcgtatcccacaatattaatatagaaaaatcacaaaatgtaatagcgcaactgaataactataatcaaggtaagagaaaaaacaaatataaatacggtatccaccacaaaatagaaatacaaaaaaaagataggtaagacgaaagagaacacaaaaaagtaaaaaaaaacaaaaaaagagttaacaacaaaagagaacacagcaccaaaacaaaaaaaaacacaacgagaaaaaaacaacaaaacagaagaacgaacagaaaagataagacaaaacagagatgacatcagaagaaggaaaaagacatagatgctaaaagaaacagtgcagagagataacgtagcaggtataataaggtagtaagaaataaagtatagcaacagagacaatgtataagggataaaaatagatggagaagatatggaggaatataatgaagtagttatgtgggaaaaaaaaagagctaaaactcgaatagaggaaaaaaagcaaaaaaagtaatgtatagaaaaaagtatagaaaatgtaatcagttatagaaaaagagaagttaaaaaaattagagaaatgtgttgt

SEQ ID NO: 566178 - DNA, 946 bp, Homo sapiens
gcttggctggcatgaccctctgcagtcccttccagcgcaacggacgcatgggccgcgcttctcctggacgcgcttgatgcttgcccgttttgccgggtttgcccttagcgcagcgcctgaagccactcatggctcgggccgtttccgaacaaccgttcccaggctgggcctccaagcaacccccgtggccgtccagtttatttcccttccaggaccacttcttcccccttttccaagcggcaaccccggcaacccccccccttaagtttcccacctcatcatcgtctaacaaccactagggcggcccacctgggccattggcgccggccaaccccgccccactttggggccccaaaccggggcccttaaatcgcgtaagtgttaaacccaagccaaattcggtggagttctccacccgcccgggcaaaggacccccgaaacatccaaccgttctccccctggggggccctatttcccccgatgaagggggcacccattgggcccccacctttcccattaccactttccccccatagctctttggggggcaaacccgtttaaacggcccccagtgaaacagcaacgccggcggccctctcggcccttcccatcggcgcctggcgcgttctacgactgtgggcccccttcccccctctggctggtgggccttcccgcttgggcccgcctggtgcccccccgggccgccccccgttggccccgccttctcgtaagcttgtctgccttggacacaacctctccacacccttctgtggagcacccttgccattcggccccgccaaccgttcgggcggcaacccccgttaaccttggtagacacacacccttgggtgcgcaacccttggggcccatagggacccaccacccctatgaaccaaagcacttttcacgtcactagccaatcattggggggactttcccaagaccg

SEQ ID NO: 566179 - DNA, 420 bp, Homo sapiens
  misc_feature (106)..(106): n is a, c, g, or t
  misc_feature (118)..(118): n is a, c, g, or t
  misc_feature (127)..(127): n is a, c, g, or t
  misc_feature (133)..(133): n is a, c, g, or t
  misc_feature (171)..(171): n is a, c, g, or t
  misc_feature (212)..(212): n is a, c, g, or t
ctaacgtacacagaaaactacaaaacactgttgaaagaaattaacacaaataaataaaagaaaagctgtgtttgcagattagatatttcatcttggaatgatgtcnacactacttgangtgacctanattcantacaatccttataaagattccaatgacatttttgatanacagaaaaacctatcctaaaattcatatggaatctccaggncccatgaataggcaaatcaatcttgaagcagaacaaaattaaaggtctcaaaacaattacaaaactgcaataagccaaaaaaaagtggtcatggcgtaaagacatacttggcacacttatggaccaacacaacagagacctcagaaaccaaccctggcatatatggtctgatgatcttccacaaggatgccaagaccactcaatggcg

SEQ ID NO: 566180 - DNA, 327 bp, Homo sapiens
tgcgcagtccctgagtcctgtgagatgaattcacttggctggttatcaggagtggcctgtcccagagcaaatgctgcatgagggtgagaggaaaacagcccagctggagtggtctgtttagaactactggcctgaaaaaaaaaaaaaaaacaaaaaaccagaaaatgaaaaaagctcctgaccaattcagcctctccaggtgggagccaaaaaacctacagttgctatgggaatcacagcttccaggaactgaaggaacaaggcttcgagttagcattttatctgaaaagggaaatctaataggtggactactccaaatacctttgg

SEQ ID NO: 566181 - DNA, 1092 bp, Homo sapiens
agcggacagaagcgagtccgactgtgctcgactgctcaggcgccgcacccggcaagatgaggctctggaccgctgggcagccactgttggtctgcgcctgtcctggggctagtgtctggctgtccctgatacaactgtgatgatggtgtgcaggtgtcgcgaacatgacggccacttaagtgccagagtttcccgcgaccatatgaaacagcgtcattccatccgactggtcccaagtgctgcgcttgtagtaaacgaaagcctaccataccattgtaattgcgactcgagtggtccaatgtagacgggacataagcgaaaggcagaagatgcatgtgcacacctgtgatgctagcgttctggcgtggtatgactgtctttagcctaggctccgcagatataacccctgaaacgcctagtgagcttgtgtcaatgcatgaattctcatagcgcgttgcaacacagcagtgagtccatctacgtacttttctcatccatcgcgtagtcagctactgagttgcagcgtaatgggcactacgcttggcctatcccaggaacttggaaatcccagcacatattcgcaggggccaaatgaaaagctccctatgtccctatccacaggggtatccctacgggcaagtctgtcccggctttggcgggatttgcaaaccgaatccacgcgagtaagggccttcttaacgttgttcactcgttggtagaaaccctttaacggcctttggaggcctccaacctggttaatacacgctgtgccatttttgtacggtaacaatagggcacacgttaggggtcccagagttcatggccgtaggtcccttacacggagccggccaaccggacagttagattaagggccccacccgcattagatggagttggccccgggaaactttagatggcgaaggcacgagtgaagcccttattgccactccgcgccctaagtgtcattcggcttaggtatcgcataaccctgtgggttggggtcccaccaacggcggggagggttgggattggcgcccttcaggtcctacccaccaaaggccccccggatttagataccccaacatatttaac

SEQ ID NO: 566182 - DNA, 828 bp, Homo sapiens
agtgctttcccaaaggtactttatgttacgcaacttaagttaggtcgtagattacatttcccccagcacttttataaaataaacacttcagtcttcttgcgggggccaaacatgtcataattcaagcctggggataatctgttccatgcaggtttagaattcatctctatatacaagtccacgaatttgctcctctcgccgtgttccctcccgtactgggccttcccccccccaggctacggttcacctgtaaacttggtcttaatagtcagtttgttttggaatagttgctgtggtactataaagccaataacaatagtatacacacatttctttttcttctcagtcaacagcatgtgtattgaacactctggcatgagatgcctgtggatggagtgaggttggagtctcgaaagacagaagcaagcgctggcctggcccttgaaagaaccgaagtctttcccattcactgtctctagaaagctggccaagacagaggctagtgaagtacaactggatgatagttctctgtcaagcgacacttctgttctcgtagaaccttagaagtgtttctaagaggacaacaagtaatgaagtagtaaacagttacgctgtggaattccacatctttggttggatcgcattggctttttttttcttgttttgatagacatggaattacgcaaaagtagtttttgtcttttcgtgttgtcttcatattttatgccgttgttattgttaatgtaatcccgttcaattatttaattgttatacaatgacattactgctgtatttgacgttgttaactctgtgtctcgcgcctgcttc

SEQ ID NO: 566183 - DNA, 379 bp, Homo sapiens
tcgtctattgataggcagaataaacgcagcagagctcagacttcatagcagcagtcatagtaattctagcaacagcaagggaagtttcggatgctcacccggaagtcagattggagcccatgttggcttaaaaccaggaccggcccgttcacagaacagtaatccctctttaaaacttaataattctcctaatgaaggtaccggaatattcctagcacacaggtcctgtcttccaggagaccggttacttctggattggcaccaggcccagatgccaaccatttcttttcttctaatatttcgacattaagcttctccgttggcatgacaagtaagtggctgttattaataataacccgatcttattccaaacattccc

SEQ ID NO: 566184 - DNA, 737 bp, Homo sapiens
tggaagtgaacataaacccaagattttattggtcttcataataaaagctattagtggggagtagatgttgtgaagcccttgagaagaggtaattatggaggcgatctggtgatgtgctgtccgtaagttggagtttgtgcataggcagaaaatagtaagtgaggagtgtaagtctccgggggccgattatgaaaatgacgtgcgcccggttggaagctctcagggggtttgggattgaaaagtggcgtgtatacatacgaagggcatagtggtggtctgatgtgaagagttatgcaagtgagcagattttacaggtcctgagtgttggtccgtaagcgcagaatgggactcttggttcatatatttatgcctccataagggtatatgtacaaggaaagtggtgtaaggctaatgtggttttggtccagggtgtgtttgaacaatggagtggtagaggcgttatttatacccataagccgcctaagtttataagagtacggcggcaagtactatgtgacccagcgagtggtgggcttcgacagtgggcttaagggagtcaataaggggagtccgtaaagaggtatctttactataaacagctattggtgtacagctagtcatataaaagtcgtgggccccgggagttttgatagtcccttgggcagctgagagtgcatagcagaaggtttaggggaacccaagggtgttgtgcgctgtaacaggccacacgcatggcc

SEQ ID NO: 566185 - DNA, 221 bp, Homo sapiens
aatcttcatgcaccagtcgtgtgtgtgcattccatgtgtactgtgtctttgtgtgtgtgctgtgtgctagtgtgtgtgctgtgtgtgcatgtgtgtgcgtgtgctgtgcgtttgtgtgctgtgtgccgtgtgtgtgctgtgtgtgcgtgtgtgctgtgcgttagtgtgtgctgggggtatgtgtgtgtgctgtgtgtgcatgtgtggatatatgtgccttt

SEQ ID NO: 566186 - DNA, 244 bp, Homo sapiens
atgatgaggcgcacgtgtgtgcgcgttcaggtcaacttctggaatttctgcttcatttcttgaatcaatctgtctgttcaggtgtcagcactagactattttaatccctgtatgtatgtatgcatgcatgtatgtatgtatctattatgagacggagttctgctcttgttgcccagagctagagtgcaatgatgcgggctcgactcactgcaacctccacctcctggagtcaagcgattcattc

SEQ ID NO: 566187 - DNA, 1191 bp, Homo sapiens
  misc_feature (300)..(300): n is a, c, g, or t
gctgcacttgtagttggataatccatgagatccacgctgacattggaggctactctccaggatcaattagaagcaccccaattataagcacgtgatactcgtgcttagtccacacgcagttcgacacgttagttttaggagcgtcgatgggtcattagtcaaccttgtccggcatctgataagatggataaagacccctaccaactaaccacatgacagcgaaacggtaatcccttataggctgctggggtctcaagcttggcagcagctcgacgagttacaaagtttacggaatggatngtcacagcttttggaagagccaggggactcgtgtcggtggacgagattgccacattttcgcatatacgagaaactatgtaagctagattcttagggagccaatgggtgcgtaacagggtcttgagagcgtgaagtcctactggcctgtgcgtcctgcaagtcaagtcaaactaatggacaacttgagcccagggcatgcaagactacataatatgccgcccgactgttatgaagcgcccatggagcagcgaagctggatgcctaaaatgcacacaactggatcgtaatactgggctaaggaagccacctgaggtattagggccgtggatgccgtagagagatgctcacactgcgttgactcttagtgcgagtgaaacccatcaagaccgcaaaagtggtgccttcctaagaatccctggacaatcgccatcgttggctcgcacttgtgggccgcgacgtgtcccctaaggcggtagaagctcaagttccgactctggcagagggttttaaccaaaggaaagataggtcgatttggtacaaccggcgcactttgaagtcaacgaagattttgaaaaccatagggggaaaaggaaaaggggattagtgctccttacacacacctctgatggacccgaagtgttctagcaataacccttaacccaatgggacttccagtggggtccagaactgtcggtccagatgattagtccaaagggatcggcctcccataagctacccgcaaatacccaaaaggccaagtctcgtataacgtgggagctccaagggagaactattattcaggagagaaacgatttttggtggccgacatatcatggttaccacgcagtgaaccagaccgggccttggttcacccaagatgtttggcttcca

SEQ ID NO: 566188 - DNA, 1043 bp, Homo sapiens
  misc_feature (39)..(39): n is a, c, g, or t
  misc_feature (1043)..(1043): n is a, c, g, or t
atttgggagacagtgtctgtgctcggtatacccaggctngagtgctggtggtgcagccacaagctcatgtgcaaccttgaccttctgggctcaagtgatcttcccacctcagcctcccgagtagctggtatgacaggcacaccaccagcgtctggttaatttttaatttttaatagagacagggtctcactgtgtggtccaggcgtgatcttaaaactccgtgacctcaagtgatctacccacctgtggctcccaaaattctgagattgcaggcatgagacaccaaacctggcctatacaccttttctttggtctaccctttggtatcttctaaatttggtatcatatgcatatattacttattaaaaatgaatggtaggccgggcacagtggctcaggccggtaatcccagcacttgggaaggtcaaggcaggtggaacacttgaggccaggagtttgagaccagcctggccaacatgtgtgaaacccccgatctctactaaaaataccagcacagtcacccgggcatggtggcagggctctgtaacttcccaagctaatcgggaagactgagcaaggaagcactcggctgacacccaggcaggggagctagagtgagccagatcggcgcatgatcagccgggagaaagggactcaccaaacaaaacaaacaacaaaaaggtggagcgtcacggaagcatataacacctgggggggccctcggataccatgatccgtcacaaccccgaccaggcggtgacagaacacccccgggggaaccggtcactggagctcccgcacccacccgtgagggtgggacacaaatacgagacagaactagcatagatggacacagagacgacaaacacatccgaagagcgacacagacacagaacgagtcgcgacagatacgagagcagagtaagcgagcaacagcgcaaaaagacagcgaacgaacaagagcagcagcgaaccacggcacgcagcacgcagcgagcgacagcgacacaccaacacacgacagacagcagcaccacaggagn

SEQ ID NO: 566189 - DNA, 707 bp, Homo sapiens
  misc_feature (463)..(463): n is a, c, g, or t
catggtggctcacctgaggtgagcagcactttgggaggctgaggcgggtggatcacctgaggtcaggagttcaagaccagcctggccagcggggtgaagcccgtctctggtaaaaatataaaaattggcgggcgtggtggtgcaggcctgtgatcccagctgcctaggaggctgaggcgggagaaccccttgggccagggaggtggaggttgcagtgagccgagatcgtccagcctgggcagcagggcgagactccatctcaaataggataaccataaaataataacaactacacacagattaaggtaatacagaagactatcctaacttgattacttaaacatcagaacaatacactttttttccataaagtgaacagcaagtttattcaagaaacagtcaaacgaagcaaccagaacaatccacctttcatatatttaatcaaatctcttctaaagcatgngcacctggctgcatttatgcaagttgcattgaaaaaactacattttagactacagtgactattttgacctgtaactctgatcaaaactgatcttttatttcaatattgatgggagggaacaaaagaaaacaaattaatcttttatgcattttgtagtcaaaatccatttaggagaatataaattgcagtaagtaataaatttggcttgttattacatcagattatttacttctagaacttctaa

SEQ ID NO: 566190 - DNA, 93 bp, Homo sapiens
ggtcgacgcctgggaactgcaggagctgcccaggttatggaaggcggccaagtggaatataagcccctttcgggcattcggtacatgtggtcg

SEQ ID NO: 566191 - DNA, 399 bp, Homo sapiens
  misc_feature (58)..(58): n is a, c, g, or t
ggacaccatgccccctagcgggtagcgggaagatgcaaaagctctgaacacagattgnggtgatgattgcaaaacaatgtgaggatgcttactaaatgccactgaactgcacacttaaggttaagacagtaacttacacgttatgtgtatttgttttgtttttggtttgtttttgagacagggtcttgttctgttgcccaggctgcagtgcagtggtgcgatcatggctcactgcaacctccgcctccagggttcaagcgattcccctgtctcagcctcccgagtagctgggattataggcgtgtaccaccacacccggctaattttgtattgttaatagagatggggtttctccatgttggtcaggctggtcttaaactcccgacctcaggtgatttg

SEQ ID NO: 566192 - DNA, 236 bp, Homo sapiens
tcgctagcgactcggtcactgttgcctcgagccaaaagccagcatctccaacacaacagcacacatttttttttcaacattgcagctgggtgtctggcatgcatctcgggacccagctacttggaaggctgcggtgcagaagcatccacttcagcctgggaatttgcaggcttcagtccagctcatgcattgtatccactgcactcccagcctcaggcccaccaggggcatcctct

SEQ ID NO: 566193 - DNA, 381 bp, Homo sapiens
atggcagcagaaccactgcaaagcctaaaggagtcccttgagaccgtggtcaccccctttttcacctttgcaaggcaggagggccggaaggatagcctcagcgtcaccgagttcaaagagctggtttcccagcagtttccccttcgcccaaggatgtgggctctcttgattaaaatatggacagcttggatgttcatcaggtttcggagctccagttcacttagtccttgaaatttatttgggagctggcccaggaaatcacccattaacaatccttgaagatcaggaaacagtaaaaccctccgcctcaatcgggtgggcaaggccaactttttccgggcttgacaacacaacactctttcgggcttaaaattcctccat

SEQ ID NO: 566194 - DNA, 1106 bp, Homo sapiens
gccggttggcggactccagcagctgtcggcttctctacgcagaacccgggagtatggagactcagaatcgaatctcttctccctccccttcttgtgagatgctgtgatcttcagctacatgttcggctttgtgagaaaccttaccatcaaagcacgatggccagcaacgttaccaacaagacagatcctcgctccatgaactcccgtgtatacattgggaatctcaacacatcttgtggtcaagaaatctgatgtaggaggcaatctatacgaagtatggcacaaattagtgggctgctctgatcataagggcttagccttcgtacagtatgttaatgagagaaatgcccgggactgactgatagcaggcagaggataggcagaatgattgctggacagcgataacagatataaacctggactgcagcagccaaaagtagaaccagagagaaaaagcacagtgaagaaagccgaacagacaaacggaagactagtacgagacaccatcacggacaaggcactaatgaacaaaacaacggagcacacatacacaaaaggaagcaccaggaaaccaagaacgaagatacccatcctaacaaccactccaaagtagacacggagcgccgataaaggaccacaaaacacggtaaagagaccacaacaaaggcaacacacatacaaagaacggggaaaaaaagcaggccacacaaaccatcaacaatggagccacgaagagacacacacaaaacgacagacacgaacacagacacaccacacacaccggccgacgaaagagagcacgaacccccacaacacacaaagaggaacacaccggcacacccgaacaaccacaaggacagccagaccagcgcacacagccagaaaagaacaaccacggacggaccggcaagcaagaccggccaataaacagggacaaagagggagagcgaagcgaggagggcgccgagaccgacaaccagaggcgcaacacaagcgggcacaagagaccaggtgaaaaggagcggcaacgaggggaactggcgcagagcatgcaacgaccgaagaaaaaaaacagcgagcagcgaacggataatggatagaatacg

SEQ ID NO: 566195 - DNA, 162 bp, Homo sapiens
gtacgccgttgctgcgtgttcatgcacgtaaaggggacggaggggattaagtctgtttcttggcacattgtcgccgggcattgccctggctgctacctggtgactggagtgctgcccaaactgaaaatggggccgtgcaatgcctggcccccctgaatacag

SEQ ID NO: 566196 - DNA, 222 bp, Homo sapiens
cgcctcctgcgtctaaacgattctcctgcctcagcctcctgactagctgggattacaggtgcccaccaccacgcccagctaatttttgcattgttagtagagacaggtttcaccatgttggccaggctggtctcgatatcctaaccttgtgatccccccacctcggcctcccaaaatgctgggattgtcttacttgtcttctgtgggagaatcctgtcatac

SEQ ID NO: 566197 - DNA, 105 bp, Homo sapiens
tcttcacacagattgaatattgagcagttcttcaaacgaaagagggggaagaaaaaaagcccaagtgtaataatacattgaaactattcccctgtggaaacagta

SEQ ID NO: 566198 - DNA, 726 bp, Homo sapiens
  misc_feature (241)..(241): n is a, c, g, or t
catcaacctccatcggaacttacgtgctcctttgtgatggcacccgcgaattcggccattatggccgggatgtaaaaacgttggaactgtatttccgaaggcatcatttctctgcatatgtctgctctctggaatgttctaaagggaaaaaacatgtttgtttcggctgcaggattatttttgagacataccagtcagtcctttaccagcgtaatcgtgaatatctgcagggctgcacggnaaggcttttcatttccccatagcaagagccatgctgccctgaccctgccacattccgacagaaggccccctgggatcagctctgggtatgtttgggaagccaactccatgttctgaggcacaccggccctgaggatagggcatggttgaatggtcttagctgttccagaaggactgaaaagcccaagagatttcacagtatggatgcaggcacgggcttcccagtgggctactcaggggtgccctgcacaccactcttgtgtgtgggcacaggctcatgtttttttctgcattgtatttagctcattctttttctgtgttcccttatttctcttcataaaacatctttttgaaagtgtagaaaacttaaatgactttttgtatacttttatctgtgccttgtcttgtgtttgaccaaaaaataataagatccccaaaaacaaaaactgcagggtagcctatttggatgatacacacgttgtgctt

SEQ ID NO: 566199 - DNA, 151 bp, Homo sapiens
aggggataggggggtcggggatcattgaattgtggttggcaggagcaagccctgctcacagtctcacactcgcacccagaactgtcaacagatacagattgtaaaaatctacgatcctctcagtctcactcacaagaagaataaaatctca

SEQ ID NO: 566200 - DNA, 442 bp, Homo sapiens
  misc_feature (316)..(316): n is a, c, g, or t
  misc_feature (415)..(415): n is a, c, g, or t
  misc_feature (436)..(436): n is a, c, g, or t
ataagcatcattatctatggagtctgagaggggaacgctgagaggaagggtcggccagccgtgtgcagcaggaccaggaggccctgcaagccccagatcacgtctaccgcgcgtgtgtgcactgatccacccacacaggcgttcagggccctacctggccaatcgcgtgaaaggctggctcagaaggcggtaaactctgtcaggtcaaaatgagtaataacatttctaaagcgacaaggctacaaaggaagctggactcaccggatcccgggaggtttgcgaggcccagcgaagggcgtgggctgggaggcccatngaaggagtcatggagccaatacggggctcaccaccccgcaagcggcgccccggagcccctgcttggttcccaaatttttgacctgaacccttcaagttnttgttcctctgacctgagganttttga

SEQ ID NO: 566201 - DNA, 132 bp, Homo sapiens
tgtctgcggatcctttacgacgaagcgtagaagggtaatgctggctcgcagttttctcacgtgctgactgaagggtttttttgccgtggctcaacagctttcgagatggttggttggtggttgggtggtttc

SEQ ID NO: 566202 - DNA, 391 bp, Homo sapiens
  misc_feature (1)..(1): n is a, c, g, or t
  misc_feature (180)..(180): n is a, c, g, or t
ncgagtgggtctgcatgattccctcacagtgttttgtcctgaagcttctcagaacccgctgttcaccacaggacgtcttggtgaaacagtctctgtattatctgccttatctgttaggcaaatgccaaattcttccctctctaggacgaccaagttgtgctctgctcttaaactgaggancgtctggaattcaggggtcagcccaagtcacacccaggagtaaaagaaactgaacattctctacatgcaagcctccattcccaaaatgccctcctttaagctcacgttgcctaaaaaatgaagacgtgtgggattaacacagccaagtgaagctctttcacagaggtagcatgggcttgcattatgtattatgtacctattgcatagacgt

SEQ ID NO: 566203 - DNA, 114 bp, Homo sapiens
tacgagcatagtttccatttaacgtcacatacttaaagatgatgattatgctatacaatcagatgaactctgtcatcactttcttctctgtcccaacaattgctcattcagact

SEQ ID NO: 566204 - DNA, 185 bp, Homo sapiens
ctctagaggattacattggatacgggatagcggtcgttcgtcctcagcggatgataatctcaagacacttccgagcgtagctactccccttcaccctcagctcgacgcctcagcagatgataatatcaagacacctgccgagcgtctgcggggcgcgattccaccctcagcggacgataatctca

SEQ ID NO: 566205 - DNA, 279 bp, Homo sapiens
aaaaacaaatccaaggccacatcataacttctgaacaagtgtgtgcccgtatatatatatctatatagatgtattaagttggtgcaaacgtaattgcaggttttgccataaaactcatggccaaaaccacaattacttatgcaccaacctaatacatgtgtgaacaacagcgaacgatgtcaaactacttaatttcctttctgtacaataaacttcctcactttgaaaccaacattttgcttgctcaacatgtgttcttcttcgggttgtttgatcccc

SEQ ID NO: 566206 - DNA, 288 bp, Homo sapiens
  misc_feature (169)..(171): n is a, c, g, or t
gcacgcagcatccaggtggggggacgactccagcagggtttccatggagattcctctgggtctagcctaaaaacagcagatcagctgacaccattagctcaggacctaattactgcttattggagcaacaaatgagggaaagggccagctgcaaaggaagagtttttannnccccaccccattcccccatctcctttctccccctctctccatccctcttgagtcccgggtgaattctcattaacttgcaagattcctgcaacaacagctccccttctccagaggcca

SEQ ID NO: 566207 - DNA, 103 bp, Homo sapiens
aaacaccgcaatctcaaccattttgtgttgtctcccccacctgcagaagcaaccatgaaggacgctcttcaactccccccttacatgttcacgtggatgagaa

SEQ ID NO: 566208 - DNA, 106 bp, Homo sapiens
gcacggggggtaagtccatgacaaccaaaccaatctcggtggaaactcctatcgtattcatgtagatgtgcccgaagatgattgagcttggcactcgtgcccgtga

SEQ ID NO: 566209 - DNA, 190 bp, Homo sapiens
aggagaaggagaggtgtgggaacagctagtcaggggagcagtgagaacacactcaacatttattgatgaagttcgcagtctaataatgagcatggtagtagcacccaaaaacaattacaacagtcacatcaagatcgctgtcactgatcacagatcaccataacacatatgccattattgaaaagtttaa

SEQ ID NO: 566210 - DNA, 386 bp, Homo sapiens
agggtgacctaggaggttaccggagtggcgacatttccaccaaagttatctacagttttattgtacctcacccatatttttttgttgttgttgttgttgttggttttgttgttgagacggagtttcgctcttgttgccaggctggagtgcaatggcacgatctcggctcacttcaacctctgcctcctgggttcaagcgattctcttgcctcagcctccccagtagctgagattacaggcatgcaccaccatgccaggctaattttgtattttcggtagagacgggctttcgccatgttggccaggctggtctcaaactcctgcctgcctcagtctcccaaagtactgggattacaggggtgagccactgtacccagccaacattc

SEQ ID NO: 566211 - DNA, 607 bp, Homo sapiens
gttggagtcctgacccatggtacctcagaaagtgactgtatttgaagataggtctttaagagaggtcattgtaaattaattaataaggtcattagggtggactctaatccgatatgactggtatccttataagaaaaggaaattagcacacagacacacaatcagagggagaagacagccagtcatctacaagccgaggagacagacctcagaagaaaccaaccctgcctgcaccttgatcttggacttctagtcgccagaactgtgagaaaacaaatctcatgtttaagccagaacctagcacgtggtacttgttaaggcatccctagaaaactaatacactcactgaatgaggcaggtagctgtttcttttattttttgagacagagtctcactttgtctccaaggccagagtgcagtggagcgatcacagctcactgcagcccctgccttccgggctcaagccatcctcccacctcagctacttgggaggctgaggtgggcaggatgcttgggcttgggaggtgaaggctgcagtgagccttgacagtgccactacactccagcctggacgacagagtgagaccctgtctcaaaaaacacgagt

SEQ ID NO: 566212 - DNA, 122 bp, Homo sapiens
actgccacacatactgggcagtgagcgaggactgctcccaacagcgggattggctgatgggaggtcccaaggacaaggaaggaggcgtgttttgactgggggccttcattgtagatctgatt

SEQ ID NO: 566213 - DNA, 834 bp, Homo sapiens
ggataatcgttagccacccgagcatatgttcacccccctcgtaccataatcattcggtattccccaccggcgtcaaaagtatttagctgactcgcccacactttccccgggagccatatggaatgatctgctggcagatgcctctgaaccgcctaggattcatctttcttttcaccgtaggtgggcctgactggccatgtattagccaactcatcactagacactcggtttctacaccgaacaccgtatgctaccgttgtaggtcaccttcccactaatgtcctatcacacatatggaggctgtattttgccacatcaattaaggaagggcttcaattcacactgagtttcccgctacatttctcacagggtaatacacccctagagcccaaacctaacgcccaaaatcccatgttcactaatcaataatttactcggggtaaatactaacattttttcccacaacacatttttcggcgctatccggggatgccccgacgttactcgggataaccccggatagcataacaccacatgggaacatcctatcatctgtgaggcgtcatatcatattctctaacagccagttaataattaataaatatttcatagatttggagaagccttcgcttcgaagcgcgaaagtcctaatagtaggagaaccctccattaacctggagtgaactatatggagtgccccccacccctaccacacactttgcgagtaacccgtatacataaatttagaccaaaaaggaaagggatcgaacccccccaagctgggttcaagccaaacccatggcctccatgacatttttccaaaagaaaaaaaaa

SEQ ID NO: 566214 - DNA, 262 bp, Homo sapiens
aaaacccgatctcttaatctactaatcgtgtcagtgataaggaaggaaaaaggtaactcatacagtatacttgcacgaaacatcatccactcaaaaaagtgtctggcacacgtacaggagagagaatggcaccatgcgcaaatgtgaaaaacacatatctcagcgaaacactatgcagttcacacttgcagttatcctagtcaactgagtatttgaaatgatctgatactcactgttatctctggtgtcttatacaagttgt

SEQ ID NO: 566215 - DNA, 183 bp, Homo sapiens
tcggtacgatcttcacatataataatggattcatctatttgtctctgcagtcacccttatgccatgctaaggaagtctagaaatcccccagaaagaaaaatcatggcaaattcttctctgccatgattttgctttctgggggattgctagacttccttagcatagaatgtgttggaccaaaat

SEQ ID NO: 566216 - DNA, 1161 bp, Homo sapiens
ggtggtaccggccctagacactgagccgcggtggggatccccatcggctctgcaaggccctgagatgcgccagtggaggcgccacgagggagccgggcagccagcgggccacttcagtgcgaggcctgactcgccgccccgggccggtcgagagatccttgggggcacaataatccgagggttgcgtgtgaaccccgacacagggacattaacgaggaggatagagcgagccgcaattgcccaaggggaaccattcttgggaagaccccggccccatgaaattacatgtcagcggtcttccaagagataacaccccttgggaactagcgcctaggacggccttggatatgcccctatacgaacatgaggaccagacaccaggggtgaaggacaccaaaaaacgacaagcgaattgaaagacttacagacccgggggaaacatccggacgcgatgtgcacagggtcaaggacaacagtttggcacaaacaccacagcacaatggacaacttggccgatcagaaggaagcaccacccatagtgcgaacgagacaggcgaaccacacacaacgccattgtgcgtgaaacgcggccacacccatggagaagaacacgacacccgatgaagaataccacgccacctataaaccaagttttgacacacagccaccacatcacgaggcaaagatgacacatggtaacgaccacaccgataacagtggaatctcactaaacagggattgtgggaaccccctatgcgctattccacctgatgacagggaagtcgaacaacaatctgggtcttgaacatgaggaaacatattcccacatgtagggatcaacataattctaaaccggatgcacgcaggtttagtcaaccaattcacgacagtctggaggacaacagcgtattacacgaacatatacggaggattacacatatatcaccaaaaataacagtgtttagcgagagacaaccgcaattacgcggagataacacattaataacaacacgttatggtcaccgcacgctagagtaacgggatacaagcacacatattgtggggaaacaccacatacagcgtggaacgagagcacaatccacaggaatagggagagaaacaaccacatatgaagagagaagcgaacttgtgacatctata

SEQ ID NO: 566217 - DNA, 452 bp, Homo sapiens
tgcagcaggaacacgcctttaagacacagattgctcatgcttttgtttgtggcttaagaatgcctttaagcagttttccgccttgggcgggccaggtgttccttgccctcattcccgtaaatccacaaccttccagcttgggcattagggccattatggacatatcacagtgctgcagagattttgtttatggccagttttggggccagtttatggccagattttggggggcttgctcccaacagtcaatagcacctaaaaaggtgctcaacattagggaaatacaaatcaaaaccactgtcagataccactccacacctatttaggatggctattattaaaaaaaaaagtgttggtaaggatgtgaagacattggaactcttttgcattgctggtgggaatgtaaaatggtgcagctgctatgaaaacaacatgaagcacctcaaaaaaaa

SEQ ID NO: 566218 - DNA, 853 bp, Homo sapiens
ggggcgctgccactacgggacagtcagatgttagaaaggaggaaagtgtgaagtcaggcggccaatgtgctgtgaataaaggaggacagagcatgatgttgggtgcagagtggcccggaggctccactctgacgttgagcagagacctggatgcgcaagcgtcggtccatgcgggtatctgggaaggcgaacagcacgtgcccaggccccggggtcgtatttcctgggcatgccgcgcacagaacaaggcgccagcccggggtcgcatttcctggacatgccgcgcccagaacaaggtgccggccccggggtcgcatttccaggacatgccgcacccagaacaaggcgccggccccggggtggcatttcctggacatgccgcgcacagaacaagccgctggccccggggtcgcatttcctggacatgccgcgcacagaacagggcactgcccctccctggctgcactgcccatggccgctgtcctctggggacctggaactggccgaaaccatgaagccaggttttaacctcggctgtcctggccaacctggtgtgtgaggagtgcccttccctgacggccgggtgacaggacagggcgccctcctggagtaagtcagctcggaggacaccacacggacaaggctgcccacagctgggggagggcagggcgctcaccccgaatcgggggccggcgcaggactctccagttcaggacccacccgcacactcagcggagggagcctcagccccgccggccgctccacccgacgggaagggaaggcgtttgcatccacatcggtttcaatctgggactgccgaggcagcaatgccgaaacccgcgcaggtcaaaac

SEQ ID NO: 566219 - DNA, 851 bp, Homo sapiens
  misc_feature (231)..(231): n is a, c, g, or t
tgaaaaaaaattctctcttttgtccccagggggaagtgcaggggcttaatcccggtctcactgtgcaccctctcgtgatttcgtgcctttctgtgggttcaagaagattctctcctgtgccctaacagccctcccaagtatacgtgtgggccataacagctgtgctttgccaccacgcacaagcaaattgtggatattttaagataaaaagtggggttcactcgggtgtgncgccaggagtgtggccttggactctctcttgtgaccttgtttgatctcttcccgtgcctgtgggccctccacagggttgctggggatcttccgggggtgtacgccatgtgtggccccagccatttgttggatttttgtggataaagaagtgggggctcctcaagtgtggtgtgtgcgcccaaggcgggattataaagtcctctataaagaggactaagttataatttcctataagggattttcttacttcttaaaccaccgtgttaaagtgttgaggggagatccaattatagcctaaaattctaaaataacgccgtggaattcaactagaaataactgctgtgggttaaaatctttcaaaaaacaaaaacaaaaacaaaaaaagacacaaaacaacaaacgacaaaaaccaaaaggggggggcgcccaacacaagaacccccacaaaagaagggcccacaactgaagagcagaaacaccaaaagagatatggacaccaaagaggaccacccaaaagaagaaaacgcataacacacacaacagcagacagcacgagaaaaaaaaccaatagaaggagaaaaaacacacaggagagagaacatgaagaaaaaaaacaaaat

SEQ ID NO: 566220 - DNA, 849 bp, Homo sapiens
  misc_feature (486)..(486): n is a, c, g, or t
gcctcttcccatcgcgcgggtcctagccaccggtgtctccttctacatccgcctctgcgccggtgcacccggctccctccgccgctgcgcttgtgtgtcaaagctgctgccgccccttgggctaaaaaggttttcacatggcacatttgtgatggcatcacttagtacctatttcaaggcattgtaggccctcgagatactagagtaacaaggatggtttcttctggacaattatatacccacattttatctggctctgtcatatatttacctaatttgtatgggctggggacccaaaatacatgaggaataaacagcattctctttgccggggatttagtggtgtataacctgtggactcacactgtgtctcctgtatatgtctgtgagttagtaacaggagtctgggaaggcaaatacaattcttctgtcagggcacacgcaccgaaggagactcacgatatgaacgattatccgtgtcctctngtgtactacttctccaaaactcataggaattttattggacactttcttcttcatccctgccgcaagaaacaagcaccagatcacggtcctgcacgtctaccaaccatgcctcgatggctgaaaccatctgggtgcttctgtggatgacacgttggtccccctggggcacctccttatttgtgctggccccctttaataggcttcctcccacgtctcctggacctcttacctatggttggcgcaggcccttcctggggtcattactctgggggcgacagcgtcttccctcacgggggggttcgttgggccggcatcttccgccccctggcggcttctgggcggcgatctctggggcgtcccccg

SEQ ID NO: 566221 - DNA, 769 bp, Homo sapiens
agcggagggtggatcaggcgctgcgccggcgccggcccggtgagccggatttggagcgcgaggcgccggtggtggctggcaggggtgctggcggggaggctcccgtgtgctcgggatgctcctcctagctaagcggtcggtctgacctgcgcgtcgatctgcagcactctcgagtcgtccttcgtccccggcaggagcccaggtcgtccgcattacagaaagctcacgctggaggaagctgcgtcagcctgggactgcagctccaactgttggacagcgctaccttgccatccagggcgtcgctggtgacttctagtgcatgaatgagaccagatctgaagagcaatgcatgaataggcacatagacagttgacagcagagatgatgatactgactgcggttgaggattgcgtatacgagctacacacgagatttgtagtgagtagctgatgttcttttctgagattgaggaaactcgggttaagattgacaagatctcagaacatgtagaggaggctaagaaactctacagaatcattctctctgcagccgaacttccagtagtcctaacacaacgataggagtgaaacatacgagcgatggtcacgatctgagattaggcaaagaggtgccgaacaacgtccggaacaaactgagggagcactggagaacgcatattgaaagaagatgaggtcaggtcatcggcagaccttcggattcggaaatcccagcactctgtcctttctcggaagtttgtggaggtgatgac

SEQ ID NO: 566222 - DNA, 256 bp, Homo sapiens
tcgcacactgcccagctatttcgtattatttagataaagacggtgtctcagcgtgtatgacaggttgagctcgatagcgtccatgaccctctgagtgatccggctggcttggcctcccaaagtgctgcgtttacaggcatgattcagtatgcctgtctggtccagttttttaatctacaaactgaaggcatctggaggttgaaggcagtctggagagtctgaaggcagtctggaggagaacctgactaggacagag

SEQ ID NO: 566223 - DNA, 410 bp, Homo sapiens
tgtcagtcgctctcaggatcccgcctcaggtgcgagctgcagcccgggccgcttcccacacctgccttccgtccctgcaggttgatggtggcatcacccttgagaatggacatctccacagacagagcttggttgccgtcctggagctctaccgggagggccggggggcctcctcggatgtcaccaggctgctggagaccctctcccagatggagagataccagcaacattccatggtgtttctgggacggctatcaaggaccaagagcgagctgagcctgaagatgtaccaggaggagatccaggagtggtatgaggagcatgccagggagcaagagcagctcgccctgagttgcagctcgccccttatttagcagctcgccccttagttagcagctcgcccctgagtt

SEQ ID NO: 566224 - DNA, 609 bp, Homo sapiens
gagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgta

SEQ ID NO: 566225 - DNA, 495 bp, Homo sapiens
ggcaaagctcaccctcccgagttgaacaaatttaggacaagcaagttatcattaaaattcacgctggcagaccatgtccacggactattgcggggatctgatccctttatgaacctcgtgatgcagcaacgtgtggagacggcgactagctggacaccagaacactattggaatgctggtaatccgaggaactcgtctcaccacgttagaagccttggaacgagtatacatcatggctgtccagcagagaaacccatgtcctctctccatagggcccgttctactctgccgtaaaaatcaggtcatgtacattttcatactcgactttttgcttaacataaacttttgtaatactcaaacctgctttctcagatgctctgactatagaatatcagctctcattccagttctttctaacatgaattttcctcgttgacattcattccaaagggctttatccatcaaagtgcaaagcctcttattaaacctgaaaca

SEQ ID NO: 566226 - DNA, 298 bp, Homo sapiens
  misc_feature (22)..(22): n is a, c, g, or t
  misc_feature (172)..(172): n is a, c, g, or t
  misc_feature (291)..(291): n is a, c, g, or t
  misc_feature (297)..(297): n is a, c, g, or t
tcgaggcgagttggcggagtgntgcgcgcggcggggcgatggggggctcgggcagtcgctgtccaaggagctgctggccgagtaccaggacttgacgttcctgacgaagcaggagatcctcctagcccacaggcggttttgtgagctgcttccccaggagcagcggagttgngagtcgtcacttcgggcacaagtgccttcgagcagattctcagccttccagagctcaaggccaaccccttcaaggagcgaatctgcagggtcttcttcacattcccagccaaagacagncttagnt

SEQ ID NO: 566227 - DNA, 325 bp, Homo sapiens
aaaaaccgggggggggcccccccccccggttttttttttggggggggggggggggttatttttttcccgggggggcggttttccccttgggggttttttgggggccctttttacccgttttttttaaaaaaaggggggggggggggggggggttttccggggtttttttccccccgggggggttttttttttccccccgcgaaaaagaggagggggaaaaaatttttttttttttctttttttttttggggggggggggggttttttttttttttttttttttggggggggggggggggttttatgttttggggccctttcccga

SEQ ID NO: 566228 - DNA, 600 bp, Homo sapiens
  misc_feature (358)..(358): n is a, c, g, or t
  misc_feature (540)..(540): n is a, c, g, or t
  misc_feature (571)..(571): n is a, c, g, or t
  misc_feature (573)..(573): n is a, c, g, or t
ggtttggaaggttgcaaaagatgtttagcacgaaggatgctgtatatgctgctgccagtgcttggaacacagtgacaaaacaaacagctgtgcatgcctggcacaacctctggcacaacctctgggctgtgactctgtgttcagtgatgatgatgaaccaagtggtgactttgaaggattctgtgtgtcaaatgagacaaaaacgatgtctgacctccttacatatgtaaaaaatataccttcaaggtccatcagaaaactgggagaagtggatatcaaagaagccctccacatcgataaatgaggtaccagttgttaaccattggaagaagtggatatcaaagaagtcttccacatngataaatgcattaccagttgttaaccatcagtagatgtggaaatagccaaaatggttttgagtccaggtaactgtgatgatagtgatgatgaagatgatgacgttaacactgtagaaaaagcatctatagatgacatggcgaaaatgtgcgacaggcttactgaaggactagggcagcatgngatcacagcagggcaaggaatcacgtcaatngnacaaaattcaagagacacttaaagaca

SEQ ID NO: 566229 - DNA, 107 bp, Homo sapiens
cgttatttctacccagatgctctgcctcccgttcaaaaccactcatcctcagcttgcacaaactggttgaacggcaggaatgaaaaataaagagagatggcttttgt

SEQ ID NO: 566230 - DNA, 82 bp, Homo sapiens
  misc_feature (8)..(8): n is a, c, g, or t
gggactgnctcctcacactggggctcactcacctcaacaaggcacagaccctccagttcctgttgtagctgagtaagtggtc

SEQ ID NO: 566231 - DNA, 191 bp, Homo sapiens
aagttcatgcagcagtgcctcggactgggaacacccaacagaaagtctgcagcaatgccatgaggtcctgaccagagggtttctgcaatgcctccaagtggtcaccacctcagaactataagaagcgtgtggcagcttggaagccaagcaaaagccagacttcccagagccagggctacacgacaagacag

SEQ ID NO: 566232 - DNA, 108 bp, Homo sapiens
agttatatatgatagctcaggaaatagaaagcggctataactatctgccagcatcatcctagatctcatcgcctcccatcccatacgacatcctttacataacagacg

SEQ ID NO: 566233 - DNA, 641 bp, Homo sapiens
gcacaccagaccgctgcagtgctcccatgggctgagtggggagcagttttcccctggcctcagttcccagctcacccccgaacacccagcatacacacatgcccatcctggacaagtgtaacatccacacttagacagagacatgcacactgcatgtcgatccaccaacataccacataggatggatgagggacgatagacacacatgggatattaaggacatagagagggacagcacaatcacaatgaaacactatcacatgctacaccatatggcactctacacaataaaatgaaggacatgacgaatcggacaaccacgctgggacctacacacaacgcggcgaccaaacagcaccccagatacataccatacacctagcaagagaagacacatcacctacacaaaccaggcacagacgccacagacaccacccagcctagaccccctcaagcagccacccgagcgcggagacagtaacacaacacaaccagacaacagccaggaccaaaagaacacaggaccgacaggacagaccagaaagacgcgagcaacgaaacaaacaacacacaagagcacaccaaacagtaacaaacaacaccccccagcacgcgaaacagacgaagcacacgacgccgaa

SEQ ID NO: 566234 - DNA, 115 bp, Homo sapiens
tatgggtgaatggagcttctgcagctggagaagtcatccacctgcagacatggggcgcagaaagtcaaaactgaaagccgcctcccaagaagaagatgacatggcaccctcgaga

SEQ ID NO: 566235 - DNA, 442 bp, Homo sapiens
tgccatcagaccactgagtcccatatggtagaaaatgtgtacctgtgtgctgctgcagtggcacatggatgtggacctaccctctgggaaagcccttgtgtccctcccagagtccttcagtgtaggccctcgcagatgctgattgctcagaacaacaccgtgcatcccatgaccatggattctagcagtgacctcagcaaggagttggccattcggttctcagcgaacctgcagcagtggcagtgagtgccagccattgcaggacaggagtactggagcagcagttgtctgctgtgactccactttgacaagctccacacttaagaccccagtcctgtctttgcccatggtagatccactgtgcctccaatgtagactgggggaactacaaaagttaaacaattgctcagtaaaatgccttaggctggcccgcagcagttca

SEQ ID NO: 566236 - DNA, 410 bp, Homo sapiens
aaggagagcgctgaggtgatgactcatggggggtggggtggaggtgaggtgcccagtgtggcgtatttgcccatgacagagctggtgagtttcaccccgcaacccaccaccatgttctctccttacctttggacatcctttggcctggtgtgggaaacagaggaccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcacccccagagcag

SEQ ID NO: 566237 - DNA, 916 bp, Homo sapiens
tgtcacatggtgcgcgctgttactaatcacgtggctgccacccaggcctctctgctcctgtctttgttggatgccggcgctgctgcctgtggactccctgacttttgttgctaccccgagtcttgctgaccatggcactctgggaagccctccgaccccagccctcgccggcctcggattccggctctggctacgtaacagggctcggtctctgcagcctttgttactatgccccaaagagaaggtcgccaaggagatcgccagggcccgtggtggagaagacgcctagcagactgagtcaacctcatcacctcagataaacatcacattctcatgaagtggaaagggcaagatcgaggaagaacagtgagtgtgctggatgcatgacttacaacacctacagtatctacggattcacagcttagacaagatatctgaacgctctgtgcacacctttacgacaactggccggagggtacatatggccttggctgttggcacccggcagaaccttccgtaaccttgcagtgaggtgtagccaggtccatcagacacaagcaatattgacactatacacagcaccgccatgactgaagcccgaacactgccatcatgaacatcccgggaatcctacaagcaccttccgagattcaggagatgatgggccccaaataaaacgacatgagctcacacacaacaaacaaccagaaaataaaagaaaaaaaaaacaagcgcccacccaaacaaaagacaaccaacagcgaacgacgcaagcagcaacgcgcaccaccaacacccgcaaactagctgtcaccccccaacagatccacaccgcaaccacactcgcacaaaaagacgacgacaaccacaggacaaaactgacaaacaaggaagcaacgacacaaacaaccaagcc

SEQ ID NO: 566238 - DNA, 270 bp, Homo sapiens
tccgacaactgcaccagagagcaaaaatatatgaagatacatggcccgccactcttctggagcttagagcaagagcagacattaagacagggcgagagacggccaggcaaggtagaagctggctctgtccacgtctctcaagtcatgagtactctgggctggaatttcacgtaaggccttttgggcataatgaattaggaggcggggaagcgggactttgtgcaggatacagttcatgcttccgtggctactttctccacatcagtccag

SEQ ID NO: 566239 - DNA, 224 bp, Homo sapiens
  misc_feature (129)..(129): n is a, c, g, or t
aatcagggttgactgttgggtcacctgaaacacacacaaacacacacatgtggatggttaagcactgttggatattcacacacccacaggtaagccccccgctaactccttgcccggtgtggtcatganggagacctaaccaccagatcggtcaaactctgtggaacacaatgtgtgctgtgtgcactcctcagactattgtagtgttccgtctgccagtgatt

SEQ ID NO: 566240 - DNA, 411 bp, Homo sapiens
gtcattcctagaggcagctgctacaggaacagaggtgccgtgcagtcccgggtactccttgttgctgccctcctggcgctcctggcctctggccgagcttcagaggccgaggatgcctcccttctcagcttcatgcacggctacctgaagcacgccacccctaccgccaaggatgcactgagcatcgtgccagagtcccatgtgggccagcatgccaagggctgggtgaccgatggctttacatccctggactactggaagcacgtttacgacaagttctctgaatactgggagttggaccctgaggtcagaccaacttcagccgggggtgcctgacaccttaataccgcaggtacacctgcctatacatcctgccagctacttgggaactgctgtacaggcttcccctgt

SEQ ID NO: 566241 - DNA, 1375 bp, Homo sapiens
  misc_feature (1138)..(1138): n is a, c, g, or t
ggcaaggtgaacatgctagccagtagtccatgcattggcgggactgtgataccgcttcaggcatcattattcagcttattcagtccacgagagcacccgctgcaactgcgaaatctcctttccaagagcggcagcagctgggtcccacgacacgccttctctctagtgcgctggcatggacccatccgatctgcagaaacggacaggcctccatctcgtcatcagcgggcagcccccgtggaaacgtcctttaatgcttcaactcatgcagagcgacgttaggtagcacatggtcaacagcacagttgggcagccaagctattaatcaccaatatactgggcttcaggtcttggccctatcacaagacggtcatatgtgctcttggcatcatttcaagttcaacttggacccattgcaccagtactcatgtgataacactccatcgcaactttgccgctagccttagcagcgcagtgttcattaaatgctccgtggccaagggttgcaaaccacccccatccagttcacctccccacagaacacacggaagcctgcccctacccttaagtcgtttacccttcaattctcgtaaacggcacacagtggctcaaacctgtcggccacttggacttaccgcgggtacactttgtccccttagtttcgggaaacgcacacacaccagctatttagcacccaatcacgtagtttgagagccatgctatgtaacttaacgcgtacttgatcacgccgtcatttaagacctacacgacacattggctttgcggacggcattttaactttcaagcggccaaaccaccctttatgatgaccaaacaccttctacaccccaattggggggtcaacacccccgttggggcactttatcagcatgattccctcacggcaaatcacaccggcaactgggctgtattggctcataccaccatattacccgctgatggtcaccaagacaaaactgtagcatcccctgggcattcatccccaatcagagggaggccccctaacaacccagacaaacatcggggttgcacctagtcgtacacccggcgcatacacttcccgcccatagatttagttcattcaaccctacacatgcgactatccgcgccatttcancccttagaaatgtgacgcggctttataaccgaatcgttacagacataacctcacgcaaagaataaactgcgattaccgcccaccacacaacctctggctacccaccttgaagtgatcagagcactcagggggggtccgaaattatatgtggtcactgtctgcagcagggttttaattctaacatgcaatagtgattatacagcaccctcatggccattaggtttccacccccccaga

SEQ ID NO: 566242 - DNA, 177 bp, Homo sapiens
tctggttgtagccgccaggtcagttgtgtcatcatcacaggatgtgatcttggagcccagcgtgaacaccaggacacatatggtggccagccgcataaagacacaccttcggggagagaaggagagagtgatgggaagatgaggccctcagggtggctggtcccttggaactggggc

SEQ ID NO: 566243 - DNA, 1200 bp, Homo sapiens
ggtccaatgcgcccgctccagatggcaggcagtccgcgagcccagtccgcctgctgtcgccgccagatagctaggccttctgccagcgagcgccgcggcaggaaccgggcgcagggtgagcgagcccgagccccgccagacccagcccagcccagccctactcccttccctcgatgccagggacatgcagtcactgttgctctagcagagaagggtgagaggaagaacactccagatcgctagcgacgcgccgcaccatctgatgtgaccagttgaatgatatcgtcgagcaaaccattcggattacaatgacagcctggaagtagagactgggaccggggacctgctccgtggtacccggtgctggcgagtcaagcaggccgaagaggaaatgcatcgattcgacggcatcggtgtaacgtccgcaccgtccgagaaggcgggcgacacagcatcgagaaacatcgacagaggatcttccggggtcagtggcctgagagcatcacttgctagtcttgcattgggacgggtcatctctacgagtgaacagcttgtggccaaggccaaggcaagcagagggcaatgatgacgaagttgcacaaggatcttccatagcgtcaaacaaaggcccctgggattttcattagccagcaaaggcgtcaagactaggtgtccatcgtgaaccgaacgcaaagtcgtgggatgggaaattgtgcacgaatgacccctggagcattgaatctgaggacctccatccttgcgcctttcgcgcagtcccacggaacaattataccgattggaaacaagaacgttacgagcccaaggaaaacggggcggaaaccctggtgggtgtacgccgagacagacccagggccccttaaagcaagcattgtgtccccatgcccgaaactctcacacaatacgcgttgaacagcgatagaccctcagggaatactaggacagttggggccaccacgggaagacccgcggtcccaaaggtggcgataagccatcaccggggcaaggaccagtggcagagaggtgatcaccacctgacaacgatggcgagatctacgggatgctagcaacgggggataacgtatttccttgctggttccacccaaaaatctggatgcccaccaatccgtggcaaggccccagataggacagcggatcacactcgacagtctatcgcagacg

SEQ ID NO: 566244 - DNA, 414 bp, Homo sapiens
  misc_feature (154)..(154): n is a, c, g, or t
  misc_feature (242)..(242): n is a, c, g, or t
  misc_feature (252)..(252): n is a, c, g, or t
ccccggtatgtcatgctctttgtctgtcggacccagatgtctgccaaggccccgtagaggctgttcccagaaagcccttctgggtgtcacttgcccgagcagtgcgtctcagagttctcccgccctgattgtcctcccagcatgccagcccagncacaacagtgccttgcttctagtcatgtgtctggctgtttgctgggtccaggccagccctggtagggcacaatggggggccgctctgncaacccatanctctccccaggatatctcatgccccagttctctccctagttccaccaagcactggcactccttagaaaacacagctctagactagttacttgcctagcttacagcacagaactcccctggtctccaaccattcatgggtccctagtgctcggcggccgcaca

SEQ ID NO: 566245 - DNA, 351 bp, Homo sapiens
agcttgaatgctgtaacatgtcatagcttgtccaagatgcatgtggacaatgactcccatgcctgacactgcatccctggtccacagcattcagcatggcttgggagatggtttcaaacatggtgatccgggctcccatgttgggctcccagaaagaactcacacattcctgtacatttgttctggcgcaggtgccactgaccaccaaagtcatcagtccaccatggtgcagccgcatgaggtctcagcagcagcaaatgcacgggcttaacaggtcttcgtggccccaaccctggccaatgccttggctccagtgtcagtaaggcgccaaaacggtttctcaatacaaag

SEQ ID NO: 566246 - DNA, 103 bp, Homo sapiens
  misc_feature (78)..(78): n is a, c, g, or t
  misc_feature (101)..(101): n is a, c, g, or t
aacctttagcaataaacgaaagtttaactaagctatactaaccccaaggttggatcaaatttcggtgccagccaccgnggttcacacgattaacccaaggnaa

SEQ ID NO: 566247 - DNA, 234 bp, Homo sapiens
tggagtgtaccttgtacacatcggaggacagtgtctgactcctgaagaaggaaacgtggtaaaagtattgtccagttctttctaagttggtggctgaacttggtgaggtgtgtttttaaaagacctttagtccgttctacttttcttgaagacagaggactatacgggatataaactgaaaaactgcttgactaatttgactaataaagcctggtctgtcatcagacaatgtat

SEQ ID NO: 566248 - DNA, 263 bp, Homo sapiens
tggcagctatggtaaaatggatggagtcctgtaatttaatcctcagctgtggtagcgtgtggctggtatacgcagtactactcgtttggtgtactttcaatttggcatccagaaaatttggctaaatccatttatcagttctgggaattttttgggatgagtctccgggtttcctaggtatatgatcatatcatcagcaaacagtgacaggttgacttcctctttactgattgggatgccctttatttctttctcttgtctga

SEQ ID NO: 566249 - DNA, 252 bp, Homo sapiens
tgtttttggattggatgaatgttcatgatgcgtccctgtcctgaactgccttttttcctgtagtgggtgaggtctatgctctgttggctcactatgtcttttccctcctattcagagttaggggacgagttggattacacatggttaatcggtttataaaataaggttgacgtagttccatagaaacgcaagcccctttaactgtttagtgataccagcctgggggacagagcaggattccgtttttctata

SEQ ID NO: 566250 - DNA, 1088 bp, Homo sapiens
gcacggatagctgctcttcattcctcttctgacatgtgcatgctgctccccccagttctgggatttcctgaattgccaatgcctggtgccttttcaaatgactagcaggtcctcgtggttgagatgccagtggaaccacaacggagagtgcccttgcctgtctcagtgtagaaggtgtatcattggttgttatacggataagaaccagaggccttgaagggagccaaaaggacaggaaactcctcgagcactgtgtacatctattggaatgagcacattatatcatttcatgaactgcatgcccacctctcttcggcaccggcaagcatatgaaaatcccgttttcatcgtcctaatttgcctattgttttgacacgtacacattacgcggtttagctacttaacaaccattctttggaaatggtcttcagaatcattaagtggcgcctcttgaacgattccaaactagcgcgttaaaatggacgtttaccaatatggtggccttcaagggaactcacattgtatacttaacaacgccagggaactgcgacccagatcgaacggcgcattccttgtgaacaaccagggttaattattcccaagaacaaggtttacacttccgttggctcacggcacattagcaacatagggatatgacataggcagaacaatgtcacgaaataagcattacgcctcaccctttgataacaccaagcccgggacaacattttgcaaactggccttattaaccccacacgtgagtacagatatcgagcagattacggaataagagttcggcacaataggtgaccgtccaactgccgatcgccccacagtgcgtagccgcgtgtcgtgacctccccgatacgcaagacgttcgcgatacccgatcaattataacaacaactgggccgcctgttaacaaccgtttgttgttccccacctccgcgtggaataggatcttgggccatcaagggctctctcattgcgaaggaacgttaggcgcgtagtgtgcgcaacttccatacccgtatatggccacctatctttgagagcgtttaggacagaataattgcctcttataacat

SEQ ID NO: 566251 - DNA, 952 bp, Homo sapiens
ggagggccggcctggacccggcgggcgcactggttccgtagcccattgcgcagctcgagtcctggtctgcagagtgggcccccagaagctttgtgtgtgtgtgtgcacgcgcgcgcgtggtgtgcccaggtgcgagggttcgcgcgatgtgcatggcggggagggaatctgacccgaaagagagcccctacgctgtgcaaggagtgtgctcgctccgatctcgacagaccggtttggcgctctggcggagtcgtctttcagttttccatggtgtgagcccatgtgcctgtggtattagtctctgagagagatgttgcctgaggtgaggagacaatagtactggcatgagactgccttggactgaatgtggagctagatttgtctgggttgagattggatgtttaaagtagaacggcgagaacgaacgaactagcgtacgtccgacatcgatgctatctctcaatgactggtgatgaagttagaggcctcaagacatcccaatggcttgctcctttgcattgggaaagctcttgagattcttatccagcccatgggttttgcggggaaacgcctaaaatggtagactcaagaaacgtctgtattggatccctcttgtgtgggggtacctatcgttgtgtccgtcggatcgttcgactggcctagtctcgtgaggccatgcacattgagtcaaagcagagtgttcgggccggaggaaactttcaagttaacattttaccaatcaggacatgtgccggtcagaaggattcgggggaggttcaaaggttcaggggaggcccgaaagaggcgggttgcatgggttattcaccgttgtggcacaacgacctgggccacgaaggggtccaacagggtgctccggtgagggtaccggggtaatcaggtcgttgaacaaaggttgaaacgaaagtatgtgttccaccctcaattcaggcca

SEQ ID NO: 566252 - DNA, 774 bp, Homo sapiens
  misc_feature (88)..(88): n is a, c, g, or t
ggcacgagggagaaagcaacataaagaaatactcttttggccgggcgcagtggctcatgcttgtaataccaggactttgggaggccangtggggcagatcacttgaggtcaggagttcgagaccagcctggtcaatatggtgaaatcccgtctctgctaaagatagaaagattagctgggcgtggtggtgggcacctgtagtcccagctacttgggaggctgaggcaggagcatcgcttgaacccaggagttggaggttgcagtgaaatcctgccattgcactccagcctgggcgacagagtgagactcagtctaagattatttctttttttgagatggagtcttgctctgtcacctggactggagtgtagtggattgatctcggctcactgtaacctctacctcctgggttcaagtgatgctgatccctgtcaaatacagataaagtttaagttcctcagtggggcatgcaagatccataagtgggctctatgtaactatccagcttcatctcttggccattatgtgcttccctcttcttgctctagaaatactgacctgtttacagttttccagacataacatgttattttcatgtttatgtacttttgtgcatgcagctgcttctgcctagaaatttgatcacccacccactgtcagtttttcagataaattcttattcatccctcaaggttacacctttccagatactctcaaattcaaagtgaaaaaaaattgaccttaataaatgtttactgaattggaaaaaaaaaa

SEQ ID NO: 566253 - DNA, 1017 bp, Homo sapiens
agtccgcctcggttctggttcacttgccgctttagcgtggccccgttgtgatctcttgtggcactcggcgtgttcttacaggcgtctcgtcttgctaacgtcttgggtaagagcccggccgttgtgtgggccgcgtcttgtccatcctatacaggttgctccatccccggtggtacagacccctgcgttatctcccggtgtgggtcctctggcccgcctttttcgtgcccattttccgtatcccgccatgtgggccaccccacgtggtgacccccaatgttcggacatcccacctcgctggtgtgttgctccggagacccctcctccttggggggccctaaagttcacagcgcgacttctgtgaggaaccaaggccccacccactgtcactgcccgaagattttggtggtaataaaatacgcctttggcccaagtggtccgtgggtaataaaccttttctcgcttcaggggggagtaaccaatcccccggttttttgcccaataaggctgcgtgggctaatctacgacgcccgcagtggggagcaacaatggcggttgtcttcctgggtgcccgcaccagccccgtggtttgctctctcaccataggctcaatctgcgttgaactattatgtcatgggggtaacaccacgagcctttctcagaaaaacacttgttctagcgcccgaggtatcatccgacagtgcacctgtttgacccaggaagggctcgtactatttggctgtccccacaataatttctcacggccgtctttcccgcagacactctgctgtcagaggactttccccgggcgcactgggaatcgatgagccccccagtccccgcactcctggagcccacttatatgtcgttgcggcctcctgtgaagtgagtgtcagcacccttctcgcccccagctgtgttggtagaaagtaagaggtgagattaaacaacagtcgctcccagttccgccatttttgcgttccagaaacaacaatttttttccccccccccaagaca

SEQ ID NO: 566254 - DNA, 335 bp, Homo sapiens
ggctcggaccttagctcatgggctgtatggaaattgcaggtattgagtggccatgtaactatccagcttcatctcttggccattatgtgcttccctcttcttgctctagaaatactgacctgtttacagttttccagacataacatgttattttcatgtttatgtacttttgtgcatgcagctgcttctgcctagaaatttgatcacccacccactgtcagtttttcagataaattcttattcatccctcaaggttacacctttccagatactctcaaattcaaagtgaaaaaaaattgaccttaataaatgtttactgaattggaaaaaaaaaa

SEQ ID NO: 566255 - DNA, 156 bp, Homo sapiens
ggatttaagagctagcgaatatagatatacagtgaggtatgacatagtgacaaggcactactaccctgggcgacagggtgagacctgtactcacaaaaaaatcacacaaagtataggtgtagtcagctgtgttctagcaacctgctgctacgcact

SEQ ID NO: 566256 - DNA, 391 bp, Homo sapiens
  misc_feature (36)..(36): n is a, c, g, or t
aagcagtatacagactcaccaagccacagacttgtnttccacaatgcacgtacttacctatagccacgaaggtacccaaggccacacgtttctaaagggttgaactcaaagatatgtacggggtattaaacaaatcccagggggaacagttaacttcaatacaaggtcaaaatcagcaacaagttctacaatccagtgctgatatcagatcacaagcttcaaggcacaattcctttccgaaggcttatcccagttccgtgaggctagcatgaggtgtgtcgcatttcccaggggcaattttctatcctcaattaacccatgcggcaaatgctacgatatttcgtggagcctgtttaacctgcttggggataaccgagctcaaatccgtaaa

SEQ ID NO: 566257 - DNA, 343 bp, Homo sapiens
  misc_feature (137)..(137): n is a, c, g, or t
ctctgctctggaatcgttagagtagaaaatagtgagcggcctagatctaggaaatacttttccagatgagagggacatacgtacatacataagttggtacccgaaatgcattttcttgtttcttttagtctaccatntgacatctaaaatactgtgatacaaactgtcacaagtgacaatttgtctatgaaaggtatattgtttaatacatcctctactatagagtgatcagaagcaaaagacgtatattaatgaaacatcaagaccccactcatctcagcactaagtctgtcagcaccaccatccttcctaaaggaaataaattaaacttgattccttaagg

SEQ ID NO: 566258 - DNA, 281 bp, Homo sapiens
tacagaaggatttgctctgtacccaggctggagtgcagtgtctcgatcactactcacatggccactcaataccggtattgagtggccatgtaactatccagcttcatctcttggccattatgtgcttccctcttcttgctctagaaatacaaaaactggtcaggtgtggtggcgcacacctgtaatcccagctactcgggaggccgagacaggagaatcacttgaacccaggaggcagaggttgcagtgagccaagatcgtgccactgcactccagcctgg

SEQ ID NO: 566259 - DNA, 1072 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaaaaaaaaaccaaactcgagactagttctctctctcc

SEQ ID NO: 566260 - DNA, 276 bp, Homo sapiens
ggaaaactgcgaggcgaatggtgaccggggaccgagacatttcacgatctgctcggtagacctggtgcaccgaccaccatgttggctgctagagggcgtggtgtgtcgtccgtgacactaccttctagggttggaccacccagctttcatccaatggcctccccatgttgtgaaggaacttccatcacgaagaatcaatgggtggtaacagactagcacgggaatatgtgcacacaaaacacgagatggggtactgccggtgtgagagcacctggt

SEQ ID NO: 566261 - DNA, 1221 bp, Homo sapiens
  misc_feature (1221)..(1221): n is a, c, g, or t
atgaacaagatgcatgtataaggaagacttcactatgatgaagagagcccatctttgtctaacgctatgctggcatggttctttcccatctgattgtgcatctatagatattgctaggatagattgcgctcaagaacctcactatcctgatcacgctatcctggtctgaatctggccctcttctaatagcatgtgctgaatgggttgaatgtgattctctctcatcctgtgagttcctctcctccacaagccccctgtctccctgtggagctatgaggagtttgtccgtggctgtcaccttgtgagtcttcccgcatcgtactatgagccttggggcatacacaccggctgagatgcacggttatggtgaatcccctagtatcatccacacaatcgtctccggacttcggcatgcttcatggaggaacacatcgcagacccctcagacattacggttatctagcggttcttgaccggcggttccgacagcctggatgattcctggctcgcagatacacctccttcctctacagtttctgtcagcagagccagagaggcagcgtatcatccagcggaaccgacacgtgagacgcctctccgaccttctaggacctgcgaaatacctaggcctggtactatatgtctagcgctgcgaggatggccgctgttcccacgcgcctttccagagacacttcacctacgagcccaactaaggcggatagcggcccattgggtaccgataccgagggccaaacataggtggccaacagttgggccccctcgccatgctcacgcaaaacgtgccagatccgcgaaccaaagtgagggaccaacgagggacaccccggaacggtatcagaaagcacgaaaaacgccgcacgccaacaacgagcgacacacataagcaccaagacacgtgcaacagacacagcacaaagcagtacagccacaggacactgaccacgcaaaccacgcggaccaaggcgagacaaatagagaggagggcgcactcaaggtaaacgacgaccgggaggggagggaaccactagtaagactgaaaaaagagaagcacgaccaagaggcaagagacaagacagcccaaagcaagcgaggggaacaacgcaacatataggctagtcgtagagaagaaggccgcagccaacgaccagcagacagaaaaagaagaaacaataaaaagtggctaatgagacgtccaccaan

SEQ ID NO: 566262 - DNA, 966 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagcggggacctggagctgacgcctagacacttgtattagctttaatagaaagagaaatggaggagccatagaataattaggatgaattcaggaaggcctgagaccatggaaaacttgcctgtctctacactattttccagagagtttggtgactgaacagtgctccaaagagccgtatgagacctgaagataagtttgttgtatggtgacgccatggggctttcaaatccggggtcggaggcggtgggcctcgacccattctccgtggggggtaccctgtgttatttgggcacacgtgggggcgctggggcgggaagatgaaagcccctcagggtcgggggggacttccgtttggagaaggggccttggggccccggtctcaggggggctgcgggtctcggaggctggtatagtgctgcggtcgcggctggtt

SEQ ID NO: 566263 - DNA, 108 bp, Homo sapiens
  misc_feature (82)..(82): n is a, c, g, or t
gcagtacctgcccagttgatggtcgtgccctcctgggagttgatgaagtccccataggcaaggttggctcgctgcaatcacntgtgtgcaactgcctcctgtgtactg

SEQ ID NO: 566264 - DNA, 919 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactacacctggcaccacagttttggtgcctgcaagggactgtggtgcaggttgctatccctcacgatcaaggatcccgggtatgagtctgaaagcagggactttgcgaagactgggagcatcatggccaaggttgcgttactggactacgggacctacagttcagaaggttccaatacaccggttcccctgggatttcacgccgttataaacgtttaacgaagtacaagtgccacttcaagctgcaggcatctgggggccctgtatatcaaaggttgttgttctatcttagcaccagccagctacatacccatatcgtaaagccggaaggcactacccactcacatccaactagcaacgtgccgcgacatccactcgtcgccc

SEQ ID NO: 566265 - DNA, 916 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaagaagacgggggaccgtccaaatgttccttgtccgaagaagatcgggtgctcaaaaaaggaggtctcaaatcagaggggggggggaataaccacattctaggatttccgttgataaaactt

SEQ ID NO: 566266 - DNA, 490 bp, Homo sapiens
cctggttatgattctgaaagcaaggaatcgtttggtactgtgagggatagacaagcctccatccacagctccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 566267 - DNA, 378 bp, Homo sapiens
catggcttggagtggtgtccagatgcgtttcttttcctccccgaattcggcacgaggacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 566268 - DNA, 110 bp, Homo sapiens
ccatttaaatcgcccgggtgcaacctatgctacgccgcactgaagataaatcagttcaactgttctcgactttctcgtaaggaatcgccaggaggccgcctagcgttatt

SEQ ID NO: 566269 - DNA, 1111 bp, Homo sapiens
  misc_feature (1077)..(1077): n is a, c, g, or t
  misc_feature (1099)..(1099): n is a, c, g, or t
ctgtgttgtgttggtatctagtgtagtgctctgtgcgtagcctgtgtgttgtgtcgggcgtgtagtcttatgttgagagtttgcatcatttgctcgagcttgagtggttagggtgtcacgagttctgggtaatagcaggttcgaaatgagaggtcgattggtgtggcgttgtagtacttcagtgtatgtggctgtggtagcccggttgggtcaggttgttggtagtgtcgatctcctagcgtctctgagcgtctttgtctgtggtccgcttatcgtcggttttgtgtcgtgctttgtacagtttccttttttgctttatatgtcttgctcttttttttgcgctctgggctggtggggtgcctgatgcgcgtttgtccctggggctcttgttgtgtgccgttgtcttgtcggtgggtggagctgtctgcgctttgttgggttggtgctagttgtgcagtggctggtgggttggtggcgggtgtccttgtgttccatgctttgtggttccagccggggttggcttcacgtgggacattggtgtttggagcgtgtctgtggtctctcatggagtgggtcttctcgtaggtggtttgtctttgcgtgcggggtgttcgtgtgtgttgcgtgtcgagggagtgcgacagaagatcgagggcaatgtttatttgtatatgttgtgagggggcatatgacccagcgatgtcatccgcatctggcatgtacatgggtcatcgtagatgtcttttatgtggctcgttggttggtttctgagcgttcgcgttcagcctgataggcaggtggaagcgcctgcctgtctgaccatctaagtgctgcttaacaacagtggtagcgtcatacatccagtgacctccaacgttggcgatgcatattatctagtgcagctcagtatggacactcggccatcatcaggccatccaatattctagcataatgtttcgcacgaccgttcacaccatatttggcacatcggaagcacatcatgggccagaatgttgcagattacatgcgctacttaatggaagaagatgaagatgcttacaagctctcgtatagcancatgagctttcttatacatctnctccatcatgtc

SEQ ID NO: 566270 - DNA, 436 bp, Homo sapiens
tcgtgccgccactctctcccttccttccttctttttacctatccatgtggaatttcactttctctatgcctgtcctagtacttagcagactcaagggaacccctgtgtaaatttctgcagttctttttctgcattgctctttttttggggaactctgccacacaacttcaagctgaatcaactttcctgagctactatcactgattctttaagtcagcaaggctgctgagcttctgtttgattttttctggctgagcccatgacctagaagacaactttaggtagaaaattcctggtccttattaaactcactttgacagttatgctctctacacagataccagcgtctcatgtgccttgtttttcaatgtatgaaaatggctggttcatatttttccccatttttttcttgtttttaaggaaaaatcaatgttgt

SEQ ID NO: 566271 - DNA, 1029 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 566272 - DNA, 1404 bp, Homo sapiens
  misc_feature (1404)..(1404): n is a, c, g, or t
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcagaaaaaaaaaaaaaaaaaaaaggggggggggacggggaaaggggggggggaggggttttagagggccgggactttggtggacgagcgaaaacccagcggcccccgggcgctcgtgcattgtgaaagggcgcggcacttaaatgtggggaggatccgaggggtttctacaagtggggccccaaaccggctctggtgtctggccaagagatctcgggggacaggcgaagaatggactaagtggaatacctgaaggtttgccatggaagtggaaatgtgcactaaaagtggcgggaacggtgtaggcgtacacaagaagagttgtacgcgggggcacgcacaatagagcatgcctcgctctcgtctgcgtattcccgn

SEQ ID NO: 566273 - DNA, 1146 bp, Homo sapiens
  misc_feature (1112)..(1112): n is a, c, g, or t
  misc_feature (1134)..(1134): n is a, c, g, or t
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcagggacattttgggacggttccacctcttctttcaacttcttccttgggcttctgttgatagactggatactctcgtatagcancatgagctttcttatacatctnctccatcatgtc

SEQ ID NO: 566274 - DNA, 456 bp, Homo sapiens
  misc_feature (395)..(395): n is a, c, g, or t
caccaggggtgtgagtaaggtggtggtgctggtggtgggaggtggtcatgttcatgggataataaacgtaactatcaggacttttcagttactctaaatttggtcttcctggtgtgacttggttattttgcttgaaatagatgttcaaaatgtcaacaagtgatggcttgcagtttggcttgaattcctatgatgtgcagtgagttgtatatatgcagtgttaagcctcacaactatctctgcaaatcagaagaattaaacagtttttcagaaagagtaacacggggtcctaggttgatttatttctttctttaccaaacagtggtcggacagtctcccgagtgccagatactctgctagatattagggatgcctttgggcagcttaagtcttancgtaaccttaggcaggtaaatagtctgtagagaagtatatgtggcaactgtctgtggatgc

SEQ ID NO: 566275 - DNA, 755 bp, Homo sapiens
gtggaaggaatcgaaacccaagatggtgaaaggaacgctaatctcgcgtacaccattcgccccaagtaacccagagagacacagaagaaaatgctggtgacaaccttggccagaaccagaacacccaacatggcccatgacctctttacggtaacggtttcgcaccaaactcaatgaaacaagctgaagtaatcgcaaggatacagtcctgcagaggaacaaccattaggcttaataagagaaacagatccagccaaatggctgatgacacagtggcagaactggacaggcatctggcagtgaagaccaaagaactcctcggatgaaagtccactggggccatgcaatactccagagcccagtgttctgctggatcccatgggtggcacattgggacttctctccctcccccatctacacagaagactgtcaccatgctgacagaagcctgtccatgtaaggcccagccttccaggggaacacatcagacatgttcattctcattcctgcttactagtctctgggccggtgtggtcggtctcgtcagcaaaatagctgtgctgacgtggcaaaaggcctgtactcaggcatttggcttcgacttgatgttgccaagggactgaggccacttggcaggattagtaccacctgctcctcatctgtaggaatctccttctcaaataattaggcctctgttcccatgttaaaactctgatattggccattcacaaaagatttggacagcctattagagg

SEQ ID NO: 566276 - DNA, 180 bp, Homo sapiens
tcagcattagtgtacctggagcgaagcggacaggctagtactgccagaaacttcccacccagccaggatcctccggggacctgtacaccacgagcagccagctgaccctgccggcacacagtgcctagccggcaagtctgtgacaagccacggtcaacccacaagccacggtcaacccac

SEQ ID NO: 566277 - DNA, 125 bp, Homo sapiens
tctgatacacctccaatgtttccggcatggcgtgtctagaccatggacggagaacgacagtattcatgggaccactgaagaaagagctgaagttgcaaatcgaagaaggtagcgttaattccagg

SEQ ID NO: 566278 - DNA, 311 bp, Homo sapiens
gcccgtctctacaaaaaaatacaaaaattagctgggcatggtggtgcatgcctgtagtctcagctactctagaaggctaaggcaggaggattgcttgagcccaggaggtggaggctgcattgagctgtgatcactgccactgcactccagcccgggtgacagagtgagaccctgtctggagtgcagtggcagtgatcacagctcaatgcactccagcccgggtgacagagtgagaccctgtctcaaaatatatatatgaagaactcttaaaatgtaacaataagcagacagttccaattttttaaatggca

SEQ ID NO: 566279 - DNA, 820 bp, Homo sapiens
gagtggcggagggcggagggaacttgcaccgaaggtcatcactcgagaccccaaagcctccagggcctgagtgcccagtccagcgtcccaatggatgacaaaaatgaagaaacggagtcccatatgcccctgtcctgtgcccagccatgcccatggccccaggcacactacggagggtccctgtgcctaccaggccatcagctggctccttggccctaggacttcctcatctgccatcccccaagcagcgggccaatgttcaatgagcagtaggcgaagagaagtgccgtccagtcctggctggaggtgtaagcggctctgctaggcacgcccctgcagcactccttcctgaccgtggtgactgatgtctatgagatggcacggggggactcctgaacctgcgtctctgatttccactctggccggctgcaggccttcgggagaggaatgctcctttgacgcagctggagcacgttcggggtgatgcagggagaagctagcccgtgcctgctacttcagcctggatgtgtgtggcgaggaggaggacgcatgaacgaggaacgaggatggggtcactgacggggctgccaagagtgagcgggtgaacgactgtggctgaccgtaatcctggaccgcgctgcttaagccatcttggacagacctccagtggttctatggtttccttttcccaggaacccgtctatttttgttgtgtcctgcggcgagccaggtccgtcctctcaaggcctccaggggtttccccccaacacttcccccctttgggtctgccatttcccggtgccacccggtgggtttttcc

SEQ ID NO: 566280 - DNA, 185 bp, Homo sapiens
cattctagagcctccggctcagtcccaggctgcatctgatccaaatgacacaggaccctcactcatacatcagatgtcacaaggaatgatgtaaggtaccctatgagtgtggaatccagaaacgcaattccgtgttgaccacagacgacccaggtcatcctgacatgtcctctatgtgccctagg

SEQ ID NO: 566281 - DNA, 1985 bp, Homo sapiens
  misc_feature (1985)..(1985): n is a, c, g, or t
ggtccgcgagccagtccagagagttgcggactgaagtaatgtactctcctgtgaggagtagcgtgctaagattgcttgtacagtgcgacgttagctggcgtgccagaggatcacgtgactccttcacatcggagggcccggacgtggtcatcccagaaatgctttatgtcggattacatcatattacgattggcttgcaagaaaattttccgatgaccgtcttaacactctgtctgtgcaggaggactggtgactggcgtggaggactggtacgtcataatcacgtgtgagaggaggcagtaattcatatggaaggctgtagtacacatctgtgttgcatgcctgtgtcaaggcaaaaactgggcagctgatcctataaggatcattgggaaaggagagggctggtctggcccacgactgctacatatggcgggctgaagcagaaagaatgggtacgacatgcgagaagaggcataactgggctacgacgtgttttgacatctcaaggaggcaattaagagagtgcgatagatggctaccaattcttggacaacgttagaggcaaagcgccattgaatccaaagtgaatcgtgtgatgcgtcgcgaggcttcgggtgggtttcacagggagaaccacaatagggaacttaaagaacggttcaacgggctatgaaacatctggcataaggaacggaccggtaatccacttccaaagatccgcataacgaacggggaaacacaagcagcgaagctacccagtgagacgtccgaacaatcggggttgcaccaacagggtttaagcggaagacacgcggaaaagcctcacgccaaagagcgtgtccccggccttgccaagacgcgcaagacaaaaatcaccaacgcatacagttgactgaccatcactgacatattcttctcggaaaaacgccgaacgcacacagagagatcacaacaacacacatttcgggtgactcccaacatatccaggagatacgagacgagagtaaagggagctttacaccggatgatatggggatccaaccaagcatcgatgatcgccccccgtgatgtgataaatacaaagttaaccaggcgccacgtatacatttttgacacagagccaggaaacggaagagagcatcatcaccctaaggaaagcatctagaaccatgtggactggatttctacaagagcgcaactggaagatggccccaaaatccatcgtggtacgggaaacctaacactgggtgccaacagcaagagcggggcaccgcacgatgtgaaacgtcggacgcacttgagcaaacgagtgcagacacacagagggacgctgcaacagagcacacacacaaggcacgccaaacaacgtgacacacgtcgcgaggacacaaaggcaccacactcaggcggcctgcaaccacaggcaagtgacagaccatgccatcgcgaacctcagggcagccaacacagcagcaccctagcggcggacacagcacagtgcacacagacaacgcagagcggggatcacacggccacggacacaacgcccgacgacacaccggcagaaggcgaacacacactgaagcgaactgcgacagcaacgacacagcacagtcacacatggatacaagaacaccacagcgacagagcaacatcacatgccgcagcagtagaacacgatgagaacgacaacaacgaaccgagaaaagtcagaagaaacacaaacgaggaacagagacgaagacacgggagggaagaccacagaagacacaacacaaagcgagagagcgcagagagacagacagagtcgaacgacagcgctccagtgcaaacatcgtaacgagcacaacaagcgaggagagcgcaaacaacagtagcacaagtgacactagacagacacaccaggcggtatagacagacatgcgagagcagacacacacaagtgcgcaagtgacagtcagacgagcacaacagggagaacacan

SEQ ID NO: 566282 - DNA, 200 bp, Homo sapiens
ggacaaaatcatcaacggggcgcacttctcaccgtgctccgtcaatcctatcagcatcttcattacgcacctttccaactatggtaatgaccgccttggcctgtacaccttcaagcacctcgtgcgcttcctgcactcctggaccaacctccggctgcagacactgccccacggtgcgtaggcccaacacggtgcgttgg

SEQ ID NO: 566283 - DNA, 426 bp, Homo sapiens
ccacgtccattcctatagtgatgtggatagaaccaagggcttcccgcagggggcagagcactccagccaagctacagctcagcttttgttgtttatggttttgtttcctgagacagttttttccgggtacactagactggccctaaccacgtgacagtcctcacttgtgctggaattagaggtgtgtacaccacacccagctcttgtaagatatgattttggttatttgtcttggtctgattaaggtaagatcccataacttgacaagaaatataagatttttcttgtaattttagacaattattaggtgtatctgcatagcatttatgttatatgagaattaagtttaagctttccagagagtagcggcctagggagccctccctactctcttgaataccatcaataaagttcgctgcacccaca

SEQ ID NO: 566284 - DNA, 151 bp, Homo sapiens
gctgtgtccacatgcgcacccttctgacccaccctagcccctggcatccccagagccacaagtgatcccattgagggaccaaatacagcaatagacacacgccagtctgagggcaacctggactgaccggagaccgagggaagcagcgtgc

SEQ ID NO: 566285 - DNA, 711 bp, Homo sapiens
ttcggcactattatatagtatagtatatatatatagtatatatatagttttatatatatatagtctagtgtgttatctttcttctctctctccttctttcttctctcttcttttctttctcctctcccttttctctttttcttttttctctcttttttccctcctccctctctcttcctcctctttcttttctcttttctttccctctccctctttttctcctcttcctctctctttcctcttttcccttttcttcctcccctctccttttcttcttcttcttttcttcttcctctcttcctttctccctcctcccttcttttcttctcttctctcttctctcttcttctttcttttcttttcttcttttttctcttttcttctttcctcctcttccctctctctccttcttcctcctctctccctcttttttccttctttcttcttcttcttcctctctccttttctctttttctttcctctttttctttttccccctctcctcccttcttctccctttttttctttctctctctttttctcttcctcccttttccctctcttttttttctcttttttcttttttcctttttcttctcctttctctttcttcttcttttctctctctttcttctctctttctttcttttctctcccctttctctctccccttctttctctttttccttcttcctcttcttttctctcccg

SEQ ID NO: 566286 - DNA, 291 bp, Homo sapiens
  misc_feature (34)..(34): n is a, c, g, or t
  misc_feature (41)..(41): n is a, c, g, or t
  misc_feature (285)..(285): n is a, c, g, or t
atcgttatggctcattcagggcacactaacgaanttctgtntcaaaaaaaaaaaaaaaataaatagcgtatggtgggaagcaccttgcatggagtttctcatggtaaggggtgggaaaatggtggtaaaacaaaagctggatatccattgtgaagtgttttctaaaaaacatttaaagaagcagtaataaggtatatggggatgtaattgtggcccccataagggcagctatagttttggtcctttaacgaaaccctgtgaatgtgaatagaaagaaccctgtgnagttta

SEQ ID NO: 566287 - DNA, 109 bp, Homo sapiens
aaagcgacgtgagaacttttaacacaacgattttattgaagacggggactgatgaggcaccttcaaggagtaagtatgtcaaaagaaatgtatagccaggttctaaaaa

SEQ ID NO: 566288 - DNA, 204 bp, Homo sapiens
agtagtatactatcgtacgtaagagctgcatagaacaaagccttcctggagagagtaaggccaatcgtcagctagctcaacccgtgcctggcacatagtgagcactcaggaaatgttagctgctctatatatttattatatatattataaacaaatttttcacccctgtgtcaaaattggttttatcataacaatcattgggca

SEQ ID NO: 566289 - DNA, 107 bp, Homo sapiens
tcagtgagtcgggacgagagctcgcccttctactgctggatgaatggtgaccgcatcgactccctgctggagaacggccggcagcagacgcacatgctggagtgtca

SEQ ID NO: 566290 - DNA, 150 bp, Homo sapiens
tctagcggatcctgtggtggttgtgggtaggacggggccctggtgtgggacaggacgggggcaccttctccagatgatgttcctggaggaggcaggaggtacctccctctccctctacctggggcactttgagtctgtggctttggggtg

SEQ ID NO: 566291 - DNA, 156 bp, Homo sapiens
cttggttggcgatgcgtgtgccgtggcgtggtgggttttgtatgttctcactgtcattttatttttacgttgttagatatggggagtagtgtgattgaggtggagtagattagcgcgtggttgacagtacgacggttatggagggtgatggtggct

SEQ ID NO: 566292 - DNA, 295 bp, Homo sapiens
attacgtactgcttactcgtaatgatctagtggggaaacgtgatgcattcactgagagtactgagtaagcgatggcgggtactgactgaagatgcaatccgaccaaagccattacattttttgagttagatggggctgtctggatagttgaacctgttccctttataaaaaaggaaagagagaaaatcactggtgtgtactgaatagctcacagattagatgaggaggtgatggtaggctttgggaattaaaagcaaatacattttagtaaggatgtatttttaaatggtcaaag

SEQ ID NO: 566293 - DNA, 213 bp, Homo sapiens
  misc_feature (15)..(16): n is a, c, g, or t
  misc_feature (21)..(21): n is a, c, g, or t
  misc_feature (82)..(82): n is a, c, g, or t
  misc_feature (127)..(127): n is a, c, g, or t
ttctaataaccaacnntctcntcccttagaaaacctaccctgcagttaggactctacactaactcttaaagagtgtgaaaanggcacctttacgtaaaagtgtcaccaaaagtaagcagcgggatgncatatttattatcctgataacacaaatctttagtaacagcagcgttaatagtcaaggaggaacaccatatagtggtaataggttcc

SEQ ID NO: 566294 - DNA, 95 bp, Homo sapiens
  misc_feature (77)..(77): n is a, c, g, or t
gagagaactgacccagtccctgaggacggagaagatgtttcctgccacgatcagtgcacagagaccctctcggaggnggagcaggaagagctaag

SEQ ID NO: 566295 - DNA, 992 bp, Homo sapiens
  misc_feature (13)..(13): n is a, c, g, or t
ggaatgttcaggnttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggcttttttttttttttaaagagagtgtgtatgtactttttctctctataagggccagggtgttggtcaaattcaccatcgattaatttatatcttctgtggtgatttttttcaactatataacaagtgccaactaattgtccatgggacaatctacttttccactcaatttatcgttttgagtagggaaaggttcatttattttcattacctggcattaagttaaagaattcattatttggcatacatttgagtcattctgtgacctataaagtgtttttgtaactatctaattctaatggttgcaaagcaaagcacatgactgtaaaaccaagcaaggtgttttagtaactttttccctgaatacttggtagttcccattgatactattccaaaacaaattctgctgtttaaggtggtatattacttggctttggttctaagaaaaagccaggactaaatcacttgttttggtgtttcagtaatcagtttaaaatctaagatttttttttaaattagacctatttaatgaagtgccatgtaattgtagctggctaggtggtgcacgtggtgtcacatcagccgtgcttctgggtggcgttgtttttaacccctttttaacatctcttcgtgcatctcgctgggagacagggggtcctaactctttactggagccatttttctccgtggaaaattccccaggtggtttatttttctattcttaccggtaaccagttgttcgggttggtctttagcaattggcccttgagatttttcc

SEQ ID NO: 566296 - DNA, 141 bp, Homo sapiens
actcgctattcatcggcaccctgattaggaggcgtgctgagcaggggagaaacacaacttcagagtgtaaggctatggaccatgggggtttttcatctgggaatggctcaggaagcccagagtctccagggcattgctctc

SEQ ID NO: 566297 - DNA, 365 bp, Homo sapiens
ccctgcagcagacacagcatctgggaatttcttagaaatgcaagcttcaggccctaccccagatgtaccaatcagaagctggaagtggggcccagcagtttctaggtaacctgatgtcactatagtttgaaaatcattgctttaataaattgttttctttttttaagagacagagtctcactctgtcactcaggctagggagcagtgttatgatcatagcttactgcatttttgaactcctgggctcaaggtattctcccacctcccaagcagcagtgtctcaccgtagctaggactacaggtgtgtgtcagcatgcttgggtaattttaaaacggttttagtttgtaaattacaggtcttgcta

SEQ ID NO: 566298 - DNA, 838 bp, Homo sapiens
  misc_feature (239)..(239): n is a, c, g, or t
ggtctccaagcaagatggcggaggagccgcagtctgtgtggcagcttcctacttcaatggctgctggaggggaaggacttacggatgtctccccagaaaaaccacccggagccccgtcttcggctgcagtttccccgggaacagaggaacctgtgcgacaccaagaaaaaaattctatttatgtgaatcagtccttgggctcttccccagaccaagaagtggaactctctatgagtgtnggcagtgatggtaaagctgttttacattactgcaagtctcaggcgtggggatgaaccaaaagaaaatcaagtgtgctactacatgaatggactttccaggaagagacagtctgaaaagttggatgctgtgtggcaagagacttaacagatgtgatctattagtacatgtgtctactctatgtttatgcataagaaaaacatccatagcatgactggactcagaaaaatgtgattgtattaatgcacacagtcattcataaaagactggtcatgatagtacacccaatgtgctcctaactgtgttgactattaatgtgctgcagatcttggcttccaagggtttgaaaaagggaggcctaaggacgggttttaccccattcttccatgtgcgaggtctcaccactcggcgtgacattgttcacgtcgaaaagttcatactacttaaggggtcccttgtctccaaagggtcacatcacacgcctcagtccacctttttaggccacattggctgcggcggaatacccaaaattgccagtaacggcgcgcccacgcacaagtgtagggcttggcacacttggcgggcagaaccggcaaggggc

SEQ ID NO: 566299 - DNA, 495 bp, Homo sapiens
cgacggtcccaacagcttcactgatgttcatggcactcacttccaggaagccattctcctgagagcttatgtaccttaaatcccagttctgaggtgtctagggaagagacaatcgtccattaaggatgacagcagggaagtctagtaacttctctcctctccacgatacttagcatgggtgttggacacagcaaggtgcctgacccagtgactgtggacttactcatggtggatgcactactctatttccttgggtccctttcccaatttttcacaccccttggctccacgtttgctttaactctcggtatccagaacccatgcttctttgtgagagggctgccctcatgcttctggagtctcctttacctgtgtgcagagagagtgggggatacctagaaacatgcatccctctgagatggaccttgagcaatggagggaggggctctcagtctccaaatctcctctgtgggaggagccagtggcctgcaagca

SEQ ID NO: 566300 - DNA, 389 bp, Homo sapiens
tgagtctgcgttgtcggcgttgtctgggaggcgaagtaaggggaagagcctggatgtaggaccggagatttatagccggcgactcgcacggatcgtctggtagatattacgattaattgttcctcttaaaggtgttggagtagttcgttcgcggatgatattattaagattactgttaagtgttcagaagttcatcattgagtgcttacttttgcgactgttcatcatgagataaaaatatagtcatataagacaaacgtagagggaatattagaggatgccccctcctaatctcgtatagtcaccgatctcaccacccctcgaaggtaaaaacgtacgcccgccagaacggaaatagaataccagcctaccttccaatatcgcccttg

SEQ ID NO: 566301 - DNA, 688 bp, Homo sapiens
  misc_feature (322)..(322): n is a, c, g, or t
  misc_feature (341)..(341): n is a, c, g, or t
agatacgttggtgaagaccagcctgaacgggacagatctgacgaagtggccgggagcatcgtgcgagtgtggtgtctgtaagtgtacagatccgaagtgtcatagggcaatacgtgttgatatgtgtcagacctgcctatggtgtgtgtgctgaggcataaaagaaatgctgatactagctgcacgagccgattcgagactatcaaggacgaacaagcaaatgacgacgattgctacgacgaggaaatagttgcatatgttataactaattacccacaaggatcagaacagtcggggaccaataattacccctagctcgggntccaatgcttgatccttgntgctcccattgtacacggagacggatgttcgacggactgttgtgattctatagacaggtattctagttgcaatgggagctaaccgaggtcatgggttgcacgtagaggggactccagagtgtcctcactggttctcacgcacatcattccaaattgtagctggtgtggactgcgggaattgttcttggatgggcttgcattattgcatgagtatggaagcttattaaatgatcattcatgacggaacggagtctgctaaatttgacaagggtgaactgattgaaatgggacacgggtgaaaaccttattaataaaggggcggagcacttgtgggacccgaagttagg

SEQ ID NO: 566302 - DNA, 290 bp, Homo sapiens
aggtggtctatcacggtggtctagtccacggttggtctagtcacggttggtactagtcacggttgggtactaatccacggttggctagtatgtcacggttggctgggattacaggtgttgaggcagcacgtccgccctctgccgttctatttacgagagagtatctgctctgttgcccaagagtgaagtgcagtgggacaatctcagctcacgctgagatcccacctcccgggttcaagcgattctcctgcctcagcctcccaagtagctgagattacggcactagccaa

SEQ ID NO: 566303 - DNA, 583 bp, Homo sapiens
  misc_feature (477)..(477): n is a, c, g, or t
ggaacattttgcctgtcctagaagcaacggtcttattttcacaggcgcgatttgctattcagaatgaaatccagtgaggcgatgggagatggctgactatgccgaggaagtcagccacttattcaaaacatagaatgactcccaatggcattcaatgtattgtcaggaattgctgatgattgcgaaaaatgtcttactcattgcgatgtctgtaaaggcagcaatgaactcacgggatttttggatggtcagcaaacaggcgctcagagtaaccatgagccacatatatatgctatactagataaactatgtctcttgcctcctgtcataacaattacccagctatattgaagcatgagctcttgtgccgcacgttatcactgatggagtgactgtagtagacatatgctcctctaacatgttactgcacttccaacccaataaacgtcccactatatttagaacttgcgtgatctncacatcgttacctattttagtagcatccagtagctcacgtttaaaacagatttagtaatagttggggacctgctattccgtctacactctcctactgatgtgtgtc

SEQ ID NO: 566304 - DNA, 234 bp, Homo sapiens
ttcttcccacgtcatccgtaaccctacgtcgcgtaatcacataaccgtataacccccgagcaatctcaagtgagcaatatatacaccagcaaacaatgacaaccagtaactactactaatcaacgcccataatcatacaaagcccccgcaccagttctaagtcggctgctaggcgccggccgaggcgaggcgccgcgcggaaccgcggccccgggggcgagcttggcggaatca

SEQ ID NO: 566305 - DNA, 437 bp, Homo sapiens
  misc_feature (61)..(61): n is a, c, g, or t
  misc_feature (116)..(116): n is a, c, g, or t
  misc_feature (158)..(158): n is a, c, g, or t
  misc_feature (192)..(192): n is a, c, g, or t
  misc_feature (271)..(271): n is a, c, g, or t
  misc_feature (300)..(300): n is a, c, g, or t
  misc_feature (382)..(382): n is a, c, g, or t
  misc_feature (410)..(410): n is a, c, g, or t
  misc_feature (422)..(422): n is a, c, g, or t
ggctgcaggaattcggcacgaggctgcccggcgcctgggaacgatggcagcagggatgctnaaaggaggcgctctataggcggaatctggtagagagtgagctgcagccgcctccncaggtgaggagccatgggcggggcagccaagaaagcgggcanaggcccgataccgggaagagccgacacagccacnaaccagacaagcagacaatcagcggacaatcggttctggactcaccctcatccgggcccccagcccgccaaaagcctcngtggctgcgggtgttgggaaccatgcctngcagccagtatgtgcccctcacccaaggcctggctgggccttggagaatcctgtttgcacagcccaggggttgtccgggctntggccggcccccggagcagggaagggtngcttggggcaancccgaagggcccctt

SEQ ID NO: 566306 - DNA, 669 bp, Homo sapiens
tcgcacctgtggtacaggcagacagccaagtgagccaccgctgcccagcacagagcgtccttccccctgtagactagtccctagggagtacctgttgcccccactgactgtggccccctccgtgatcccaacccatctcccgggagccagacagagaccccaggaatggaaagacggagttcctaacaacggatgaaagttcccccactcacgttccccccgtacctcccagccagtagctttccacactttgtcaccacgaaatcacgaggagagatggtgttgggagccctttggagaacgccacgtctcccacggccccctgcatctatcgagtttgccatgtcaccacctctctgatcttgtgctcacgcactgattctttaatagagagttttattttttcgtgcacctctgctaatcatgtgggtgagccccagtggagacacgcgggagacctgtgctagttttacagattgcctccttatgacgcggctccaaaggagaacccagtggtcacggagttgtttctgaccccctgatctctactaccacacaggagaatagtttaggagaaacccgcttttactgtttttgaaaaattacagcttcaaccctgtccagttaaccagggatgcctgtgcccataaaaggtttctcccaccttga

SEQ ID NO: 566307 - DNA, 436 bp, Homo sapiens
ggaagaggaagagacagagagagaagagaggagagaagggaagagagaggaatatggagagaagtaaaaaaggaggaaagagaggaagatgagaagaacagagaagggaggaagaagatgtcgacagaggggggaaagagacagatatatgggaaagtcaggaagagggggcatgtagaaaggtaaggtaaaagaggaggaagaacaggtagaaagcagaagagaggaaaaagacagtggggaaaggagactcagaataaggagagaggaggaatgcagaggcagtggaaaagagagttcgtgagatgaggggaaaaaaggatgaggtataactaaagcaagcaatctctatctctataacacactctctctatctctatatatctactactctctatatatatatatatatatatatatatactactactatact

SEQ ID NO: 566308 - DNA, 357 bp, Homo sapiens
ccatcccaccagcctcgtgccccctgcctttgtgattttgctgaaatcatttctgggcacggaggaaccattcattgagcacacagtctgagccaggccgtctgggtaaaggcgatcggccctattcttcgggttaggaaaccgaagctccaaaaggttcaggaacttgcctctgtcatgagcgagtggcattagcttggtaccttgtatgtcaagctgggcccccaatgccccattctttccaccgggccgtgctgccctcatccatcctcgccatgtgctcaccacggccattccccagttctgggagtctgtgactctaccctagtctagacactttatgatggaagccacggt

SEQ ID NO: 566309 - DNA, 120 bp, Homo sapiens
atcacgcctggcctatgtttatttttaattccttaatacataagaatacattattctcttataatagtttaaggtatacagatattttcttaaccattactgaaagtatctgtggatata

SEQ ID NO: 566310 - DNA, 273 bp, Homo sapiens
aaaaacaggagcagattgtgacagaccattcccatcggacaagtggctcgaacccgacatccaagacccagcgagcagccaatgctcagagcaacctctgggcttctcggtctgactccaaaagggtgagcacgtcgccctcgcgcacggggccatatacattgcggactgatggatcggatcgtgtcgtccatgacttccacgcgcacttgcgttgcactgtccctgagaaccggtcctgcccagaaccttggtgaccctggccagtttgat

SEQ ID NO: 566311 - DNA, 140 bp, Homo sapiens
ggcaaaccagggtggaggaaggagcccagggcaaaaccaggacaaagcttgctgggcagtgtccctcatggagtgcccctaggttccccccatttgtggccaatattttcaagatttccctttaaaaaaattttctggaa

SEQ ID NO: 566312 - DNA, 287 bp, Homo sapiens
cccgactagcccgacaggagacaggcaggtagggctgtgtgggctgcacctcgtaccctcccaccagaacgcacgcccactgggagatgctggtggtgcagccttcccctcccttgtatcagacactttgccaaggctctcccttctcgccccatccttgctagcccgctcccacagcttcctgaggggtaattctgggctagtcgtgtctgtcgggatattcggggctgtcgggctattcggggacagtcgggctagtcggggactgtcgggctagtcggggagta

SEQ ID NO: 566313 - DNA, 504 bp, Homo sapiens
cgatattataatattgtaaaaggaaggtatcccatataagcagctagactgcgagtggtcccgtctccttcagtaccccaacttctgtactgcttcttctgtagtatcttatcaaatctattacttaaccagtataatagcctcagctgagagcaggtcccagtttatcctacacattgatggcttccagacttgtctccctcctacttatctgatccagtttcttttcctaaaatttcccctattcatctgttgtcacattaatatttctaaagtatactctgattacgtcatttcccagtttaaaaatcttcacttgtctggcatctagggatatccattatttggcctcaaaccaatgttgaacaacttttctcccagaactctctttgataagccaaatcgaagccaaacagaataaccaactttcttacacacaaaccacatttgcatgccactatgccttttctcaggctattccttctgcctaaaaagcctctcaca

SEQ ID NO: 566314 - DNA, 212 bp, Homo sapiens
  misc_feature (148)..(148): n is a, c, g, or t
  misc_feature (153)..(153): n is a, c, g, or t
cccacctggcccttttgggtgacacagccggtaaacggaatcacgtatggttctttctgtgggtctgtggcacaacaagaaaaagccgggtcccccaacccctttgtgaaagccccaccatggttggtcccacaccatgggaccaggntggcntgagggatgcccagttgtaacaatgctgctgtcactgtctcattaaatatacatcctcc

SEQ ID NO: 566315 - DNA, 651 bp, Homo sapiens
  misc_feature (335)..(335): n is a, c, g, or t
  misc_feature (337)..(337): n is a, c, g, or t
  misc_feature (640)..(640): n is a, c, g, or t
agaaagatggcggctaccttactagctgctcggggagccgggccagcaccggcttgggggccgacgtttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtatcttatgctgtcacctaccagctcggtttccacagcattgaactgaatgagcctccactggtcnanacagcagccagcctctttaaggatatgtgttaccgataccggtaataccttatttctttaatcatcaactcatatcttttaccctcaagaaggagggcaggtgtactcagtgcctatggggggtatgatggtaaggcagttctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagncattgcagagt

SEQ ID NO: 566316 - DNA, 770 bp, Homo sapiens
agaatgtcacatagctgtctcacgtatgtcattttccactttaggaatttccagtattccaaatatgagaagctgagaaaacaaacaacaaactcaaaaccctaaaaaccaggatacgtaagggtagatgtttgttgggtgtggatttaaaatggactttttttgccccaagcaacaaagaggcaccttagaaaatagacaagagacaagaagaagagaagctttaagagatatttggtccaaggaagagactcttcagatggaaggtcacatcagctagaaacattaatatgactggatgggctcaaaccactgacttttcagtcaacatccgacagcactaacccagtgttccagagacactgcttgttaaacagtgaaagctgttgctcaattgtgtcatccgtaattgtcaaatattgccatttagtagcacaaggaagtattctccgttgccaagctagagtacccataactcttctgttttgttgaacattcttccccaccacaaaccctctttagaagactgggggcccctaaagcattgaggccgagagtcccgtccttgtgcatgtttgggcattgacccagggccaagtcagtgggagactcctccacgcctacgccaggtccccaggtgacaactgcagtctctggatctgaagtcatccacttttccattcctagctcacctcacccatcgtgaagcctggttagtattgccagagacccgagtgggcagatgcccacaccaagacagtatcttctcg

SEQ ID NO: 566317 - DNA, 106 bp, Homo sapiens
ccgtgatgtatcccacacatacagtctatatcatgagtagctagtatatgcattctatgcaaattcaatctgatctcagcagatctgctgggaataaaaagggggg

SEQ ID NO: 566318 - DNA, 290 bp, Homo sapiens
  misc_feature (113)..(113): n is a, c, g, or t
  misc_feature (220)..(220): n is a, c, g, or t
ctcaaagtactgttaaaagaaaaaaaaaaaagggataggagagacccttaatgtgcaccaccacacccagctaatttttaaaactttgtatagagatggggtctctccatgtngcccaggctggtcttgaactcctgggctcaagagatcctcccacctcagccttccaaagtgctgggattacaggcattagccactgtgcctggtcatgtactatatngctttgaaggtcttagccagaccaatatagatagatagatagatagatagatagatagatagatagatag

SEQ ID NO: 566319 - DNA, 979 bp, Homo sapiens
cggacgcgtgggtttgactacccgccgccggccactccacactgcacggtcttctggcttctggtggacctgaacagatgtcgagttgtcacggatctcatcagtctcatccgccagcgcttcggcttcagttccggggcgctcctgggcctctatctggaaggggggctgctgccccctgccgagagcgcgcgcctggtgagagacaacgacagcctcagggttaagttagaagaccaaggactccctgagaacctgatagtaagcaatggtggcgactctagtttcccatgcaggaaagcaaagaaacgggcttttaagttgatggaggatgaggaaacagatcagggatacaagtctttgaagaagcactgcaagaggcaggaggacagcggccagaatgagaaggcctcggacctggaaactaaactcctcccagatgagacggggcggacaaagagcaagaaaaagagcaaagtgacaggcagcccagccgaagaggatgaggaagagaccaaaaagaagtcttcaaaaagaaaggagaagtgtgaaccgaagaagcagaccaggggctccaagtcttccaaacaacagacgcctaaagagggggcctcacagaactgcagcttcccagggcctccccagaaagcctcgggtaaagcccgaagggagaagcagcacgggggtaaaaggtagctcaggccacctgtagaaagctgaggtcggccagagacagacaagaaggccacggaccggccagatgcacgaaggcacctttcagagaacggtgcgtcgagccgttgacagaatgagccggtgaccaagaatggcagtgccaaacagaggggcccaaagcagggggtactaaaatcagaaagaggaaggcccaaaacgctggccatacaacaccagaaggaaaaagatcaggggtccgacaaagcacagcacagacgcgacacacacaccaccggagagaaag

SEQ ID NO: 566320 - DNA, 115 bp, Homo sapiens
tgagcacctgctctggacactggatctccacaaggtagattggctccatgagtgcgtggctgggctggtcagcacactggcgtagagggagcgccgtgccgttaggccgatctga

SEQ ID NO: 566321 - DNA, 341 bp, Homo sapiens
cctacagactgctaccttggctgggaggtatggggaacttactcacgacacgacgacggaagacgttaattacagtgaactctcacttctttctaaagattgtgactcttaactaagacctggacctgacggaaaactaaaagggtggacgctttgtcaggattctctgggattgcagactttagagctcagtgagatcatcgctggaaataaccttgaagctgatgtggccttgcttgacttgggacagttggaccacccttcttacgcaggttacagagacttcagatcacggcagcggctggggtcagcatccagagtaaccagcacaaagaaccaca

SEQ ID NO: 566322 - DNA, 994 bp, Homo sapiens
aacagcaatatggcggatgacgccggtgcagcgtggggggcccgggggccctggtggccctgggatggggaaccgcggttggcttccgcggagagagtttctggcagtggcatccggggccggggtcgctgccgtggacggagccggggtcgaggcgggagctcgcgtaggcaaggccgaggataaggagtggatgcccgtcactcaagttgggcgcgcttggtctgaggacatgaagtatcaatgtccctggaggagatcgtatctcttctccctgcccagttaaggaatcagagatcattgatttcttcctgggggcctctctcagggatgaggtttggaagcattgatgccagtgcagacagcagacccgtgccggccagcgcgccaggtgcgaggcattgtgctatcggggactacaagtggccacgtcggtctggggtgttaagtgctccagggaggtggcaacccgacatccgtggggccatcatcctgggcaggtctctccatcgtcccccgtgcgcatgaggctactgtcggggaacaagatcgggaagccgcacactgtcccattgcgaatgtgacaggcgatgcggctctgtgctggtacgcctcatccctggaccaggtgcagtgcattgtcatcgggaactgtgcctaatgaaggtgtcatgatggtggtatcgagtgactggtacactcagtcggtggctggaagtgcatgctgggaaggttggcagggcagcttggaatgccaattttaaagacactaaaggttactgaccccgagtttgggaaggggactggttttcccagtttccctataaggagttgtgagactgtatgacccacaaggtttgggagtagaaaggccaggtgtcacacaggtttacaaaacaatgtgttgtgtgaaagaagaagaaaagaagggggatacaggggagtggttatagggtgataatagggaggagagtagatgttgaacaattagttg

SEQ ID NO: 566323 - DNA, 409 bp, Homo sapiens
  misc_feature (272)..(272): n is a, c, g, or t
  misc_feature (345)..(345): n is a, c, g, or t
  misc_feature (371)..(371): n is a, c, g, or t
  misc_feature (400)..(400): n is a, c, g, or t
atgtcacctagatccacgccgcgccgccagaagaaagatgttcgcctgcgccaactcgcccgcacccccgctctgatccgagctggatccagagttgcatatagaccaatttctgcatcagtgttatctcggccagagactaggactggagagggctctacagtttttaatggggcccagaatggtgtgtgtcagctgatccgaaggaggtttcagaccagtgtaatcagcagagacattgatactgcatgccaaattcattggtgcaggtnctgcaacagtaggagttgctggttctggtgctggtattggaacagtctttggcagtcttatcattggttatgncagaaacccttcacttgaagcagcanttgttctcatatgctatcctgggatttgncttgtctga

SEQ ID NO: 566324 - DNA, 820 bp, Homo sapiens
aaagttatgctacgtaccggccctcggtgtatagtacgagcacgactgctatcctgcactggcgtacatccacaggacaagagcatcaaagaggagacccccgattcctgctgaaccccagcagaggacctgtgctggcctgagggcccctacctatgtccttctactactgcgaactgctggctatactaccgcggtcaaactactagctatgggccatgagcgaatacacatggccttcctgcccctcgtcactaccggccctagcccagtagatgacctgcatcaccaacatcctggacagcattatcgcacaggtggtaggaactggaagatccagtgagaaagccctagttgggccgtgtgggcttatctgagtctgtgccgcgcgcggtactttgctgctaaggggtgccttagttggtggccttagcccccttcttacttacccaggttagccgggctcccccgtgtcttatgctcttacccccgcgaggggtggctatttggctagttagggctatgtgttgcgcatgtcccccctcatggcccattgtccccctctccgggccggtttggccctttcccaccgccttcttttcccaagtggacgtcctactatgtctccgcgtccagtgtgcccctacgtgcccgttggtggattgggggctgcatcccgcgggatgttccctccccgggcactccttttcccgccggccccctaccccttgggccttgcgtcgtgcgttaccctggtacagccctcccctttggggcggggccccccccttgtgtcttctggtgcccctctgtttgtcct

SEQ ID NO: 566325 - DNA, 361 bp, Homo sapiens
  misc_feature (110)..(110): n is a, c, g, or t
caaagggaatttttatattcaattgttccaataatttgcccaagggaacaagttcccctagggataaaagggcaatctttttttagagtccatatcaacaaaagggtttncgccctcaatgttggatcaggaaatcccgatggggcacccgctattaaaggttggtttgttcaacaataaaagtccaacgtgatttgagttcagaccggagtaatccaggggggtttttatttatttaaaattcccccctggagaaaaggacaaaaaaaaaaaggcctttttcccaaaggcccttcccccgtaaataaaattttttcaatttagtattaaacccccccccccccaaaaaaagggtttgtta

SEQ ID NO: 566326 - DNA, 298 bp, Homo sapiens
aacaccagttcagtatatatgtcaggtgcagttgaaatgcttcacagcttgaagtatgctatgcctgctgggaaagagaattctagaatattctgctttttatagtcacgtggcatccagttaaacttccaggagtaatagaggcatggattaattagaggtagtacgatatcatccacaatagggaagcacaagtgagctgtgcaagcaatgcagtcctcagaagtatcctaatgatgtcagtcataatttagataataagtaaattgagaaggagcctacgctctgacacccaggc

SEQ ID NO: 566327 - DNA, 248 bp, Homo sapiens
gccttgctcggtccatgccatgcactttctctcttgccagagttctaagaatgtgtgttctgtcccttagactttctgcagatgagtccccaggaagctccacgtgaagttcagtgacatgcctcaggcctcagagtgccccacatcgcctgtcgactctctcatggcctgtgcccacgaaatggattctctgactttgggcatcggagtgcaaagagatgcccagcatcaaatgtgcttgtagttga

SEQ ID NO: 566328 - DNA, 1142 bp, Homo sapiens
tggggaatgaaaaaataactttattccatggtggggagcgggccgatttccagcctcaaaaccttctgggaactggcttcttgggtggccgggcagccttggtggaccttgagcactgttagaacgccgcactggtctggctcaggaggccgggaattcgcccattggtggacagattgtcaccgatctgggactgtccctgaacgcagggggagacagtgtggtacaagacatgtgtttctgtggggccgctttctctcagaagcgggtgtgtacttgtgcgggattgatagtgcaaaatagctcttcggcgggatagacaatggggctccctctgtgcattcttctcactcttgggctcaccacggccaagagaggattccggcccttcgaaatgtgggacacttttaccagtgtgaagaggggcacattttcgtggtctacaagtgtttaggtgtgcccttcaatatagaccactccttgtgggtgtgttcttgtgaagagcccacagaacgcggagtgttctcgtgtggatagaatacgcggggggaaagctatcaatcactgtttggcacagagtttcttactcacacagaagaggggacacctatctattcgtgtgtgttgtcgagaaacagaatgtggtctcggctgtgacatatgtggggtatagggacacgggctatacaggttctgtgaaatgtgctccagacaaattttatttcccggggggagcggcacagaggtttcaacacatgtgggtatgtagacgtgaatattgcggcgcggaagactaaacgaatgaggatgacgaaacaacagggggcccccgaggagaacatgtgtttggcaagagggcacggagaataacgagcagggggaagaaagagaaagtgtgcccccccccggggggccgggatatgtacaccccactattcacaatacgtgatgggggggcggccccccaagaggggacacaccagaggggcgtggtgtatactgcgagtggagagcaatgtggggcatcaaagaaagggagaaatacccaaaatatgttggggagcaaaaaagaaggggccaccagaaagcacaaggaaggaggagaaattcgacataacaccccgatggaaaaatatagacca

SEQ ID NO: 566329 - DNA, 1015 bp, Homo sapiens
  misc_feature (198)..(198): n is a, c, g, or t
  misc_feature (940)..(940): n is a, c, g, or t
  misc_feature (982)..(982): n is a, c, g, or t
gggtggcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccaggcaagcagcgagcacgcgcgtcgccgccggncccggcccctcccccccgcgctcgcctcggaacttgctgactgcgcggccgggaggagccgagccggggcggcggcggcgggaggctacagcgcgcgggggtctcccgcgtcccctccgcctcgccgggagctcgcgccctcgcccagccgagctcccacccccgcttttttccgaaggcgctgggcggcgccaccctccggccggagcccggcactgcacaaccccctccgactttcaatgttccacactccccggccagagcctcctcggcttctttttttccctccccccccttcccccccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaangtggtgtgttttttctggatatcacattttcatcagattatncatttaagccaccaaaggttactttccgcacca

SEQ ID NO: 566330 - DNA, 1014 bp, Homo sapiens
  misc_feature (198)..(198): n is a, c, g, or t
  misc_feature (492)..(492): n is a, c, g, or t
  misc_feature (496)..(498): n is a, c, g, or t
  misc_feature (500)..(504): n is a, c, g, or t
  misc_feature (506)..(506): n is a, c, g, or t
  misc_feature (529)..(529): n is a, c, g, or t
  misc_feature (533)..(533): n is a, c, g, or t
  misc_feature (559)..(559): n is a, c, g, or t
  misc_feature (575)..(576): n is a, c, g, or t
  misc_feature (580)..(580): n is a, c, g, or t
  misc_feature (939)..(939): n is a, c, g, or t
  misc_feature (981)..(981): n is a, c, g, or t
gggtggcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccaggcaagcagcgagcacgcgcgtcgccgccggncccggcccctcccccccgcgctcgcctcggaacttgctgactgcgcggccgggaggagccgagccggggcggcggcggcgggaggctacagcgcgcgggggtctcccgcgtcccctccgcctcgccgggagctcgcgccctcgcccagccgagctcccacccccgcttttttccgaaggcgctgggcggcgccaccctccggccggagcccggcactgcacaaccccctccgactttcaatgttccacactccccggccagagcctcctcggcttctttttttttttttttccnaaannncnnnnnanaattattttaatttttttaattnaatntttttttttttttttttttcccacantgtatcggcacgctanngtcngggcggtttgttgaattttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaangtggtgtgttttttctggatatcacattttcatcagattatncatttaagccaccaaaggttactttccgcacca

SEQ ID NO: 566331 - DNA, 250 bp, Homo sapiens
  misc_feature (104)..(104): n is a, c, g, or t
  misc_feature (145)..(145): n is a, c, g, or t
  misc_feature (157)..(157): n is a, c, g, or t
  misc_feature (197)..(197): n is a, c, g, or t
  misc_feature (223)..(223): n is a, c, g, or t
cgggctcctgcaggcggggagatgtgcgcgccgcgatccggtacgtgggcctccgggttgtcccctctggggggggagatcctccctccggagcccccctacanccctcccggaagtgaatatttggaggaacagggatgatgtnctgctctcccangagacagacaccgagtcggtctgctgaagccctttctganactctggacgtctggatgctccactntgcttgacaagatgaagtgcgtcttgg

SEQ ID NO: 566332 - DNA, 249 bp, Homo sapiens
  misc_feature (160)..(160): n is a, c, g, or t
agagggtgttcgactgctagagccgagagtaagcgatgcctaaatcaaaggaacttgtttcttcaagctcttctggtagtgattctgacagtggaggttgacaaaaagtataaagaggaaaaagtatgttgctccagaaaagcctccgtaaggaacaaangacaggtgagacttcgagagccccctcatcttcttcttcagagcaggagcaggagagattataacatatttcagattgggaaaatgagg

SEQ ID NO: 566333 - DNA, 162 bp, Homo sapiens
ctagtagccaaggcgtgagctagtagccaggccgtggactagtagccaagccgtggactaggtagccaggccgtggactaggtagccaagccgtggactaggtagccaagccgtggactaggtggccaagccgtggactaggtagccagccgtggactaggt

SEQ ID NO: 566334 - DNA, 697 bp, Homo sapiens
  misc_feature (7)..(8): n is a, c, g, or t
  misc_feature (10)..(10): n is a, c, g, or t
  misc_feature (17)..(17): n is a, c, g, or t
  misc_feature (405)..(405): n is a, c, g, or t
  misc_feature (416)..(416): n is a, c, g, or t
  misc_feature (513)..(514): n is a, c, g, or t
  misc_feature (683)..(683): n is a, c, g, or t
aggaacnncnggggaanaggggaagatgggctgtgacccagaccctctgttcagagtggtcctgtctgtagattagctctttcctcctgaccctgagaggaagtgcgaggagacaggacaagatgggaggaggcattggaatctgattttactggttgaaaggtagcgctgtcacagagctgactgatagagcttattccagggcatccttaccattcatcattgtctcactggctcctttccaaaagcttcctccattaagagggtcagagcctcagcctcctttctttctagtgacaatttcctttgttttaggggattttaaattagggtgctgaaggcctggaagaacatgggtgggaagagaatgtaactctaagtcatgtgtgtcattttcctttgggntgagagagtgnctgtttgtgtaatgagacctttctctgcataacttccttttgtaagacctcaagggcctccaccagcaggtaatatttcagccatgatccagtgtgnngaggcacaggtatcagagggaagagcatgagctgagtgtacctgaccacagtgggccattgtcatgggctatttgctgctatgaggatcaagacttagggcagaagttgcccagttctagggatctccagacattgttcccaagacccaagcctaacttcggtggcatnttcctgggtgtgtt

SEQ ID NO: 566335 - DNA, 109 bp, Homo sapiens
tcgagctcgcgacccatagacaccatctgaatggtagccatcttcggatcgttcactgttccttctttcacgctctctctctggactgccatagtctcggtagtcatca

SEQ ID NO: 566336 - DNA, 343 bp, Homo sapiens
  misc_feature (7)..(8): n is a, c, g, or t
  misc_feature (10)..(10): n is a, c, g, or t
  misc_feature (17)..(17): n is a, c, g, or t
aggaacnncnggggaanaggggaagatgggctgtgacccagaccctctgttcagagtggtcctgtctgtagattagctctttcctcctgaccctgagaggaagtgcgaggagacaggacaagatgggaggaggcattggaatctgattttactggttgaaaggtagcgctgtcacagagctgactgatagagcttattccagggcatccttaccattcatcattgtctcactggctcctttccaaaagcttcctccattaagagggtcagagcctcagcctccttcctacaggcagagccccaagtccatgagtctccggaacctccctcttccccagcccag

SEQ ID NO: 566337 - DNA, 614 bp, Homo sapiens
atttatgagacttcctttaataagtgtgcgctggttcaaggttgggcatgggtggaggagcaaaatttgactacagacatgtgatttcaggttaatgacatccagagagtaagatcagattcgtctcgacaaagagatgggcatatataccaagctggtggtggtagcatccgggatagttgagaatatatctgagaagtagactagatgctctcaaagtgtgtgagtggggcccttaaaactgggattgcaaaatgatgctctaaacataggaatggttgaagaggtcttgcagtcttcagatgaaactatatctctagaagaggcactgagaatggacgttgacagcaatgtcatcgcaagggccatccggaagtgatattagagctttgaacaaaatctgtctgttcaggcagagagctatatttggaggaagcattgacagaagcgaaagagatctgataggaacagtctggggtgggcctgcaaatttagaggctattgctaagaagggaaagatttacgtaaataatcggttgttcgtgtggatgtactccaagtaaagctccagtgagtaatatgtataaattgttaaatgatattaaaatatgaac

SEQ ID NO: 566338 - DNA, 451 bp, Homo sapiens
tttaacaaaccctgttcttgggtgggtgtgggtttaatactaagttgagatgatatcatttacagaaaacggcgctttgggaaggggccggatttatcttgacctttcgaacagggaggaatggggaggggatttaaaccgacctggattacttcggtctgaacttagatcacggggggatttaatcgttgaacaaaccaacctttaatagccgctgccccatccgaatgtcctgatccaacatagaggtcgaaaaccctattgttgatatggactctacaataggattgcgctggtatccctaggggaacctgaacccttgggcaagttattggctcaaaagaggataggcctttgtttccactgggaaatttttagcctggtctggttggaggttaagttctgcttcgaggttcccccaacccgagaaattaatgcacgtttgggggtt

SEQ ID NO: 566339 - DNA, 674 bp, Homo sapiens
  misc_feature (536)..(536): n is a, c, g, or t
  misc_feature (624)..(624): n is a, c, g, or t
  misc_feature (647)..(647): n is a, c, g, or t
  misc_feature (663)..(663): n is a, c, g, or t
  misc_feature (674)..(674): n is a, c, g, or t
acaaagacagttttgacacccctgtgatttcatccctcatccaaccaattatttgtacccatttcctagccccctgcctgccaattacccttaaaaaccttaccctccatattcttgggaagatagatttaagaaatattttccatctcctccctcagctgccctgtgataattagattctttctctactgcaataccttttgtctcagtgtattggctttctctgtgcaatgggcaagaagaatctgcttgagctataacgaatatgttcaatttttatttgtcaataatatctcaataaagcttgaaaaatgggatcttttaaatatatattttatctatctttgtttcatttacctttttcttaataaatcccttttaatggaatttatgtgtgtatttaagaaacatacttactccaaaacagttgataatattttgcactgttaaactatattaattttatttctatagaattataaaccaagagtttacactgtggcattttatttcaacattatatttctcactagttntagaattgaagactaattttgacaggaatcttttcgtttattacttttgaattctgtttcccctcttcatgtctgtttgactttgctnttattgacagttttgttcacttntgctcatgggcacttntcttgctctcn

SEQ ID NO: 566340 - DNA, 360 bp, Homo sapiens
ttcaaaaccagcctgggcaacatggtaaaaatctgcctctacaaaaattagttggacgtggtggcatgcacctgtggtcccagctactccggaggctgaggctggaggattgcttgaatccagaaggcggaggttgcagtgagcaagattgtgatggcaccactgcactcaaggctgggaaatagtgagtccctgtcccaaaaaaaaaaaaaaaaaggggggcctctttaagagggtctccatagcgggggggggggcccaaggcctataatttaagcatttgggggggttaaggcggccagatcgtttgaccccagggcctaagggccagcctaggcaacaggggaaacccccgttttt

SEQ ID NO: 566341 - DNA, 279 bp, Homo sapiens
  misc_feature (45)..(45): n is a, c, g, or t
  misc_feature (143)..(143): n is a, c, g, or t
  misc_feature (207)..(207): n is a, c, g, or t
  misc_feature (247)..(247): n is a, c, g, or t
gcgggcgactttccatccctcgaaccaaggcatgttagcacttgnctccagcatgttgtcaccattccaaccagaaatagcacaaatgctactgcgcgagttgcagccaatcttctcaaagcaaaccgacttcctaacaactntctacatctggctcgctgcaggcgactcaatgaaatccatctttaacaccacaatcattgtttnacacccagtgtgcaagccaggagggcatgttctgagtctntccatctgaagataccagcttcaaatactaat

SEQ ID NO: 566342 - DNA, 120 bp, Homo sapiens
ttagctccttggcacgaatgaaatcccactgtggtccctgcctcgggcgggaggagcctgtttgctgaagcggctggtaatggccacgtggcgatttcattcgtgcccaaggaggtcaca

SEQ ID NO: 566343 - DNA, 1237 bp, Homo sapiens
  misc_feature (242)..(242): n is a, c, g, or t
  misc_feature (401)..(401): n is a, c, g, or t
  misc_feature (782)..(782): n is a, c, g, or t
gaaattcaatggatggaggaagaggagagggcagttagcaagacgggatgtgagaaccattgttgctgtaatgtgccacgtggtgaatgtgttgaactacaccccagggtcttatagagaggaagggctggacagtgagccttggcataatacacggcgtcctccttgtgagcagaaccacatctacggcagtagaactctcgggttgattaagcaaaaccaagagaagttgtcactcgttntcactcacacaaaccacgggtagggacaggcccaaggcacttgggatagtgttaacagccctggtttatactcccagccaacatttggcgcagggtccacacatgggtgagcacatatgcgttgaaggtcccaggccaactgcagaacgcattaaggcntttgaagcacacgcataagttgaggaacaccctggtctctaacgaacagaaaataataaaagtaacaaattatgccaagaatattgggtggcgacattgtacttggaggtcccctgcgtaactccagagagagcttggagaaatggcagtgatcaggcttgtagaccatcaggcaggccacgagtgttatgcaggtagaaacttgtgtgatttgttggcgacctgtgaactacacagaccctgttggtgatctgatacacttgaacctgaagccctaggtctcataactaacacgacaatagtaaacaaacctctgacgggggtgggcacggggtaacgcacatttcggaccatatataatgaggtcgcgtattaccaatntcacctgaggccgtacgttattaacaaccgtcgtgtatttgggtcaaacacctggtagtctaacccaaattttaatctccctttgtaggcaccatttcccctttttgcacagcggagcatataaacgaaatcagggccgtaacgattgtgcccttcccaaaaatggtgcaccccagtaatgtgcattggcacatgtacaggcccatttggtacacaggtcgaatactgtgtcaccgacttctacaccaagccaactggacccttcatccacggaggtgtcttgaacaacaactatagcctacagaacatgaagaaccctttaggtgtacctcacatcatccatttatctagtgccgacgacacgaaccactaccgcacccatagaccaagtacagcagcgctaccaccaacaacacacaacaacacacacgaccgccgtcacacaccactccagc

SEQ ID NO: 566344 - DNA, 877 bp, Homo sapiens
cgccgtggttcaggcctgtaatcccagacgctttgggaggccgaggtgggcagatcagctggggttgggagatctgagacctatccgttggcataactaactggtgaaaacctccatctgctacgtaagcaatatagaaacttagtgtgggcgtggatggcatgcaactgttagtccgcagtttactcgggaggcgtgaagctaggagaatcacgttgaacctcaggaggtcgggagatggcatggtgagctgatgagtcagtgccaaatgactcaagtctgggcgatagagaaagactccgtttcaaaaataatgtagtaggattataattaataaaaagaaataggagcgtaagaaatttaggtaaaagatactatagcattttacatgtgaagtgaagaagatacgaatatggactcatgattttaaaaatacattacgaactgtatttgttaaatgctctggaatgaataagatggcttataacaaatgttacccctgtggcaaatgagcataccgcgttgagtcttgtttctaatatgattctccaaatagaaggagcaggagctcctgtgcgagaaatggttcaataccgaagtcctgggaggggacgatacaggcctgaggtgttcgaaaaacgtttccaacgagtcaagtgatgtcagcaaacatgagactatgaattgcctgcaggggtattccctggtctcaaaaacgggacgctggatcctagaccggctaactttacacacttcggaggtggttcacaacacgaagaaaggggcggacacacggtcatctcttcgcccctcgcccacgtccggttgacaagccagacaacaacaccccgcgacatcaccggcccaagctctaagg

SEQ ID NO: 566345 - DNA, 439 bp, Homo sapiens
tcttgtaacttaccagaattgatctggcaggggccaggcacatgtggatcacgtagaggtcaggagtttgagaccagcctggcaactatggtagaaatcctgtactctaccaaaaatacaaaaaaattagccaggcttggtggcatgccgctgtaatcccagttactcaggaggctgagacaggaaaatctcttgaaccctgtgaggcagaggtttgcggtgagccgagatcacgccactgtatcccagcctgggcgacaggagcgagactccatctccaaaaaaaaaaaaaacaaaaaggtttaaaaaaaagataggccccagggagaagttcccctgtaattgaaaagcgaagtgggtaccctcagagtcttaaactatttggaaaattctcccagtatttgaacacacccacccttattatccccagttcctaata

SEQ ID NO: 566346 - DNA, 202 bp, Homo sapiens
  misc_feature (115)..(115): n is a, c, g, or t
  misc_feature (128)..(128): n is a, c, g, or t
  misc_feature (131)..(131): n is a, c, g, or t
  misc_feature (137)..(137): n is a, c, g, or t
atgaggagaagcatgcagtcaatagcatgtggagcaagatgaatgtggagagcatggaggtgaagcattggcagcatcatagttgtttcccatggccaaagagattttttgacanatttggaacatgnagnatccanatgccatcatgggcaacaacaaggtcaaggcacatggaagaaggtcatgacattcatttggagat

SEQ ID NO: 566347 - DNA, 456 bp, Homo sapiens
  misc_feature (1)..(1): n is a, c, g, or t
  misc_feature (171)..(171): n is a, c, g, or t
  misc_feature (217)..(217): n is a, c, g, or t
  misc_feature (251)..(251): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (288)..(288): n is a, c, g, or t
  misc_feature (293)..(293): n is a, c, g, or t
  misc_feature (295)..(295): n is a, c, g, or t
  misc_feature (300)..(300): n is a, c, g, or t
  misc_feature (304)..(305): n is a, c, g, or t
  misc_feature (311)..(311): n is a, c, g, or t
  misc_feature (318)..(319): n is a, c, g, or t
  misc_feature (324)..(324): n is a, c, g, or t
  misc_feature (334)..(334): n is a, c, g, or t
  misc_feature (347)..(347): n is a, c, g, or t
  misc_feature (365)..(365): n is a, c, g, or t
  misc_feature (387)..(387): n is a, c, g, or t
  misc_feature (391)..(391): n is a, c, g, or t
  misc_feature (400)..(401): n is a, c, g, or t
  misc_feature (405)..(405): n is a, c, g, or t
  misc_feature (409)..(410): n is a, c, g, or t
  misc_feature (426)..(429): n is a, c, g, or t
  misc_feature (432)..(433): n is a, c, g, or t
  misc_feature (441)..(441): n is a, c, g, or t
  misc_feature (443)..(443): n is a, c, g, or t
  misc_feature (445)..(445): n is a, c, g, or t
  misc_feature (452)..(453): n is a, c, g, or t
  misc_feature (455)..(456): n is a, c, g, or t
natttactaaagccacattattcatacagacaaaacttttatagcaaaaccttggtacatgagcattaataatttgaatactatatggatatagaagatatttaaaaaatggaaacaatgtattccaaaggctgtaagaggcacaatatatatgcttgtactgggcctgcnagcattatactataattcattaaatatgatccaagaagttgcaganttttcagcactatgtactgaaaagataaaaaggnatatcatagctactcttacgcngangangcatctacnatcangnctacnaaannggggcngcgggcnnaaccnaacaggtaangccttagggtttnggggggataatacatgtntggctttttcatgttcatttgngggngggggtagnnaggngggnnggggggaaaggggggnnnnggnnaggggggnangntaaaggnntnn

SEQ ID NO: 566348 - DNA, 937 bp, Homo sapiens
gacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagcaccctacacaccaaggtcccaccctgcacgcggagccaccctcgacctcgtgcacgcaagcgcagctgcatcttctgagacctgggagcatgccagggtgctacggtttatgccagtgcagcctgaggaggagctatgggacccgacggagccacctctgtgacatgggggagcttgctcgggtggcaagggatgccgggaggggtagagaggcaagaggaccgacagcgtgcttggaagcacgagtgtggagatgtagacatgggcacagaggcaagtctatcactagttgataggtcacacacgtgagattcgagcaactcaagtagcgtgagcaagaccggtgccctgagagtacagtccggcctcatggtgtctataggacgatcgttcaccatcactatgagattacataacatatcatacgaagatacccatccatgaggtttaccacccctagtagtggcttaactcctaaagtgaaacgcgcggttacgaagggcgaaacggaccacccaaattaggacacctatccagtagatatatcgctaggcggcacttcacgaacagaaaaaccaaaagaggggcataacaaggagggaggcacagcgagccacaccaccgtaccccaaaatcgaaggcgggtgagacttccacacgacaggaccccctgccacggacaagaagacaacgggcagaagacatgtgataaacggaacaaaacgcccaaaacattgggacagagacagatcacctaggg

SEQ ID NO: 566349 - DNA, 566 bp, Homo sapiens
taggtagaggcgacaaacctaccgagcctggtgatagctggttgtccaagatagaatcttagtcactttaatttgcccacagaacctctaatccccttgtaattactgtagtccagggacagctcttggacactagaaaaacctgtaagagagtaaaattaacacccatagtagctaaaagcagcaccataagaagcgtcaagctcaaccatactaaaatccaaaattatgaatctcaacccatgacatctatcaccctatagaagaactaatgtagtataagtaacatgaaacatctcctcgataacctggtcgataaacatgaatgacattacaccaattacaacaacaagtcatatacctcatgcaccaacaagatgtctaagaaggtaaacagtaagaatcggaatcttaccgcgttacaaaaatacttacatcacatataagacgcgcccaggacctgttagcgggacctccggcaagtagctatcatgtcttataggacgttgatgtcccaggtcatgctcttattaaacgtgatgacgccgtgaaggggcataacgcaa

SEQ ID NO: 566350 - DNA, 136 bp, Homo sapiens
ccatgtcccggttgtgctgcaccgtatggttacaagcatcacatgcaactgagtcaggacacgtcccgatttgtggaacaggtggctgccagtcgaatctcaggcaatttggatgctccagaaggtggatttgatg

SEQ ID NO: 566351 - DNA, 978 bp, Homo sapiens
gattataacatgaccccagaccgacacttaggagctgcctggatttgacaagtgccgccccaacctgctcatcacagagtccacgtacgccacgaccatccgtgactccaagcgctgccgggagtcgagtacttcctgatgtaaggtccacgagacctgtggatcgtggtgcggacggtgctgatacctgtgttcgcgctgggccgggcccaggagctctgcatcctccatggagaccttctgggagcgcattgaatcctgaaggtgcccatcttactttctccacgagggctgaccgatgaaggccaatccactatctacaatgctgtccgatccctctggaaccatacgcaggaagggatcccgcgaaggagcatttccggtgcagcaggaacagtggttgtgagtttcaacgcaccatcgaatggccttcgaaccggggctttctgctagactacctcaagtgacctgcatgagttcgtgttttgccagcgcctagagaagtgctcgctacgctgtggcatgtcccctgccagatcttcctggcattatggtgctcgtgaaactgagacaagcatacattggtcttcactgcccaggcctgactgcggtgcgagggctaccgtctggccacgaagtatccgtctagcagtgtgcaagctggcatgcatcggacgatgcgacggggtgcggcatggctgctgcgaaggtcatgactgcaggtggagtacgtgtcattcatgcgcacatcgcggactgccatagggcatccatgcagctgagtgggccaggcaggagccgtgacagcgtgctgctggtgcattggcgaggcccacgaagattggcgtaccttgagcagaaagatcgagccggaggtccgggtcaacggctacttgccgggccatggcgacgacggtgacgctggcccaagccctcatccccggaggctctcctgggctgttaacggaatgcggcagc

SEQ ID NO: 566352 - DNA, 452 bp, Homo sapiens
  misc_feature (90)..(90): n is a, c, g, or t
ctgcagattatgaggcttcaacgtgtgcgtggacagttctaatggggatctccagctccttccctgtgggctgccacagacagctacccncagaagggtcaatgttgggagtggttgtggctctgagctgctctacagagcttcagtgtgagaggatcgagccattgaaagctcattaccagtaggacataatttttggctctgcatattcacaaccagtgcacagtttgacacagtggcctcaggttcacagtgcaccatgtcactgtgctatcctacgaaattatttgtttcataagttgtgtttattccgggagatgacatgccacccccgaatggcgtcacttgtgactgaggatgctgtcgctactgaattagctggtgcctacacgcactctggctagagaactaactacaggcacttccttcctgataaacgcctgtaaccaccc

SEQ ID NO: 566353 - DNA, 310 bp, Homo sapiens
gcggaggagccagcagcagcttctgtgaagaggaccaaacgcagggacgggggtttaagcccagggccccggttgagttttgaaaagaaaccaaaacgcgccagagagtttaggggtcccaaccacatatttttttggggttgggtgccaaaaaaatctaaaaccatggggcacaaaattggcccggccagcctgggtttttgggggtgtgtgaaagaattaactggtcggggttctccccacacttccagccaagttgtgctttgtgtccgccctcggcgctttggcaaatgaagctgcgggcccggga

SEQ ID NO: 566354 - DNA, 604 bp, Homo sapiens
cggggtaaggtagaccgctggcggttggggcggctgtttggccaccccccaaggttgcccggcggccacattgtttatattgctccgcggtgaaatcctagaggatgatgcgtcataacctagctcttagttgggtgtaatgaacacgggggatgacgatatccctcctcaaagcaggttccactaggttgtttatccccgtaagatagtgatcttttgaaggatgtttttcaccagagcagtaggtataacggtggaccgtgaaccccccctgtgcaacaacacggggggagaacctgtcgctgtggggacacagggtctccggggcgtcacaagacggcgtccgaactagcaagggcccccaggcactatgttcgcgccccgaaaagcccggtccaaaagggtccacgcaggagccaacggagggtcgccaccgccgcaatccgccactggatgggccgaagcataggccatccgctcaatgtcacgccaggaaggagcacacgccgcgccgaggttgctaacaccactccactcaggccccgtatttttgcctatcctcccaccccaactaactaccggggtgttcccctttgacaaaaca

SEQ ID NO: 566355 - DNA, 402 bp, Homo sapiens
ccgggcttcttttcaagtactgctggaccatactcaccccttgggattatggcttagaagaagggggctgggtaggcaagcactccttggctgtgtcctctgcctttttcacttacttgtaccatcccgcagcagccaatctagggactgtgttgtccctgtgttggttcccatctaaagcagcagcagagaaatgcgctggttcaacagctcgccctgccccaagtactccagacttgaccctggcggggtcctggccttctagagtctagcccgttgacccccaagctccggcttcttccaacggtcccattgggaccacccgtgactgtttatagttttttgttttcagaaatgcgggcagctgctaattccttcacttatctgacaccacctgaaaaa

SEQ ID NO: 566356 - DNA, 112 bp, Homo sapiens
  misc_feature (40)..(40): n is a, c, g, or t
gattcttgaagtctggggatgctgccattgttgacatggnccctggcaagcccatgtgtgttgagagcttctcagactatccacgtgggggtcgcggggctgttcgtgatat

SEQ ID NO: 566357 - DNA, 192 bp, Homo sapiens
tgtaccgaccgtgcacctggacggattcataatcttgcaacacccttacgccagtgatcatctattgccacagccataatcagacagtgatcatctattgtcaacagccaaacagaccagtcatcatctaattgcacacagccaagcacccattgatcatctaatgcataccagccaaacacccagtgatca

SEQ ID NO: 566358 - DNA, 443 bp, Homo sapiens
gcagaaagtagattggtgaatgcggggggtgggctgagggggccatggggaaggggagagcacctaaggggtgcatgatttcttttgggggtgatgagaatgtttggaaatgggtagtgttgatggtagcacaagtctgtgtatgaatacattgaaagccgttgaattatacattataaatggatgtgaattagtgaattgtatctcaatatattcctgctttgaccgcggctaggtgtcttgtttccacagctacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggcgacagagtgagactccatctc

SEQ ID NO: 566359 - DNA, 862 bp, Homo sapiens
ggaggggacctgcgcagccaccgtcgccctgggctgcagcctgcacgcggagcccggcggctactcgtgtggcctggatggacattatgccatggacaatattaccagtgcagaaccaattctacgatacccaatgtcatcaaacaagaaaactgagtcatggctacgagatgtgagaccactgtgaaatggagcatgcagcatgtgcctatctgtccatgaaatgaagacagagatgaacgcaatggagcacccaccagcttcctccctgcctgaagcttctcaactcaatgccagacaggcatgcaattccagagtcgaaagaggccttatgaagaaaacctggtggacggggtgtactttgagcaccgagaggataggaggggccgctctcctcagcctcctgctgaagaggatgacgatgactttgatgatacccttgttgctattgacacctattaacttgcgaccttccactatcaaaggttggacccgaggatcgagagtaagtggctatcacgctcaaccaattgagtggctttgcataccttgtggtcaagagaggccgtggccaagctattggggtcagaacggggccgtgtatgcttcgagaatgacacttcactgaaggaaattctcccgttgaagcacctttcctgtctactgaggcctgacccccaagttggtcggaattcggctttgtccctgaactccgtgcagcaccaagctatagcaaagaggccattctaatgatggaaggcctgggagacattcaacattacggttagaagtctgagacacgttgcacacaattattatgttacagcgactcaatggaatagtaaagtttaccagataggtg

SEQ ID NO: 566360 - DNA, 424 bp, Homo sapiens
cgaacatgtcgagtgggcaccaatgccctagaatattcttataattctagcagcttggaggctgacatgggaggattgtttgaggccaggagtttgagaccagcctgggcaacagagtgagactccaactcaaaaaaaaaaaaatgggtctatggagtgcataagccatggttcatttactttgtccccttctgatgggcgtaaaggtggtctccaggctttggctagcacagatggcactcgagggaatcaccttgaactcagatcagttggcatgtgtatgagtgtatccatccgctgaatttctagaatgggaatgggggctccagggttaatgcatttgtcatccagatttttttaaaaaaagccaagttgccctccataaagcttgtccagtagaacacccccagtatcatgtgagggc

SEQ ID NO: 566361 - DNA, 635 bp, Homo sapiens
aaaatcacgttatcccgggcaacagcgaagaacgcgttattaaagcaccctctccgtaaagcgtcaagcgtcacaataagcttaccgggaatgttaaagaaatcttatttggacatagaagtaactaaaatccccgaggaggtaaaagcacccgcagaagcggatcctatgaagaaaccattaaagcgccctctccctaagctagaaaaaggaggagacatagcagctgaacacgcccacttacggccattcttaagacgcaatagtcgcgacagacggggctacccaagcatagaccgcccactaaggaaaaaggtagaaaacagagccgaggcaattaaattagcagaaatcaaggcggtagactcagagttagagataagcaacggctcggaatagagcccgaaagaaaacaaagaagacgggaacaacaacgtagaggagccaaccgagaatctataatattagcttaaggacgtctcgatacggaacatcttcatcaaaataacaaagagcttcagtaaagttaatgaatcgtgccacggagaagggcttactccgcttaatcccccccctcgctccagcgataaaggagaagaagcagaaaaaggagaagcacacgtccgcacaaaggc

SEQ ID NO: 566362 - DNA, 175 bp, Homo sapiens
gcagtgtacgctcgatatcgggatcgggccgcgtctggtggcgtctcgtcggcatggcctggggctggcaggctgcggggctcgcctgccgggagggtcgggcttgcagagtgctcccgcgccgcttgcctgtggtgctgacccccggtcttaccgttctgtgcgtgagtgtccc

SEQ ID NO: 566363 - DNA, 205 bp, Homo sapiens
catctcaaaaaaaaaaaaaaaaaaaaaaaaaaaaaaaaaaaagggtttttttctacccccgaaaactaaaaaagttttccagagccttttttctaaaccctttaaaaaaaggggtttttttttttttgggggaatattcttttccccccccccccttttttttttttttgggaaaaaaaacttggggaaaaaacccggttttccc

SEQ ID NO: 566364 - DNA, 1166 bp, Homo sapiens
atgtgctggcagccattggctgaagtgccctggtgacccaaggggagggggcaactgctggctgagctgcctggccctttgctgtcgctggtgccctgcccctcgcctgccagctccatgccccgcccccgtgagccggctgtcctgctcactcgtgttcaatgtgcatgctgctgactgcgtggtggcgcactgaccaaagggcgcagaccttgtggagctgctgctgtgcccatgtgatgtctgtgaggctagctgcgagcctgtgctgccgggtgagctgaggtcatctgtcctgcattacaactaccacctggcaaggctccgctgggtgcttgctgctaccagcctgggtgcctggcctgcggctgcctgactgccggtgggttgttgccttggcctgtgtagtgctagcccttcagtctgtgctaaggatgaagtctaagcccgtgtattgttgggtgctctgagaacgccaaccctgcagctttccaacaggctccccaattgttcctgcctccttgggacagggctcaaccgttgtccgcgagtctcgccttggccagagacgacatagcacttaacagcccagggcgcaaaaagaattaaccattaactttgtacccgtgggccccagagaacaaacagcataaacagaaccgtttagtcccaccccagacaagaatccatagtggtaaccagacacctgaggagacagaggagaagagagccagttcataaacatgtatgagacaacaatccaacatttacctagttcccaggaaagacattagagacacacatacacattgaagacccaattacaggccggcattgggaaagaaaagcaaaagacaacagtacataacaatatggacagagcaacaaaaggggagagagggcacacaggtacagacacaccagttacatccacaaacgaaaccagagaagaaaggactaaccagaacagaccatagtgagatcaaaataggataccatgcacagagcaatagcaccattggatacgacgattagatcacgagaagttcaatacactatccgaagagaatcaccgtagacaaaggatacaattcagatgacattcgaaaaactagatagacagttaggaaaatataagccactttgagaaacagagactattacaa

SEQ ID NO: 566365 - DNA, 102 bp, Homo sapiens
aggagtctacgctaccatcagcggccttaaaccgggagttgattataccatcacggtgtatgctgtcactggccgtggagacagccccacagagagagcgtc

SEQ ID NO: 566366 - DNA, 454 bp, Homo sapiens
tttacctttttttaagaaaaaagttgcatgaatggaaaaaaaattttgtatacagtttttgtaaaaacttttttatttgtttcaattccttgttcatatcccatataatttagagctaaatatggggtgtggccatatttaaacccctgaaagtcaagcagttgagcctttgatttgaagcccctcatccttttttcaatggggacactatcatatggcattttttatgaggattttgtttaaccatatgttgccatgaattaactttgcccccttttttaaggatcaaaaccagtttgatttgggaattttcccctttcccaaagaaatagagaagcagttcttaactttccttggtgtttgtaaaaattgccctgtgtattccccttaaaaccgtaatttagtttgtaaaaaaaatggtgcggcatgtaaataaagcttcagggcccctcta

SEQ ID NO: 566367 - DNA, 254 bp, Homo sapiens
acataatccataacagacagcacaacctctgccccaacaactagcacaacccctgcttctatacccagcacaatctttgccccaacacccagcacaagctctgctcccacaacgagcacaagttctgcccctacaaccagcacaacctccactccacagcacaccatatcctctgcccctacaagcagcacaagctcggatcctaccaacagcacaatctctgcccctccccccagtacggagcccaagggtac

SEQ ID NO: 566368 - DNA, 191 bp, Homo sapiens
tcaggctcggccttttcttctcctattcctcttcctggtcccgccttatatttaacttaaactttttctcatccacccacactcactgtctcctggttttgcacctgaaagtgcgcacacacagacacaccaagagatttgtgtacatgcaggtcctttttcttctctccccacactcacctccagtctgt

SEQ ID NO: 566369 - DNA, 466 bp, Homo sapiens
aaataattaatatggccatagtaagttcttccctgtcagtaattattttaaatgcaaatagattaaagtccccaattaaaagacagagattagctgaatggactaaaaaccaggatccaactatatgccatctacaagagtcccactttatatcttttcaaataccaaactcttgtggccaggtgccacatgtcacgcctgtaattccagcactttgggagaccaatgtagaaggattgcttgaagtcaggagttcaggaccagcctagacaacatagaaagactcttgtctctaaaaaagttttttacttagtaggcatagtaacacacacctgttgtcccagctactgtggaggttgaggtgggaggatcccgtgagcccaggagttctaggctgcagtaggctatcatagtgccactgcactccagttgggtgacatagcaagaccctgtctctaaaaaaaaa

SEQ ID NO: 566370 - DNA, 178 bp, Homo sapiens
atccccatgttcctccatccccatgtccatccatccccgtgtccatccccatgttcatccatccccatgtccatccccatgttcatccatccccatgtccatccccatgttcatccatccctatgtccatccatcccatgtctccatgcctcccatgcctcccatgtctcgtcgacgc

SEQ ID NO: 566371 - DNA, 139 bp, Homo sapiens
gttgctctagaggatcctccagaggcacaaggagggggcagataggggctcacaaaggcttgcctccaggagatgacggcactgcccccagcttctctgccaggatgcagcggtccttgacctcctcgtagcagtttgc

SEQ ID NO: 566372 - DNA, 1582 bp, Homo sapiens
  misc_feature (1)..(2): n is a, c, g, or t
nnccggatagatagtggagtcgttctcatgctgcgtcgtcctgggggagtggttgtgagtgtgcgcgtggttgtgtttgactaccggttgtgtgtttgtggtcgtgtctcagttcgtttgtgtgtcgctgttgcgcgcggtccgtgtgtcctccgtctgttgttcggctgttgggctgcccctcgcgcctcgttggttggtcgcgctgtggtggttgttggcgctgcgtgtccgccggttggggtccgccctcttctggtgtgccctgtgttttgtgttcctctatggtgggacccgctccggggtgtctcgctccccgagtgtgctctctgttcgtgagggtgctactgggggccgaagtgtctggttcaggtggctcccgggtggtgccgcaggtgttcggcgggatggttgtgtgggggaggcagtcttgggggtgtcaccaccggcgcggggttatcaacgggggttcgtggccgtgtggtggggggggcggggtgtccgctgtcgcgggctgtggggcgtatgtccagccttgcactcctgggcgcgcccgtggaccactggggggttgcctaatttcctcggggaatgggagttttcctcccctgttcggcccagaaaggggggactccgtgttgccgccccgtggcctgtggaccgcgggcccatagtgctgaaggggggcccctggtcggtgtgagggggagccttgcggggcttggggcccccgtgggccccgccctgcgtggatggtgtagcggtgtgggccccccttctgtgggagagggggctggcccgcctggtgtgactgtgttcgggcgtggccccctttgcgttggagtcttggggcgactgccttatcccccacgcttgttgggatcccctttttaggacggtgcccccgctctgtgtctgtgatccatggggatctccccccaccctttgtgttgcgccaagtgggcgccatattacccgatggtgtgcgcccgtggggggtccctcaacaaagagtgccctcgccaggactttcccgaatccctccccgaggagtaatgcctgtggcccctaccttgggttataggatagacactcgtttcttgaaggagagaaccacagtgtggacccgtgtgtgccccgtgggccaccggagaaataacacagccgtgtttcttgtttgtccagacccattcccagggttgctgagagttcttccaccaggtccatatggggaaactggtacaccccgaagagagaacccatccaagagattcccacaccagaatatttggccagagtgaatatgtacccatttccccaggacaggccttttataatcggtgggaccccttgaagaagctgtggccaaagctcgataagactggctgaagagacattcatcgtgaggggtctttgtcctctgtacatgtctctctccttgcccctaacccccaaagacttcctttttctgtgttggctgccccagaccccttgacttgtaagaatatattctttttgaacccgtatttaaggtttccccatcaaaatgtaccccccctcctcaaacaaaaataaaaataaa

SEQ ID NO: 566373 - DNA, 933 bp, Homo sapiens
ggaattgcatggtctgatctcggacataggcatgaaatagcctatatctatctgtgaccgatgcatcggacgaaacaggcaatacttcatgcatctgctcttaagcatttatgcatgacaagtacccacacaagtttatgacatgaaatgactatatagatcacgtaatcagtgctctgtgtggaaacaagagaacttatcatggttccctggccgtcgaactttaagaccatggtacatatggtttaggccattcacatgtgtaatcaataataacaacagacattcatggagggagtttcttgttattgtatcatgcaagaggcaaaatttttatacacatgagagggagctgtatctagttttaatcatggtagaagtaggtaccttctactatccagtgtttgaggattgcttcaaggaggccagtgggatacagacactaaaactttatttcatggtgtaactaagaagaacagaatacactgtctgtaggtcccgatctgattctggcatgccactgcactcatttttgtttggccagtgacctgggtataccaagaagatgagccattgagacatatacaaaccaggtgctggggcccacatgaaatgcatttgtgctttacgatgttaccaacgaccaatgcaataacacaacataaatgtgcctatcaaaatattcgccagtgcgtacaaggggtgacatatatagtgtgtatttcgccccattgttgacccaagatatttaagtactatccatataattttgggccatcacacccatagtgcctctaattaagccaggatgtaattgaagtatattaatgacgactggagaagatagaaattcaccccagaaattagttaggagtagataaaaaacatacaaaagccacacgctaccacatctatgtgtcgagagaactaaac

SEQ ID NO: 566374 - DNA, 541 bp, Homo sapiens
tccattggactcaacaaatcttaatggagtggcaactacattatcaagcaatctagtaggcacggggaacacagtgacgagcaagactaaatattgccagtctactaagcaaaacggtgataatcgttcaaataatcacccatacacagtgctcacattcgagtaattaaaaaccgtgaataccccagagagaaaagtgggcacacaatctattctgtgaaaaaaaacaaaagacaaaaaaaacaaaaaacaaaacacaaaaaaaaacacgccaacgcaccactacaggcgagcgcccataacacagcacgccagcgcgcacagcaccgaaagaggaggacggccacgcgagcgggtagggggccgtgcggaggcgcccgcgtaggcgagacaggaaaataggaagaaataggagggacaggagcgcaccgagaaaagacaggcaaagagagggagcaagcgggcgcggggggcgcgccgcgcatgcgggtggacacagagcgcgcagcgggctggcgtggagcctgcctaagcggcgggc

SEQ ID NO: 566375 - DNA, 386 bp, Homo sapiens
ccagacagtaagtgtgagcgcactctgatatgttggatgatgttgcctgtaaacctcacattgaaatgtaatccccaatgtgggaggtggggatgggtgacgggtgattaaatcatggggacagatttctcataaatggttagcaccatctctttggtgctgttctcatgagagtgagtgatttctcaagagatctggttaagtgtgtggcatgacctcaccccatcttgctcccactcgcaccgcgcgagacacctgctcctcctttgccctccgccacaattgaaagcctcctgaggcctccccggaagccaagcagatgccaacaccgtgcttcctataaagcctacagaaacatgagccaattaaacctctctataaattac

SEQ ID NO: 566376 - DNA, 640 bp, Homo sapiens
  misc_feature (350)..(350): n is a, c, g, or t
gagacggggtctcaccgggtgggccagacggggctcaagctccggaccgcaagtgatccaccggcctcggcctcccaaagggcggggatcacgggcatgagccaccagagcgggtggggtggggtttaagtgggggtatattcctttatgctgagtcccgggccctaattacatcacccctccctgggaccagggtagcaccctcgggactagtggggctctttcagtacacacggtccttggaatgtatttcccccagtagagctaaacatatttctctcttaaaaacttctaatgccttccgttagaagggagacttggggtggcctttagcataccggcctctcggnctcgcccacagggagggccatttagtttctccaactggacatttggtctccggcctagggcttgggcatattcctctggtcccaattggttcttcacatgcattcttcagctctcagctcattcattccttcagaaaagcctttcggaatcccagattagctcaggttcttcggttatacctgcaccccatgtgtttccttcaaggcatatatagtaggtggaatggtacactgtatgactatgcgatcatgactgtcttccctgttatactgtcatggcatgagacccg

SEQ ID NO: 566377 - DNA, 165 bp, Homo sapiens
cataggtgctgggccctccttgctgctcgccgccctcctgctgcttctctccggcgacggcgccgttgcgtggcggacacacctgccaacttgcacctaatctttgaccttgcttgggaacctggggcttccaaggtggggttccaaccggttcccaggcgcgat

SEQ ID NO: 566378 - DNA, 324 bp, Homo sapiens
tcattggggaactgattggggaagggtctattgtctttttaaatggcacaattttaagggtttgagggtacagtcccttaacctgccacgggaggggaccccaaactttcttccccccacacttctggttttctgtgtggagggggagcagggatatatgagcgaatgtgtgaaagggtaggagagatgctggaggtgggggtgctgtgttctagaccccccatattatcccagtgtcccctgccccaaaaaagagagaccccatgcccccaattctgtggcgcatccagattgtgaaaatgtacaataaatgtgtaatgagta

SEQ ID NO: 566379 - DNA, 743 bp, Homo sapiens
tcacattcacataagtattcatttggtttgttccacattatccacaaggtattcttacaaccttataccaaaaagtaacactgttactgaaaataattttttaaaaagggtttgcagctcttttgtctttagagcatcccattactgattgagcagttacgagtatatcatattttttataggaattggtaactttgctcacacctaccaaggatgggcatgtaggctgattttgagcaccatcccaccagtctatttatgcatttttatactccctggttagaggcgcactgtcccttactggttctggtttagcttgctatcttgacctatacacctcttcgggagcatgacaaatgaagtaggacccccactttgacaggtaggagggttgcttgtgaaaagccttcactctctgatcgccctttcgcaatcgaataaacctcacccatggattttaatgatgctatatacgctatgcatacaccttgagacaaatccatcacgtactatcatgttatgaaatctccacgctgtacaaaaaacaattcccctggatttctcaatggacaaaattcgcatggatttcctctttttgtcttactcccatgtcctatcttagtatctttcgtaagaatcctccatttgtgtccatggacgtttaagctcaactttcaagaaaataatcatgttttccaaaaccactaataaatttgcgcccatttgttctcgtctttctcact

SEQ ID NO: 566380 - DNA, 1263 bp, Homo sapiens
  misc_feature (910)..(910): n is a, c, g, or t
gcagtcagccgcatcttcttttgcgtcgccagccgagccacatcgctctagacaccatgcgggcaaggtgaacggtctggaggtcaagcggtagtttaggtcgtatttgggcgcctggttcaccagcggacttgccttttaacctctggttaaagctggatagttgttagccatcaagtgaccccttcattgacctcaactacatggtttacatgttccgaagtatgattccatcctcatggccaaattccactgcgtcaccgttcaaggctgagtaacgggaagcttgtcatcaactggaaatcccatcaccatcttccaggtagactgagatccctccaaagatcaagttggggccgatagctgcgcgctgccgctacgtcgtggagtccactgtgcgtcattcaccaccatggacgaacggctggcgtgctcatttgcatgggggtgagccaaaagggtcatcgatctctgccccctctgtcgtgatgcccccatgttgcgtcatgggtgtgaaccatgagaagtatgacaacagcctcaagatcatcagtcgaatgcctcctgcaccagcagctgcttagcacccctgggcaacgtcctccatgacaactttggtatcgtggaaggactcatgatcacagtccatgccatcactgtcaaccagaagactgtggatggcccctccgggacactgtggcgtgatggcccgcggggctctcccagacctgtcatccctgcctctactggcgtctgccagggctgttggcaaggtcctccctgagctgaacgggaacctcactggcattgccttccgtgtccccgactgccacgttgtcagtggtgggcctgactggccgtgctagtaagaataccttgcgcaaatattgtttagcctacagacaggggnctgaaaccaagacgtcacagggccccctccaggggcccccgcggctcaactgggtaccccagggtggtcactcgtgattaccagggtaagccaccttttcacctgtaaaccgtggggggaatagccatccaacgacaatgtgtggagcatctcgttgaacaacaatgtgttggacacgcaggggtgatattgatccaggccaagtgaggtaagcgacgctctcagagtaaagaaaacaggtgtggctcgtgaaccaaaacacctgcatcataggaggagattcagcgtcataccagtgcctaactatcttcggtctgttcgtcactcgcgctaccagtcctgcctcggcagaa

SEQ ID NO: 566381 - DNA, 872 bp, Homo sapiens
gccgaggtctcgtgtgttcccgcgtgttctcctccggcgagtttgtgcatccccttggtgcgccagtggggcctacctggtgtgggtccccgtgtgtgacgcgttgcatatcttgtcgccggggtgtgcaggtgcaccactctcccccggggcgtgtatccggttggccccccgccgccctgacggtggtctcttcttgtgttggtggtcgtccggcctccccgtgtgtttcttagttttagggtggtgtcccacggctgcctctgtgccccggtttgtgctctgccgagagaggcttgtctattgttgatggggttgccttcctcctgcggggacatctaccggttggttgttcttcccctccctcttcttgcaggggggcccgttgtcactgctgctgtctgccttggagtaggagctcgtctggtgggcacactcctcttgcagtcatgctgctctcgcggcgcggtttagaggccccgcgctggtccgtcgccgctctatgggggctgtatctctacggggcgactatctcgcgccccccccgcgtagtggtctgctcacagggggcggtgagtttcctccttcagcgccctccgtcgtggggctccgcactagctgcttgtccgctggggtggtcaacacgtgctgagcctcctcgtcgctggacgggttactattattggcgccgccgctcccaccgccctccccccctgggaggggggacgcagcgcccccagtccctattgcttggttggtcctatttccgcagtggcgtgtctccaccaggagaaacgacttagcgaggtccccgtcgaagccacggccacagcgtaccctcccaaaaccgccaacccccgacaaacaagaca

SEQ ID NO: 566382 - DNA, 898 bp, Homo sapiens
cgatgtgtgtcttgtggtggttgtgtattcttagtcgggttggctgcttcgtgtgtgggtgcgtgtgattcgtcgtggctctgattgtgtgttttagtgtgtgttcgccccgtgtcgtgtgtgcggttgcggatgtgtgtgttgtatcatttgtgtgggttggaatggtgttggtggtgtcgcgacagtttcccggtaccccgttcggggaacgccgcttcccccgtctggcggtttaccccctgccgcaattgtgtatcgcgctcccaaatgggtcgtctgtttccccccacccgagtgtccggggtgccggaagttctctttgccggaggtaccgctcccccaaattttggtttagcaaacccttattaccaaggttttcactgtccgggtcccagacaaaatctccccggatttcttcccccctttcccgcccggggccaacccccttcttaaccagtcgagcaaatacttaggggaaaaattattatttgtgtaacagcccccctaccccccgccgacgcccctgagtagtaacctgggttttccccaaatagaaattcttatatgtctcacctgtaacaactttcgcccaccgaaccctgctttatacccccttctaaatttactggtagtccacaaagagcaacactgcttttggacacaaaggacaaaacccctgttagaagaagagtgtacatcactttgaacaaccccatcattgggcgcctttagacgccgcccccccgttctagaaatacccgtttcaacgtccacacctcctcctcatctcgcttcaaacacgccctcaaacaagggatctgttatccctccccaccccccgggcccatttttccccccttaaaaaaaataaatttttaaaaaaacacaaaaaaaa

SEQ ID NO: 566383 - DNA, 283 bp, Homo sapiens
gtgacacatgcgaccgtgaccaggaccacccgactcctcaaaagcaaatgagatcccgcctcttcttcttcagaggacacttgcaaaggcgcagtgcttctcttacagacttctccagacccaccacaccgcagaagcgggacgaggacctacaggagaggaaggttccatttcccagtaattccctatttggagttttcaggttggttcgtatcagtattctgtcatagggaggtagtaccctaagtctccagtattctctccggcagataggccaccactt

SEQ ID NO: 566384 - DNA, 922 bp, Homo sapiens
  misc_feature (837)..(837): n is a, c, g, or t
  misc_feature (909)..(909): n is a, c, g, or t
cctcccacccttccgcacccaaactctccacagccctcgggcccaggtgcgtcccttcagctctgagggcgctgctctcccctgccttggcatccagcctcagctaaagagggtcatacacctttgtgagaaacacatgactttcttccctggcagctttcaggcagttctttatgcccagtattctgaagctgctttccactgtgtgttggatcctgcctgtcactaggagtctgtcagtctcctgccctttgagactctttctcttggtctagggcctgcctgggcctctgcccctccacttgaacttagttcagcaattggcttctcccacaccacctgtttcccccagcgcttccacttctgaggcttggaatgcacagactgcttcaagaactgtgcttgctgggtgtcaattattctcgcttttggggtgtggactcctaccctggtggctgctgcctgagcactagtctggtgattcctgctctgggccgctcagtttctgccaccctgggagcttccccagttacatgtgggcctggctgagtgtctccatctttctctggctccaagatgctggtggccctggtgaggtctgccattggtctgccaggtccctctgcactgaggcaggggaggccagcaaggacttcagggctgcagagccttccctgcagtttctaccttacaaacagggatctaatccctaacctggggtacgtgtgagaccacagggagaaggccctcgaggcatgggcacatgcaaggcctgtagggcaccttcctgcagcaggcagaatccccttcccaagtaggaggggaaagtgacaagancaaggcccagggagggagcagcaaggcatgggaaaggcagcagcatcggctggatttggctgctctgggatngggaggagactgt

SEQ ID NO: 566385 - DNA, 263 bp, Homo sapiens
ggcatgatggcagggcaggatagttcagacggtttctatatcctgagcgtctgagatagtatagtattagatagtataagtaagtagagtgttacagaaaagggcatacgcccaggatacgcatgcttccctggagcgtatgagctcaaggcaacttaaaagcacatttctggtcaggtcatcctccattggtcagttaggcaaataattccagcagcagtggcaaatgtgagcagcactgaaagcacttgcaggcaaaaaaa

SEQ ID NO: 566386 - DNA, 272 bp, Homo sapiens
cgccgggagcggatggcggcggccgtagctggctccactcgccgccgggggtgaggaggcggcagccacgatctccgtgcccgggtctccagtgtctgccggggagacgcagtgcagagcgggccctagaggaggccgtggccacctgggaccctgaacctgtctaaccgtgcgcttgaagcacttcgccccgtgggctgcggcctgtagctacgacctgtcagacatcacccaggctgacctgtcccggaaccggtttcccgaggtgccct

SEQ ID NO: 566387 - DNA, 129 bp, Homo sapiens
cacgaggcggcacgaggcccacctccaaatatctcatcaacaaccgaccaattaccacccaacaatgactaatcaaactaacctcaaaacaaatgatatccattctcaacactataggactaacctgat

SEQ ID NO: 566388 - DNA, 137 bp, Homo sapiens
ggctccgcggggctcctacgcgccctatctcctggtcttccaagccatcttctacagcctcttccatctgagcttcgcctgcgcccagctgaccatgatttatatcctgaaccactacctgtatgacctgaaccacg

SEQ ID NO: 566389 - DNA, 105 bp, Homo sapiens
agccaccggaagcattccttctaggaaaggtggagtcggtagtaagaagccggagtgagaagacccctgagcggatggattcattcattttgaattctatgtagg

SEQ ID NO: 566390 - DNA, 921 bp, Homo sapiens
ccccttgtactgaggtgcccgttgtgcggtccctgaatatatccccccggttttcgcgcccctttctctgcccgggggggttgtttatctctccgcctccttgcgtttgtttgtagaaagatagttgtctccccccccgtcattgtgcggcggcctcccgccggcatacgttgccccccccttttgaaagggttctttttacgcgcccctgtcggcattgtttcctctccggaggtgctccccgacattcggcgctctctttttagtccgtctctctctctcacccccctgggtgatggtggtgccctccatcccgctcgatcgtccctcgtacagttcggggtgtcaaatgatcagtccgccgacagttttcgagacgagcgccccccccctcgcgtggtcttattcgtcagttcaatgtggcagtctttcgaggaacatcgctttcgtatgtgggtgtgtggtgctcatcaaacccgcccgtgtgtgtctatttggacccagctagacggcgtatagtggagtcccgctgccgtgtgtgtcttattccccagacagttaggatacgttggcccccccgccctccgattgattggctgtctctcattgaacctttgcgtgccgccttcctatatatgcgaagaaccaaaagagcctctcaacaataaccgctgcacatagattgctgcctccgtgccataatcccacaaaaatgctcgcgggggggctctcctcattgcgccacacttttgcggcggccgtgccacacgaactgtgtgccgcgaggagtctggttggataccgacctcgacgagagtagacggctagctccacttgacagtctcggacgtcgcgccctcgctggcgatgttctttgcgacgacccaatttctgaaacaattcgtatccccccaaaaaaac

SEQ ID NO: 566391 - DNA, 121 bp, Homo sapiens
ctgaaatgggaaggagccgcattatgtattccataatatcatcttgattgtgctaaatgcatgcttatttttcctccaagatgaggaatacatttcaaatcaggaatttctttatattctc

SEQ ID NO: 566392 - DNA, 309 bp, Homo sapiens
  misc_feature (17)..(17): n is a, c, g, or t
  misc_feature (77)..(77): n is a, c, g, or t
ttttttttgagacaggntcttactctgtcacccaggcaggagtgcaatggtgagatctcggctcactgcagccttgnctcccaggctcaagcaattctcgtacctcagcctcccaagtagctgggactacaagggcacaccaccacgcccagctaatttttgtattttaggtaaagacagggttttgccatgttgcccaggctggtctcaaacccctgggctcatgcctcggcctcccaaagtgctaggattacaggcgcaaacttttcttaagtatgaaattatttcaaaatagaaaggtcgtcgacg

SEQ ID NO: 566393 - DNA, 130 bp, Homo sapiens
  misc_feature (12)..(12): n is a, c, g, or t
  misc_feature (68)..(68): n is a, c, g, or t
  misc_feature (103)..(103): n is a, c, g, or t
  misc_feature (107)..(107): n is a, c, g, or t
tatctatatatntatatatgtatatatacatacatatatatatatatatatatatatatatcacacanacatagatatatatatctatcaatactactccacncacnatctctctctctatctctctcta

SEQ ID NO: 566394 - DNA, 782 bp, Homo sapiens
tgtctgaaaattgtttggttatgagttgaagatcaagggaagaaggtaaattgtcatcactgagacgttattttgatgccgattctcgatgactgtgggttctccattcatcagtctgcacacagtctgccatggtcttctggaaatcatgcaagtactgtaagcttttaggttggcagtagaatcaacctagctgcccacactgcccgttctccccatcactggagttagcctgggactggagtgagttctcaattttgttggtagattttaatatttattttcccttcaaattttaagaaagttggccttagtaccataaacactgctggaaataaacacattattaaaaagcatatacccattaatcttttgggggtgttttacatgtaaaatactcttacaaatataatcaatttatatatgcaatataattgagatgtggtcctttaaacagcctggttttctgtatacagtgtacttttgaatttaaatgctcacttaaaaaagtagattataggctgtaagatgctgttatgctttaattaatcaggatgcaagacacatacccttactgttgtgggaaaaattcttcggtctgcacacacaaaaaatgtttctgaatgaagtgaatagatcacactgaatttgtgtgttgtaaagtactcaaggcatcagcacattttattaaatcatcctccaggagattcttagctttaaaaaagccatgataatatgcaccaaaaaagtcttaaatgaattcagattttcagcctttttta

SEQ ID NO: 566395 - DNA, 184 bp, Homo sapiens
ggcacattgtgctggcacaagctctgcccaagcaaagccacaggggagttaacacccgtggggagccctcaagcccgtgcagacagagccccgcctttggcccttcccagtgcacactccttggaggcctcgtggcaggctccatcagagtgtggtgacgtgagcccttgatgtgtacatgcag

SEQ ID NO: 566396 - DNA, 415 bp, Homo sapiens
ggaaagaaactcacattgatagggtacttactataggcatagaagcaacaaagcagcacagccatgggcaaacaaagtgagacccgggtggtttacaaaaaatttaaaaattagccaggtgtggcggtgtgcaccatgtagtcccaactacacaggaggctgaggtgggaggatcacttgggtccaggaggtcgaggctgcagtgagctgtgtatgtgccactgcactaccagccgtgcgtgacaaagcaaaaactctatgtcaaaaaaagaaagaaaagcaaaggaaaggaaaaggaaaaggaaaagacacggcaacgacaagaaaaggcaaagaaaacaaacaacaatagcaaacggaaagaccaggcatctctgggactcagtaatcaagaaagccatttgacactataact

SEQ ID NO: 566397 - DNA, 278 bp, Homo sapiens
tgagtaccctggtcatccacaatttgaggaacagcacagtatgatcctgtactgactctcctgtaagacaacagattctagcagtgggaccgaaacaaaaatcatctaggaacttaccatctttaggggagtcattttaggagaccgccttgggtgacattgtagcatggtggaaattttactggatttgggcgtagactctgcaacctcagggggagctaggaacataatatttctgagtctcagctcttttgtaatctagagctaaaactgcaggg

SEQ ID NO: 566398 - DNA, 129 bp, Homo sapiens
cctcaccaagacctggcagaagcaggaagcagagaaccatatttatatcttggaaaataacattactggtgtgaaggaatgacagatgcaatagtaccttgtgggcagcaagcaggacagcacagggtc

SEQ ID NO: 566399 - DNA, 355 bp, Homo sapiens
gtgactctgaggatccaatcgcagaccaaggagctgtggaaaattgtgggtggcaaaccacccaggtgctgagcgcaagagactgaggacacgagctgttcccagtataataaaatataaaacaagaatagttataccagatatagatcttagatatgattatatatgaatatcattaatcattatttgtagcaattactctttattccaatattataataatcctcactctacaatcataacctaggaaaaaccaggccatacagagataggagctgaggggacgtagcgaggaaggtgaccagaagacaggagtgcgagccttctgttatgcctggacagggccatcagcagg

SEQ ID NO: 566400 - DNA, 137 bp, Homo sapiens
gttttgagacatagtctgactcctgtcgccaggctagagtgcagtggcgtgatcttggctcactgcaacctctgcctctacctgtgtctccaacctcctgacctcatggtgatccacaccaccccgagcctattttt

SEQ ID NO: 566401 - DNA, 321 bp, Homo sapiens
gtcacccacacctatttgcacactccctccccttttgaaaatccctaataaaaacttgctggtttttgtggcttgtggggcatcacagatcctaccaacgtgtgatgtctcccccagatgcccagctttaaaatttctctcttttgtacactgtccctttatttctcaagccagccgacacttaggaaaatagaaaagaacctacgtgattatcggggcaggtccccagtaagagtgagaccttgtctcaaaaacaaacagacaataattatgtttacactatactgtagtctattaagtgtgcaatagcattatgtataa

SEQ ID NO: 566402 - DNA, 304 bp, Homo sapiens
  misc_feature (127)..(127): n is a, c, g, or t
gcgggtgtcaaggatccggaaaatagcgagcatgaccattagcattaatttttctattactacatagatctttctgtgtttttaaaaactgtttttcagactttgagttaggctagtcttactctgnctgaaccctgttttctactcataattctaataaaggttctagctgccatttctgatagtaacctacatcagaaataaaaaccacaaatcttaagataaatgcagtgtcaagtgtctgctctcctcccagcttacttgctcgacaccccgtcgctaatttttaagctccgtagtcact

SEQ ID NO: 566403 - DNA, 1014 bp, Homo sapiens
ggttagaacaaggaggatgacgggcaaggatgttctatgttcgaggccttagctgcgacactacacacacgaaaagatctgaaggactacttctatccgaaatggggtgaagttgtagactgcgctctgaagttgagatcctatcacagggcgatcaaggggtttcggctttggtgctgatttatagaggaaatcgcgcagaagctggtcagagtcagacgtgctcagtgggaatctaagagagatgaactactaacaattttggacactgcgtggataggtgcgattgagtcctacaagacgggctcaatagccatggacacaccaaaaggagcctggttaaaagaagtggtgaagctgcgtggcactttctccagatgcaccatgcatcgagagaaataagggacgtacttatggtgggatcggtgagtgtgggaagtccggtaagaagcctccccaaaggatcgaacaaggaccaatcatagagagcagtggtgtttcgtgcctttatttagcctttaatcggaaggagagaaccagcgatgagaagatacagtgggcccagacgagatagccacaagggtctggttgctctaggtgaaatgtgaagatagaacgatagacctctgtcgaaatgaactagtatctgcaacagcaacagtggggatctaggacgaggatgtgcaggaagagctcggtgtgaagaagaccagcaagagtgggttagtgaggaaggtatccagggcgaggtggtcgtggtaataggctaccaagcgttactgatatgtattcccatttgcaagtgtatgcccaacaggtggtgaaagcagtatttccactctggagatcctgctgaggtggtccctgcagctgctaataagagttccaactaaattttttgatcaagtccctgctggaatttgcgttgggccctctgaagtaatctgagtctcctaaagaaattgttctggtttttcttactggatgtccacacactgggtttgcccccccgtg

SEQ ID NO: 566404 - DNA, 280 bp, Homo sapiens
gacttcgagcttggacccgtcggcgtgtctgaggtttcagcgatcgtccacggatgggttgcggtgcaacacgccagataccgaccttcgttcaggtagtgctcaatcaggcggggttcattgggatcgaggccacagcgaatctggcggctcatccaacgccagctttccagatagggatcctcatgcaggacagaactcatgagccacactcattcggtaatgatatttattattaaatgatactgagaatcaaaacaagagcagcccattaatcctg

SEQ ID NO: 566405 - DNA, 927 bp, Homo sapiens
tacacccaatgaattcatctctttatggcatatggctattttaaaaaaaactatgtccggtctcataacaaatatcttttttttcctcagtactcatctaacaaacggtctgtgcacctaaagactaagtggtccccacttacttaaggctacactaacgatataagactttattaagttgagttgtacaaatttagtgctttttctttttgtgcatttacattttaaaaaaacaaaaaaagtttaaaatacacacccaagagagaaaccggtggcatacttacaccagccccaactctaaaaagtacggcttccttctatgggtcctcttttttttctcttttttcacacaagtggccctgtggaatattcccttgcccacagtcttctctcaggggaagacgaaccccacaaaactgtgcaaaatgtggcaacagaggaggcgccccaccagagtgtgggccatatacctaacacggagacgcaactgatttaacacagggcgccaaagacgaggacacgttacacaaaacttctgcccccctttatgttagagtttccccctcaccccgtgtcatagtcccgttaaactctgtaacaaccaagacgcctttttccacacaattccggtctccaaagtcttgagcccgagacgcaatttttctccgtggtcaccaattttggcaacggtcaatactactttggcgggcccttttagtttcgggacgacgccataacgccttcatgttttttcccactcttccctcatcctccaacgccttttgtgaccccaagttctttttttgctcctttaaacgcgtgcgttattggccaccccgcttaaccgcgcatcgggggagggccccctgctgtgtttcaaccgccctatggcacgcctattcccatgtgcgcgacccccacttctcg

SEQ ID NO: 566406 - DNA, 222 bp, Homo sapiens
ggtggagaacatccggtccaccgctgcgatctgctcgtcagtgccagtaatgcggtgggcagcggccagcgagaatccccggcccattccgaaatacagcgacccgagggcggccacgtcaagggtcacggcgtccgtggagtcgtcgaccttcgtgacggtcgcgggcgctcccggagcctcaacgtccactcgccaggtaccttcggcataacccatcgg

SEQ ID NO: 566407 - DNA, 802 bp, Homo sapiens
  misc_feature (27)..(27): n is a, c, g, or t
  misc_feature (29)..(29): n is a, c, g, or t
  misc_feature (67)..(67): n is a, c, g, or t
  misc_feature (101)..(101): n is a, c, g, or t
  misc_feature (109)..(109): n is a, c, g, or t
  misc_feature (112)..(112): n is a, c, g, or t
  misc_feature (121)..(121): n is a, c, g, or t
  misc_feature (125)..(125): n is a, c, g, or t
  misc_feature (134)..(134): n is a, c, g, or t
  misc_feature (171)..(171): n is a, c, g, or t
  misc_feature (183)..(183): n is a, c, g, or t
  misc_feature (209)..(209): n is a, c, g, or t
  misc_feature (243)..(243): n is a, c, g, or t
  misc_feature (264)..(264): n is a, c, g, or t
  misc_feature (272)..(272): n is a, c, g, or t
  misc_feature (275)..(275): n is a, c, g, or t
  misc_feature (286)..(286): n is a, c, g, or t
  misc_feature (334)..(334): n is a, c, g, or t
  misc_feature (365)..(365): n is a, c, g, or t
  misc_feature (419)..(419): n is a, c, g, or t
  misc_feature (437)..(437): n is a, c, g, or t
  misc_feature (449)..(449): n is a, c, g, or t
  misc_feature (467)..(467): n is a, c, g, or t
  misc_feature (472)..(472): n is a, c, g, or t
  misc_feature (478)..(478): n is a, c, g, or t
  misc_feature (495)..(495): n is a, c, g, or t
  misc_feature (510)..(510): n is a, c, g, or t
  misc_feature (523)..(523): n is a, c, g, or t
  misc_feature (565)..(565): n is a, c, g, or t
  misc_feature (584)..(585): n is a, c, g, or t
  misc_feature (587)..(587): n is a, c, g, or t
  misc_feature (591)..(591): n is a, c, g, or t
  misc_feature (627)..(627): n is a, c, g, or t
  misc_feature (630)..(630): n is a, c, g, or t
  misc_feature (680)..(680): n is a, c, g, or t
  misc_feature (685)..(685): n is a, c, g, or t
  misc_feature (703)..(703): n is a, c, g, or t
  misc_feature (712)..(712): n is a, c, g, or t
  misc_feature (716)..(716): n is a, c, g, or t
  misc_feature (728)..(728): n is a, c, g, or t
  misc_feature (741)..(741): n is a, c, g, or t
tcaaaaaaaactttacttatggacaananatttcacagttttataccattttcacatgtcatcaaanaatcttttgattttccaaccatttaaaaatgtangctggctncantggctcatnactntaatcccancatcttgggaggacgaggtgggcagattgtttgagcngaggagtttganaccagtctgggcaacgtggcaaaacnccactgtttaaatgaggggaagtccaaatgttanattctggacttggctcttccnctacttanctnccaaccatganaaacacgttaaaccttaaaaaaaaaaaacaaaccatttttctatttanagcatgttaaatcttactttttcccataaantcttccttgattcattagttgtcctttactttttttttttttttttttttttcntgaaacggagttcccccntttccccacccnggagtccagtggcaccanccccncccacnccaaccccccccccccnggttcaggccattcncccccctcacccnccccagtacccgggactacaggcacccgccaccacgcccggntaattttttgtatttttannanaganggggtttcactgtgttagccaggatggtctcgatcnccngaccttgtgatccgcccgcctctgcctcccaaagtgctgggattataggngtganaaccacacccggcctgtncttttaaanaaantgaaatttatanaatctatattggnctgctcaggctgccgtaacaaaataccagactaggtggtttaaacaaagaagtttattttc

SEQ ID NO: 566408 - DNA, 331 bp, Homo sapiens
attttgtgtcatttcctttgttttttttctttattgtggaaaattacacataaaatttaccatcttaatcattttgaagtgtacagtgaactcagtggtgtagtagtcccccttgctcttgggggatatgttccaagacccctgatatggatgcctggaaccttggatagtactaaatgctatatatgatatggtttttcctatatgtatatacctatgataaagtttaatttataaattaggcacagtaagattaacaacaataataattcaacataattataacaatatgctgtaataaaagttatgtgaatgtggtctctctcaaaaa

SEQ ID NO: 566409 - DNA, 142 bp, Homo sapiens
cctgaaaggaatttgcacctcggtttctctttaggctccaagattctcaagaactccagggttcccgctttccccattgcggtgggtctccttggggcccaggagagtccgctgagcaaagctggctcttgagaaaaccagg

SEQ ID NO: 566410 - DNA, 1043 bp, Homo sapiens
  misc_feature (195)..(195): n is a, c, g, or t
  misc_feature (528)..(528): n is a, c, g, or t
cctgtgctgtgcaaggacccagtccaggagggctgggctgaggacgtggacctccgggtgaacttcggcatgaatgttggcgaggcccgaggcttcttcaatgaatgggagaatgtggtcacttcgtgctgagcgcgggatggctgacccatggtcatccgtgcttcaccagacacgcagtgcgtgttgttcctngtgccgtgcatggcaccgccatgagcacgccatctctgcgagggcacgaggcgctgacggccacttcttgcctgagtccgtctccaagtgcaggccacaagcatgccgacctcgaccatgtaacatctcagctagtgtgtctctcgtggcgactgtgacaaaggagatggggaaggggaccatggcgagttaagcaatgcgatgcataccgctctacggacgcgaagagggcaccgcgtcatgaatggacaggcaacgttctggacacacacgtgggaggaccacgcaggaccacgcagaatctagtgtctatgctgcgatacgatgtgtggngacacgcttgtggtcgatagccataacgtggatcagtagcgcgacggtggcatttgtcttgcgcactgggccgcggatgcctgagaggagcaccatggtgccctggacgccgaggcacccagccatctctttagcccccgaattatgcggggaaccaacaagtcgccaaacactgggcgcactccatggagggtcagcgagggactgccatcacgcgctagacgccccgtgctcattagtaaggtggcctttaccccatgggagcaacaaaagactatgacacccgaggcctcccctagaaggggagttggggggtcgcgggaaccgatggcgatggagtaggccatatgacaaaaagaacgcgaaagcgggcgggagcccaacgttggtacaggccgacccataggcccaaagggggcaaacccccagaaggaccattacccccatcctacgagggagccccaggggtggccagtcggaggcactcgcggggaattcacccactccaaggggag

SEQ ID NO: 566411 - DNA, 1165 bp, Homo sapiens
  misc_feature (222)..(222): n is a, c, g, or t
  misc_feature (490)..(490): n is a, c, g, or t
  misc_feature (1113)..(1113): n is a, c, g, or t
  misc_feature (1161)..(1161): n is a, c, g, or t
gcccactcttggaccaggccctggcaaagggggatgggtcgactagtgtatcccctggcactgagcacacttgccctttgagctggggttttgttagtagggaggaagctggagtggcagttggatagacaattcatagtagctgctgccatgttcaaaaaatgctgcaatgtaaaatcataaagtattcatctaggcataactttttaaaatattcagtcnccttttattctactaaaatcaattttaacattttagtgtatattattttattttagattcagcaggtacatgagcatgttagttttgttttgttttgttttgttctgttttgttttttgagatggagtctcactctgtcgcccagtggtgtgatcttggcttactgcaactctgtctcccaggttcaggtgatcctcccgcctcagccccccagatagctgggattacaggcacatgccaccacacctggctaatttttgtatttttngtagagacgggagtttcaccatgttggccaggctggtctcaaactcctcacctcaagtgatctacctgcctcagcctcccaagtgctgggattacaggcgtgagccactgcgcccagccacatgtgcgtgtttgtgtatattgcgtactggtggggattgggcttctgtcatacctatcacccaaatagtgaacattgtactcaggtagcatttcaacccttgccccccctcccactcacccccttttggagtgcccagtgtttgctatttccatctttatgtccataggtacccattatttagctcccacttataagtgagaacatgtgctatttgattttctgtttccgaggttaggataattacctcaagctccatccatgtggctgcaaagcacatgatttcattgtattttatgactgctcatgtatattatttcagcctccaaaattttgtatgttatttataatgatataaattatgtggttttatcgtgtactctatctcactcaggaaatacatacaattcttcgttcccaggctactctgggagctgaggtggggagggatcacttgagcccagggagttcaagaccagccgggggcaacagggtggaaaccnttgtctctggaaaaattaaataattacacaccccacatggcacacacntcca

SEQ ID NO: 566412 - DNA, 477 bp, Homo sapiens
  misc_feature (6)..(6): n is a, c, g, or t
  misc_feature (28)..(28): n is a, c, g, or t
  misc_feature (32)..(32): n is a, c, g, or t
aaaggnaacccaacccggtcttctcaanaaanacccccaaaaaattaagttttcctttttcccaaggtgcccaaggccaccccctatgtcacgccctgaagtagttattgagaaagtcgtccccctttccccccttttcctataacccaaatagacaggaatggaagattcctccctcggggccctgaaagcttgcgggatgaataactccctcctcctcaggccccagtccccaaggtacaaacttgcacccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttgggctgatgccattttaggcctcagcctgtctgcatgcaggcgctcattaaaacagcatgttgctcc

SEQ ID NO: 566413 - DNA, 540 bp, Homo sapiens
  misc_feature (222)..(222): n is a, c, g, or t
gcccactcttggaccaggccctggcaaagggggatgggtcgactagtgtatcccctggcactgagcacacttgccctttgagctggggttttgttagtagggaggaagctggagtggcagttggatagacaattcatagtagctgctgccatgttcaaaaaatgctgcaatgtaaaatcataaagtattcatctaggcataactttttaaaatattcagtcnccttttattctactaaaatcaattttaacattttagtgtatattattttattttagattcagcaggtacatgagcatgttagttttgttttgttttgttttgttctgttttgttttttgagatggagtctcactctgtcgcccagtggtgtgatcttggcttactgcaactctgtctcccaggttcaggtgggaggattgcatgggcccaaaagtgggaggttgcagtgagcttaaacgagatcgcccccctgccctttagcctgggtgacagtgagaacttgtctcaaaaaataaataaataaataaaatcccttta

SEQ ID NO: 566414 - DNA, 1735 bp, Homo sapiens
  misc_feature (411)..(411): n is a, c, g, or t
  misc_feature (467)..(467): n is a, c, g, or t
  misc_feature (585)..(585): n is a, c, g, or t
  misc_feature (619)..(619): n is a, c, g, or t
  misc_feature (755)..(755): n is a, c, g, or t
  misc_feature (1406)..(1406): n is a, c, g, or t
gctatgaatgagtgaaggtgcgcctccgtccacactggaggtgtacgaacggaccgagcggcggtgtttggggcggcgcactcttgttggagctctctgagatggcgccgcccaacgggtggtggcacgcaagaaagcgccggggctttgtgtatgaccgtccgcccgtcccgttgtgcttgtatggcccggggcttctgaatattggtgtatcgccgagagcccccctgggggggggcggaaatattttggccaacgcgaaggggggtgcccccccgtttctgccggtgggtggcgtaccacgcgggttttgtggtctcgcccgagaatgtttttctagaggccttctacttgtggtcgttaatgagctgtatgtcgcgcgccggtgcgggttggggtgtgtgcacgcgngtgtcgaaaagtgtgccgccactgtctatatgggatggtgagtggtctgtccgccnggggggacgcggtctagttctagctcccccccgggaatggaggaaagagttggtgttgttcccgcgacaagaatgtttttgaccacaagggatttctccccgcgggagagatttctcntcccgcgaacccgcggggtttttgttgtgccccnctggggagaagcgtgtgtgaacaggggcggataaaaaaagttggcgtccgccaagtaatggggggaccacacagagaaaggggtgaaaaaccaatgtgtgggagtgggagactcttcgcgctcgcaatatgggggntggggagaaaaaaggccgccgtgcccccgcggtggagatagggcgccctcccgaggaggggcacgaaaaaggtgcatccctcggagtaacagcgcccccaccggtgagagatctcaccactcggggtggttcgcgagtagaatgttgtgtggttcactgcggagagccccctcttcacgccttcggcacagggggggagacccacacagtgtgttgtcacacacacaaaggagagagctcttcatccacacagagagagtgacacacttctcacacaagatatttacacactggtgaggaatagtcacatactcacaaaagggggagaaaatctcttgagaagagacacacagagagagtcccacagagtaatagagagtgtatatacacgctctgtgtaatatgacacacagggggggctctgtcacagagacacacacattttcacacagacacacactctctctctggcgtcaaagtgtgttcacacacaatactgtacaccacactgtgtctctttatatttgggggtgagaagacacacatcgagaattccacgcagatgggaacatcggtgtgtgctctctatatgtggagatctatcccgcgcgagaggagatgggtgtggagaccccacataatatatgaganttttctcttataagaagatggttttatagaaaatggagaaaaatggtaaacacaaatgtggcacacattatatgtttggagatctagtcaccccggtcacatcacataaactggctgtcttgggttggtcacatccaccaccacacacacccacggagacttataagaccacaaatgggaactgagatgtcacttcttgagagctctttcacatttaattttgaactgtgaatttatatttggagatgcgaagcgccattgtgtgttaaagaaaaaacacatgtcacatgtaaggttgtcctaaaaaataaaatgccatttaacctcca

SEQ ID NO: 566415 - DNA, 1292 bp, Homo sapiens
aagaatcaaattgattatgatagtagttgacaaaactacactaaagaatttcttaactacaattagaacgtatcagcttggtgcaacacagtacatagcagctatacatgctcatcacatctctaccactacgcaacaacgccaccatatatacctgcttgcaaccaaccataagtacctacacacgacaccacaatactaacttaagccctgacgagacacagcaacatcatcaagcagcacttgcaactacccaaaatactctattgcactaatcacaccatcacattcacactcactccaccaacacccacacagaccctccacacgacacttctacaacacaacactcgacacccagacacctcatcctagcacgcaaaaggcatgacagaataacaacgatcgaaacgcaggacccacaaccccttagtggaacatcaaatacagggacaactacacccctcgcacagcgcagcaagcagcaacgcgaaaaacaaactcattcgggaaccaacaccaactaaacactatcaacgacaaattacttcaacactccaatgactaaaaaatttccaacaccaacacaccttatggcactacgcacacataacttaacaaacaattaccaaaaaataacacaaccgccaaaacttacacagtaatcaacacccaattcccacaaacactacctacattcccaaactactcaacactattccccatcacaacctacaccttacgcctccactcaaccaactctccctacacaccgtcccacacccgctccaccaatatacacaccacatatccacaaccgccagccctaccattacatcacctctcccaaatcctcacccactcctcacaacgacgcatctcgccaacactcaatgacactagaccaaagagaatgcaccattcaatggccaagcaaacaccatcctattaacagacaccaagaaatggaccccttcaagaggaaccccggctgatcgatacgtaaattcctttaactcggcacacaactccaacaagcccaaaaccaaagaacaatacaaacaactatcccaactccacaccctacgcccctccgaacagcgcgaacaggacaacacataaataccaccatacgcacgaacaagcaccaccagcccaacgcgccacaatccactaacacacacacacacagtaccgtaaaacacaaaagtacgtcaaagaacacacaaaaccagcgcaccaacaccaccacactgacccgcccaaacaacccaccataagcaaccaaacac

SEQ ID NO: 566416 - DNA, 513 bp, Homo sapiens
  misc_feature (36)..(36): n is a, c, g, or t
  misc_feature (64)..(64): n is a, c, g, or t
  misc_feature (66)..(66): n is a, c, g, or t
  misc_feature (80)..(80): n is a, c, g, or t
  misc_feature (102)..(102): n is a, c, g, or t
  misc_feature (108)..(108): n is a, c, g, or t
  misc_feature (144)..(144): n is a, c, g, or t
  misc_feature (156)..(156): n is a, c, g, or t
  misc_feature (185)..(185): n is a, c, g, or t
  misc_feature (210)..(210): n is a, c, g, or t
  misc_feature (219)..(219): n is a, c, g, or t
  misc_feature (221)..(221): n is a, c, g, or t
  misc_feature (229)..(229): n is a, c, g, or t
  misc_feature (243)..(243): n is a, c, g, or t
  misc_feature (252)..(252): n is a, c, g, or t
  misc_feature (254)..(254): n is a, c, g, or t
  misc_feature (286)..(286): n is a, c, g, or t
  misc_feature (318)..(318): n is a, c, g, or t
  misc_feature (325)..(325): n is a, c, g, or t
  misc_feature (328)..(328): n is a, c, g, or t
  misc_feature (443)..(443): n is a, c, g, or t
  misc_feature (500)..(500): n is a, c, g, or t
aaagtcgctctcaagtactggagcagctagcaagcncactccccactctcctcacttatctctntnacaatctctatcangctctggagcccgaagatatanccagcntcctggccctcatgcaccacggtgtcctcgccatanagcctgcaggtngtgtgtccaaagtcgatcatgcgcacatntacagaactggcgccgatggatttntaggcatangnaccagcanaatcatcagctgantcctcttanangtcctccaaatcctcagcatctcactccaggnccacttcgggccgctccttgccatcataaatnaccagcnggnagcttgatttgaagctgtttgtcttctgttgctccaacattgctttgagctcagttagcttcttgagcacagggcccaggagttcacggcgcaggtaccgcccattgtggaaganctggaaaagtgccttcttgaagccctgcaccgatagcttccgtccatggtacttgtncatgaacatgagc

SEQ ID NO: 566417 - DNA, 172 bp, Homo sapiens
actgcactccagcctgggtgacagagtgagacttcatctcaaaaaaaaaaaaaaaaaaaaggaaaggggcccccggaaggggggtaaagaagcccccccggggttaaggaaaggggggacccggccccaattgggaaaccggggcaaaaggggccccgggggatgtacccga

SEQ ID NO: 566418 - DNA, 333 bp, Homo sapiens
ggcacgaggtcacccaagttcatactgctgacgatacaggtttagagactaaagagagcgcatggaagaaaacttcaaagaaagagaagaaggatcgcagagttcaaaggaactcttaatttgggcccatcttttgaaaatattgtctctgcaaaagcttcgaacaccattttggatcctctggagaaggcaagacagaatgcagaggaagctaagaaattaccttgttagcttaaggttcctgttcctaagggtagcggtcaccaagcgactttcccaatgtaattatttttgtttgttccgcaagtatctaacaatatgatatattgctag

SEQ ID NO: 566419 - DNA, 295 bp, Homo sapiens
  misc_feature (31)..(31): n is a, c, g, or t
  misc_feature (64)..(64): n is a, c, g, or t
  misc_feature (118)..(118): n is a, c, g, or t
  misc_feature (194)..(194): n is a, c, g, or t
  misc_feature (213)..(214): n is a, c, g, or t
cacttgaggattaaatttttttaggggttgngggaggggatctgttaggaaactgttacctatnaacaaagattgactggattcgatccaaaagataaaacttgaagctattctgganctaacatggaaaaatgaaatggctattgtttaaaaaaatgatagaaatacattgttgatgggatatgagttaagtntattttctacaaactgtanntgatgaggacatggataatatgctcatggtagtgagaagtaacctgtatgtggggggaggggattcttatatttcccccca

SEQ ID NO: 566420 - DNA, 624 bp, Homo sapiens
attttaggtaccatggaataccattgatcaggatggtagggatggccaacgcagtagccttaacaccagtttttcagaccagagtttggaatcggttaattggaccagtgttggaagtgtgcatagttatccaccggaaggtcttgatgaagttaccaggttaatggttattcatttagaacttaaaattaacccaaccttatttgaaaggcaaatttaaaattgaaggaatgtttttctaactaataaattaattaccttagtaggtagatcaaaattagaggagatggtagctggttagggtttaaattgggtaccatattagatttttaaaaaatggttgtgcagggttaccagatttggggctacttaatctggtcctgggtccaagagaagagcatttggaccaggaaaatggacctttagttaagtggagcaatagttgcggatattcggaacttcttagagcttagatgatgcgtgtgtcaacatggtttcaagctgtggatctgataagggaattcttgccccagaggttaggttgggccggaaccactcaatgtgtacatactcatgcattttcaagttggatccacggggggttggtccccttttaccggcccg

SEQ ID NO: 566421 - DNA, 403 bp, Homo sapiens
  misc_feature (6)..(6): n is a, c, g, or t
  misc_feature (44)..(44): n is a, c, g, or t
  misc_feature (88)..(88): n is a, c, g, or t
tcaccngaatttgcccacgacccttcgcctcaaggcttttgcanaatgtctcttattttccttctaactcccctttcctcttcaaacnacacggcaaactgcggagaagaaaaataccactgggatgagatgtcttgaaagaacagagccggctttcccggaggctgtttggagcgtcactgatttaaaaaaaaaaaaaaatcatgggatggaggtggagcttggaagacagaaaattagcccggagactggggaggggatgttacaacaaagttgcactgtacttttaaatatagaagccctgtgtttattacaaagaagcggcccagctgtgtcagcagcctgagcgccgtacacgaaacaaaagcgttatcataaatgcaagttgaaattagaaaattga

SEQ ID NO: 566422 - DNA, 311 bp, Homo sapiens
ccagtgatcgagctcggtaccatctcgttgacggcgattatgttgtagctgagataatgtagggtccacccctaccgggtctgtgggttttctcttcgtgtgtgtgcggagacgagagatcgaagagataaagacagaagacaaagagataggaagaaagacagctgggcccgggggaccactgccaccaaagcgcggagacagacaggtagtggcccggagtgcctggaggcgctgctatttattgtagtcaaggcaagggggcagggtaaggagtgccagtcatctccaataatcgccggtcacgagat

SEQ ID NO: 566423 - DNA, 118 bp, Homo sapiens
tgtatgagcaagcaaaaagcacgtcaagcaacagccaacgcaagggcaacgccacagcaaccagacatgcacagcaagtgccaggcaacaccacagaccgggggcatcctctcagcag

SEQ ID NO: 566424 - DNA, 1124 bp, Homo sapiens
  misc_feature (546)..(546): n is a, c, g, or t
  misc_feature (584)..(584): n is a, c, g, or t
  misc_feature (595)..(595): n is a, c, g, or t
  misc_feature (599)..(599): n is a, c, g, or t
ggcgagagtgatgtttagacgcctgtgaatcccaggctctcgagggaggtctaagaagcggcaaggatagctggagcccgggagatcaacagctggctgggcaatatggcgaaacccagtgtctccactgaacgcggacaaggtgccggacgaaaacgaggtggtggtgctccccctacatgaatatatcgacatatcgcccggttaggaagctagatcccaagattgctgtggctgggcagaactgttacaacagtgacatactggggctttactggggagatcagttcctggcatgataaaagactgcggagccacgtgggtggttcctggggcactcagagagaaggcatgtctttggggagtcagatgagctgattgcggcagaaagtgacccatgctctggcacaggggacctggggggagtaatcgcctgcattggggagaagctagatgaaagggaagctggcatcactgagaaggttgttttcgagcagacaaaggtcatcgcagatacgtgaaggactggagcaggtcgtcctggcntatgagcctgtgtgggccattggtactggcaagactgnaacaccccaanaggnccaggaagtacacgagaagtccgaggatggctgaagtcaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgcttagtccctggcttggcaggaagggtagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggacaggcgtggtgggatctgctcctgggttccctaggccctagtgaggg

SEQ ID NO: 566425 - DNA, 1322 bp, Homo sapiens
ggtaccgtcgttgcccaacctgtgtcgttgtttagtgtgcggctacaaactggggacatggtcaagcgcctggtccagtcgcttctgctctcgttcggacggtggtatggtgatcccgtcgatcctgtcctcctgccgtgcaacgaaatacttacgcacatgacatatggacttgactttgctaaccatcaatttgaaggcacgtaatgactctatacacactcggaacgttggataaggtcgcgcactcgagagctctctgagagacacgtgcagggaggcaacgtggcgaagatgaatgtgggtatgagtaggatactgatatactggtgttgcctaggaacacatggcgctttggtagacgctacaaatagattgggaagccatcgtctgtggtccgacgcgacatattccaaatcggttcaatcttgtagctgaggctcgctcatctctcaaaacgcatctgagagtcaaccttagctgctgctgagtgtagcaattgcgtctgaatacacattacaaactgactgccggatacgcatacgaacgggcgttaccctctatccagtctggaaatatacccggagaattcgtgtgcagtgggttcatataccgtttgggtgcccacccgtaacttagggccaatgtacgagggctggcaaggggcaagaaggataatcgcacccagcgaaatgtcgaaagactgttcttcatcgggaaaaagcttcccggaggtggacctacgattagaattaaccacaacctactttgacagcatcaatacgacacttgctctctcgttccaaagccaccgacatcgattcaccagggtggaatcacagtacgattttgccgcttgtgtgagccaaggcaccgggggcgctcacacgggctactaaatgccccaaaaaaagcgtacggtggcctctccagagaaaccttcaagttcctcatgtggaaccttcgcttttatctccccctgtggaatttgaggatgtttaggcttaggccaaaccaaagagaacataaaccctggtcaacgttggcacggagcctatgtcgcattgcagaatacccatgtggcagcctgggcgtggagtcaaagggagcccagagtccaagaaaattgtgccttgacttgggcgcggactttgaaaccacgtcaatttggcccaaggtgggttggcccattaatcgaaatcgccaattgcattggagttgcgttaccaccgaattgaaacgcgccacgttgttaggaccggcttttggccctaaactcccctgggtggacccaaggacttgcgccccggccaggcagaacc

SEQ ID NO: 566426 - DNA, 799 bp, Homo sapiens
gggaaagagggggtggggggaagactggatttaactccccctcccactcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaacggtatttaaaacctttggacttggagtctggctgggtaaagcttctggaatattggagtttggctggagaaataaaaatcaaaacttctttaagctgggtaaagtgaggggcccaccagcagtggatctcctggatgccttactgggaaactttggtttacttggtctggctaccctctggattggttttaaggttaagttttaattggtggagcacacttagtacctagttacatcttaagatcaggtggtttaaaactggtggagtgggagcggtaatggtatcggaatggactgggaatggtaagctggtcagggcagaaaatggtggttacactttggctaagatctgggggtttcttcatattcctgctgtcggaagcagtggaccagaaatggcttgccagtactggcaaagcactgctgtgaaatgtgaagtactggtccttaaatttacaagcgatttcctaagggtgactaattattttctctggtccttcgtaattacttggcagtggttgggggtcagaagtccttacctcttaatatcgttcggcggtttacctcaaaccagtgtggggggccaacaaaaacaacacagg

SEQ ID NO: 566427 - DNA, 123 bp, Homo sapiens
ctgtaatacactcgccaggattgctgactccaggacagttgggtgaaatgggtccctgggtgacatgtcagatctttgtacgtaattaaaaatattagtggcgacgtgaaattacgggccagc

SEQ ID NO: 566428 - DNA, 930 bp, Homo sapiens
aaagaaatgggcaatatcatctctgatggcgatgaaaagagtcggaagaaggggtggtcatcacagtgaaaggatggaaaaacactgaatgaggaattagaaattattgaaggcatgaagtttgatcgaggctatatattctccataagtttatgaatgacatcaaaggggtccagcacaatgtgcaatggccagggatgccctatgttcggggttgcaggtgaaatagcaagcattttctcaggtatcctagtccatggttacctgctctgggaaattgccaagatgcctcgaccgtaggccttggttcataatcgctgcaagcatgtgggatggaacgcaagcgtctaagtgacactcgtcgtggaataggctaagaggtgggtctgcagagttgtgggagtctaaggactccatgggttatggtgacaatagaaagaatcagattagagatatgggtatggatactggatggtgcagtgttggagaagagggatggatcctgattcttgaagacgtacagactgatggctgaggaaaagtggagaggtcatgtgaccaagacgatgccagtgtcttaggagggataaggtgacaaggggctcaactggagatagtattcatgacagccatggggcgtagatgtggcaactagtgatttgagggaaaactggaatgaagggttgcagactttacggggggatggtgtgctgaaggtggtgggacaagggatgtgcgtgatgaaaagaaaacaggtttcgattggcgtaaggtaaaaagggggtgaaaaggcgggtgggggggggaaacaccaaaatagtacgggggggatgagcataataggaaaaggttaaatattaacacaatagaagtgagaggggggtgtagaaaaaatcaggggattggatggattgaaaccacaatataatg

SEQ ID NO: 566429 - DNA, 956 bp, Homo sapiens
  misc_feature (1)..(1): n is a, c, g, or t
ncatgactcggcatagcaaccatcaacgctcatagttttagataatacacccgtcgtaccccctcttacgtcctcggaatcacaaagcgctcttgatcacaacgtgtgtcagagttaaaagcacagccgtggttcaacacagggcactcccctttgtataagaccgccccgtttgttcaagaaccccccggagggtgcccacaaaagaccagctgtattatacccccggtgccccttctttgatccacaacacaagtgtttacctcttaagggaacccgacgctgcctcttacaatgttaggcaccaggcggccccacacaccctggaattttaaatccacctcttttcctcccggaaacttttcctacccgaggattcagggggttgtcgggatacaccacgccacattcaaagctggcgggaaaccaccctctgctcttaaaaaaaatatggagaactgccaacagctattctacggcttcagtccgagctccctaatacaacccgcgtgctttaatagtgtcagcccccgctactccccttcgaatgacgctttctgtacataattaatcggaggtccccacccaggggctccctgtcccccgtgacgaaggcactctctatgcggacttgacgatcagtggaaacagtctattaagtctaccctttccaaagggtacatacatccacatggttgcgtggcttttggaggggaaaatagcaagcaccacaaccattctttccctcctcatggggatctacatctctctcgtaggtcgccggtagcagtcccaccatgttctcccccgatgacacgatatgcggttccccaaataccgccccccttctagtataggacgaacatccatcggggggatctacctacgcccccaggaggacaatttaatgtttttcgtaaggcccgaaaaaaaaaacaatcccgttccacaaaaca

SEQ ID NO: 566430 - DNA, 187 bp, Homo sapiens
  misc_feature (33)..(33): n is a, c, g, or t
tagcccagactcacttttttaacagcccgggtngtgattaacaaaccaacttcccctataacaacatgaatccattcatgagggcagagcctcatggtcctaatcacctattaccgtcacagtggcaattaaatttcaacatgtagccaggcatggtggctcactcctgtaatcccagtactttggg

SEQ ID NO: 566431 - DNA, 862 bp, Homo sapiens
  misc_feature (1)..(1): n is a, c, g, or t
  misc_feature (434)..(434): n is a, c, g, or t
nggtccctctggggggccgacaaattattcggcgcccctttttccagggagggcctccccccccgcgaagatctgttgcgctcttttttgccgcgggacttttctctctatctgggcgatttgcgtgcccatcagtggtgccctgttggcatccagagattttttggagaatgaatccctgcggccctatgtggctttttgcctgtggcgcatcctcggagccaaacgtccctgttgtctgaggcgctccccccccgacttcttgggcgccccaggggccgttttcgctgtgctccccctatatgtgtccccggaccacttctccgaggggcgctcatcccccgcccctcgtgtatatcactacgtgttctccgcgtggttactcttgcgctacacaggtaggcccgttttaccttttggggtgtttgtttttntgttttgaacctttctcctgggtgactccttcttccgggcgttgacacgtctaccctatatggtggcgcgtttattgagtggagaccgggcctgggtctttgggacttgagggccagggtccttctgccccggggtgccccgggtggcgtcttgcctgctctagcacaggcactctctctggggcaccctctgccccagagaaatctagcttggcccacagtggggggctgtggtcccaccccgccccgcccctccctgtgggctgccacgcagcatccacccttgttccctcctcccccgtttgggaaccggaatttttgggccctttttgcctttaagcacccggtccttttttacccgttgcctttcacgtatccccacatcctgtgtccctccttttattaaaaagggacatcaggcaagccca

SEQ ID NO: 566432 - DNA, 604 bp, Homo sapiens
  misc_feature (323)..(323): n is a, c, g, or t
gggggctgttttggaaatttggctcaatccattggccaatttaactatctctacaccaaaaatacactatcttgatcacaataataatttataataagccttaataataacacaagtctccctgcctgatgttccttctttgttaatgaaatagctaaccctgcctctttacttttccaaatacatttcagaatctggcttccaattccaggaaagaccttgttgggatttggtttggaatcacattgaatccataggtgagttttgaaagaaactgacatacttatgccattggggcttcctatccattaatgatatatctntctccatttatgagggctttctttaatgtccttcaatatttttctccatagaggtgctcacttaattttggtccccataatcccttgggaaaaactcaacctacacgaaccttcccaggggccacccattttttttgtggaaaaagagtgtggaacttactgattttatccttttaatgggaccaaaggactgcttttaaatttttaaaatattttttttggcctcgggccccgaatatcttgggctctccggggggcccaaattccccttatagtggggg

SEQ ID NO: 566433 - DNA, 655 bp, Homo sapiens
  misc_feature (207)..(207): n is a, c, g, or t
cttcagaggctgcctgagtctcactaagtttctcctcagaacaatgggggagtggctggctcccatctggtgtcctgttcatctcaggagcccccagctccaggtacagatacgaggaggccaaggccaaggccctcccagccagctccagagtacgaaggggtcatcgtccttggtcacccacctggagggtccgagctccgtttngccagcgacccctggccctcgctgtcatcagcttgcctggtgctttgcgggtgcctgatgactgtggagtgacgttgaatggaaaggccaggaggctccatctgaggatgtatgctggccctgaaggccagcgtggggaacaagagccgaatggccatgccgggtgggagacgtgtgtgctgttcacggcacacctcggctgcctgccttctccctgactgtgtgccatgagccacattcgtgagggtaaatgtgtgtgtgtgagtcccttcctcgcctctgtcaaagactgcaggaaccttggaggtgtttggaagggataggagacccccccagcccccaagtcctgatccctttgtcccctggaaacggttcctctgacagaagctgacaagagccttttccaaagatggattgattcaattggcacaaacttttgcccggattg

SEQ ID NO: 566434 - DNA, 896 bp, Homo sapiens
gctcgagtccataggcatcccacagttatacacagtccagttggcgtcaccacttaagtcaatacaggccacatgtaacatccttctactaatgacaatcttcccctcaaagttcctcatcagaacatacaggaaagcacttctgaaacattctgaactaaaaacactcagcagacatttatctatatgtattcttcatgaaatgtgttcttggtgctttatgtactaatgtactacggtgttgaagtcagtttttaaacttgaaatcagatgcgtgtcacttctaggtaacggaccttttcaatgagtacgttgtaggtgatcaaaaagtccagactttcttttactacatgtgagatagttcatcatttttagctggcaatgtcactttgcacacaaaaaattaagagactagagcaccccataatgcaacgcaggcggagacagccgaacatgcgctaagacaagaacattctctcatagaacattgatctgtttcacaggaaacaaacctttgccttgaaatttaccacagttgagactgtaccattacatggcgttgaagaatagcgtattttcgttcctaagacatttttcgcttcatgagtattttccaacggtttcccataactgtgtacacattttctttaaaacacattgataccagcaagcaaactgcaaattggatgccggaattgtggtcacaccattgtgttactctacctccaaggtaaccaagcagtattgtggacaaaacatatccaaccaaatgtgttcaccacaaatgcactttctatttagaccacacggtaatggtagaaaaggtatctaaaaaaaactcaccactggtaaaaggtcgtggatcattctgatagcgaagggaacacaaccactta

SEQ ID NO: 566435 - DNA, 1107 bp, Homo sapiens
  misc_feature (1)..(1): n is a, c, g, or t
nttctttgttattgtttttgtttgtttttgtgtgtttttgtgtttgttgtgtttgttttagttattgtatttattttgtgtgaaacggagaaggaagcgaaagaaggagaggccaagcaatgagttgatggagtcgttttatccttgggttcgagcgtatggtctttagccatctttgtggtgctagcaaccactcctgccgcgcgggatcacccctgtttttcgacacacgtgggcctttttttggtccgcgcaagacagtttgtgacgtggtgggtcacgaccgacctcctgtttgggcccccgggaacatggtggcctcttgaaatgtgcgaggggcccacttacggggggtgtgtctcctttagtcgggtgccttggttgtggtgagtggcaatccctgggcaccagttcgtttggcgggaaccccgttcggcaaaccccggggttgggacttccgcatgggtgtcggcaaaaactcttcacggttccacactggccacgccacctcgtggccacgatgcctgccgcagtgggagagagactgtgggtattgctaataatatggtggagcatcacggaatttggggcctcgaatcaccggggagccctcattcactatggatctttaaagggacttgaagggtcaccccagggcgccctgtcaccctgtggttgtgcttggcccacaccccgagttggcacagcttggattcctaaacttggcttcttttgggaccgccacacggcccacacttgtgctcagtggcccgccaccccgccatgtggtgggtttgttttagacctcctcctctgttttttcttcgtttagagacccccccccgggccctctcccaccctctgcccccgacctcggtgggccccttctagagaggaggaggtggacctcttttttgcttttcacttttcattttcttggtggtgagcccctcggggtggtggtatattgtatatatggggaatagaagtgtttgaggttccccttttttcccctccccaattttctgggggtggaaaccgagagaaaaaataacttagatttaaaaattttaaaaaagtaaataaaaaataacttcccccaaaaaa

SEQ ID NO: 566436 - DNA, 114 bp, Homo sapiens
gacaagttcgagtttgagggagaagctgaaacgccagagcatatgacatcatgaatgtccgggccagagtgcagatgctggccaagttcagcaagaaggctgggaccccagcca

SEQ ID NO: 566437 - DNA, 339 bp, Homo sapiens
  misc_feature (44)..(44): n is a, c, g, or t
ttaaccggatgcttgaaggcaacagtgctcgttaagagtcatcnccactccttaatttcaaggacccagggacccaaaccctgcgaaaggccgcagggtcctttgcctaggaaaaccagagacctttgttcacttgtttatttgctgaccttccctccactattgtcctatggccctgccaaatccccctctgcgagaaacacccaagaatgatcaataaaataaacaaacaaaaaacaaaaacaaacaaacaaacaaaaagagtagagttgtcaggtcaaacataggaccctcagtcaaatgtgaatttcagataaacagtgaataatttttttggca

SEQ ID NO: 566438 - DNA, 143 bp, Homo sapiens
tggctgccgggccgatctccgagcggaatcaggatgccactccattcccctttttaatgtaactttttccccaggaggtattttttttttatgttggtcctgagtattttgcaaatgcccaaagaaaataaaactaaacccct

SEQ ID NO: 566439 - DNA, 322 bp, Homo sapiens
tcgcggccgcgtcgacgcttaaacctgtgaggtgaaagttgcagtgagccgagatcatgccactgcactcctgcctggacaacaagagcgaaactcaatctcaaacaaacaaacataaatgaaaaggctgggtgcagtggctcacacccgtaatcccaatgctttgggaggccaaggaaggaggatcacttgagctcaggagtttgaggctatggtgaactatgattgtgccattgcactccaacctgggcaacaagagtgagatcaagagtgagacctcttaaaaaaaaaagtcgacgcggccgcgaatttagtagtagta

SEQ ID NO: 566440 - DNA, 365 bp, Homo sapiens
ggatacccgtgcgatcccccttcgtgatcaagacacggaatcggctgccgatgtttggatcgcaatgcgccccttttctagaggcgtccccgttcatctacaggcaggatgcgcctgggaaaaagacaactggaatttctcgaaggttgatggtccgcacggttgaggattctacgtggttctcttggttcccctggtgtgtgtgtgtgtgtggaggaggccgcggcccttagatcaccttcttgagctcgtcgtacaggaccagcacgaaggcgccccccatgccccgcaggatgttggaccacgcacccttgaagaaggccttgcccccctcatctctgaagatcttcctccaacagtcgacg

SEQ ID NO: 566441 - DNA, 927 bp, Homo sapiens
gcaggatcgcgtctccgtgcgccgtaaggatgagcgcagaaaggagaagagggaagagtactcgcggagcgaaagaagaggtgagaaagcaacacgaagcaggacacagctcaagcagctgatgaacctgatcaggatggagattctggtccaacgtctggagaagtctgcggaaagtatacatgtgcggacgagatgctggtgcctcgatgagcgggtgaccttggaaaaacgacttctgtacccctgcccaggtacgacctatggctcatgctaggaagttgctttggaggggacgagtactaacaggggccgttggcatggatggagaagccaccctatgtttgatggaacgacgacaggggcgttgatagacggacttgggagactgggactaagttgtttcacggggacctggagcaaggacgcaggactcgagagccgtgcatctgagcatggcttagtagaggatcacgcaagattcaactagtgggacgaccgatctacgaagtccctcaggagcaggcgcgaagggaatgaatagaatgcgcgagggcccctttagcggggcaagaagaagcgcaaggtcgcccttcgccgcggacgtggggcaggagaagcccgtgtatgaacccggggacaagacgttgcgaggagtacctggactgagtattacccgggtggactacgaggacatcatcgacgagctgcctgtcgcgttcaaagtaaccggacaggtggtgaccctgtgactttggcctcagcactgagtgagatcctcgcttgctgaacgataggagatgaaccggtgggtgtccctaaagaagaccctgagtgtcaggtcagagcaggaggagctgggacaagcgggcgtcagccagaaggccaaactcctggaacacgcggcgttttcagtactctgcaaaa

SEQ ID NO: 566442 - DNA, 1790 bp, Homo sapiens
  misc_feature (1101)..(1101): n is a, c, g, or t
  misc_feature (1790)..(1790): n is a, c, g, or t
cgtccgattcataacaatattttacaccattcgtatcaatgtaattatagaaccaccaatcataacgcatccaaggcatccagtcaattgtgtggttcatctgcccatttcaacacagtcatcccagtcatttgcatccacattcattcatcacacatcacatgcacaaaaatgcatttcaatcgtgtcaataaactaggtttcattcgtgcagtgcacatgtaatcatcactcagcagttcatcacatcacacattgtattcactcgtgacctccacccaaaccaccatgctcaggcatcataaccacccaaaaatcaagtcatttaactatatgcattcagagtcatcacaaggcagacactggagtagcctcatccacattcagcattccattatatagcaggccagcaccagcagcagctagtaacatccatcacactagcattttaagatcatagtaactagatcacatctgcagcacaaattggttccacccaaaaaatatcataacgtttataagtccagatgcattttcacgaattgttcaccaattatttcatcaagaggggcaccaatgattcatagtagatcatcagcagcacaatcaacattacacatatataccaatcaagatcatccaagaaaaaaaaacaaaagaaaaaaacacaagaggggaggagaacgaggatatcaaaaagagaagatataatacacacaattacagaaaggaaggagcaccacaacaaagaatatataacaagcgatgtataaacaccacagaagaattatatactttgtggaatcacaacaacacagaggaagcaacacacaatataatacagttagaatagctcaagcaatattaaacatacgacagcactaacgagacaaatagagagcaccagaacgagaaaataataacaaacaacaaggtacagaataagcaaatgagagagaaaaacaaaatgagaaacaacacacaatgaggacagaaacaaacataaaggaacagacagacaggaagaacaacacgaataaaacaacatacatgaggatgacggaggacatcaatcatcaccaaacacaatagggcgcaccnacagcaaaacaatcataacaacaaaaacacagagaatgagacacatatcaaaacacgaagcacaccaacaaagagaaacacgatgagtcaaacacagaagaaacaaccagagagcgatacacaacacgacgctctaacacacaccatcaccgcagagacacaacatacaaccagcaccagcaaagtaacaacacaaaataagagagcaaacaaggaacaaaaaggctaaaataaacaagacacacaatatatcaaacaccagagagcgaaggaaaaaagagcacaacatacacaaaaacacaagaacaagagcacacaaaaagcacaggaaaacaaacgcaacatacaccgaaaacaagcgagagaacggagaacaacgaatagacaacacgacagaagaaaagaaaacaacgaagaggacgagacgaaggcaagagagccaaacaaacaagaaacaaggagcaagcagacagagaacgaaagacgacgacgaagaagagaagacaagcagagacacagacgagagcgagggagcgcacaacaggacgcgaaaagaacagacaacgcaaaaacagacagaaagacaaacaacgacaaaagcacgatcacaacagaaacagaagaacagagaacagagagaagagacgaaaaagacagacaaagacaaaaggaagcaaagaaaagacaan

SEQ ID NO: 566443 - DNA, 460 bp, Homo sapiens
  misc_feature (23)..(23): n is a, c, g, or t
  misc_feature (201)..(201): n is a, c, g, or t
  misc_feature (244)..(244): n is a, c, g, or t
atacaaatttatttcaaagaagntatacaaatggcccaaaaagcacatgaaaaggtgctcaaccatccattagcccactggggaaatgcaaattcaaaacccacattgaaaatacccacttcgtaccccaacaggatgactaaaataaaagagtcacaaatgctcataaagatgtggaaacagccaagtgtggtggctcanacctgtaatcccagcattttgggaggccgaggtgagcagatcncctaaggtcaggagttcaagaccagcatggccaacacagcaaaaccccatctctactaaaaatacaaaaattagccgggcatggtggcgggcacctataatcccagctactccagaggctgaggcaggagaatcgcttgaatccagaaggcggagattgcagtgaaccgagatcgcgccattgaactccagcctgggtgacagagcgagattccaa

SEQ ID NO: 566444 - DNA, 683 bp, Homo sapiens
agcggttgttctcttgaggtcagggatttgagaccagcctggccaacatgatgaaaccctgtctctagtaaaaataaaaaatagccgggtgtggtggtgcgcgcctgtaatcccggccacttgggaggttaaggcaggagaatcgcttgaacccaggaggcggaggttgcagtgagccgagatcccaccactgcactccagcctgggtgacaaaagcgagactctgtttcaaaaaaaaaaatttttttgggtttaataaaaatatatttttaaagtaattgagatatctgggcatggtggctcatgcctgtaatcccagcacttcaggaggccaaggcaggtggaccacctgaggtcaggagtttgagacaccagcctggtcaacatggtgaaaccctgtctctaccaaaaatacaaaaacttagctggccatggtggtgcacgcctgtagtcccagctacttggagggctgaggcaggagcaatcacttgaacctgtggaaggcggaggttgcagctgagctgagattgcgaccacagacgactccagcctgggttgacagacgtaaagactccacctcaaaataatggggtagctacagaagaaagcttagcgggcactctagtcaagaggtggtagatgacctgggtcccccaacctctgatggatctcaaattgagccc

SEQ ID NO: 566445 - DNA, 529 bp, Homo sapiens
  misc_feature (298)..(298): n is a, c, g, or t
  misc_feature (432)..(432): n is a, c, g, or t
  misc_feature (449)..(449): n is a, c, g, or t
  misc_feature (473)..(473): n is a, c, g, or t
aatatcagtaagggatacaaaggtaatattctatggtctgtaaaagacaaaatttatgaatttatgaagtgtgaattcagctcatgttgaaagtttatgtcacacactataatgaattttaaaattatcaactatcaaatgttaaaaacaaacgcagccacctataactagacagatatggatcagaataatttatacaatcatttaacaataattagcagccgtgaattacattaatcatcttcctgaaaaattattctagagtggacagtttaatttgctttaatttcaaataganacacgtattcctgacctccttagctattttacaattctttataagaaaacatacagtattctttaaagtaagtctttatcatgagctctcacaaatgtatacttctataagcctacctcctcaaaaagaataanagatgttgcattttttntgctgggattacaagtatgagccnccatgcccagcaactcaatgttaattttaaaaacttttttttttttagaagaatga

SEQ ID NO: 566446 - DNA, 274 bp, Homo sapiens
agcaaaacgtggaaacaaaaatctgactttatgggtccgtcacacatccctatttagagctatccacgttgacgtcactacagctctctctgcttttacaaactagttgtatagtcagcatgagtgtgacaacaattagacgtcccctgtcatagccccatgcctttactccttcacagtcattcaatgacaagcgtaaaaagagcttcatcttttcacgaaaattcccattctacaagaacaaggagcagagtgaaacaaaatgaaccaagtg

SEQ ID NO: 566447 - DNA, 150 bp, Homo sapiens
ttctgctggtcgtctctagcagtatccccctgggtcagctctcgatggttgggcttggtgtgtattcctgcgtcagtctcagatctggactacagtcctggactctaacgggtccccgcatcatgtctacctgggcgctcctgtcttact

SEQ ID NO: 566448 - DNA, 1303 bp, Homo sapiens
  misc_feature (738)..(738): n is a, c, g, or t
ggagagaactagtctcgagttttttttttggtttttttggggggtaacatctgtgattaaatttacaattaaaaagccaaaaccctcattgcaaaggaaaacgtgcagtttacactttatttcctgggaagactcaatttataacccacagaaaatggtgtgccccgttgtggcatgtgtttttaacatgtggcaaggtgctattgattgtgcccaagacatctccattaaccgtgctgtgatatggacgtaaagaaatttcataaagtgaagaacgattgtggtttctcgtggtctgtggtttcctccttaggtctcagcgaaacgggaattatttctcccaacaaagtgtgttttgtgaccgtgaagaggagagttattgatcccagtatacgtctcgtgggtctataacctcttcgtgaatttacaccgtgcaaaagcgtgaaattctggggataaacttctcagcccccacatttttttcttttatatgtccaccccaatttttctcccatgtgtgtagttgtggggcttataaaagagcccccttctgtgtgcgttgtttcgcctctcagttctccctcgcgtggttccctccgtggtgctcgggactcattttctctgtctccctcgagagcccgcgacgcgaaagatgtcctccctctttctcgagtggtccatatgaggtgtggatattgtgagccatctcgcggttttgtggccacacctcttggggantccccgtgaaagttttcttctccccaaaggcgtttcgtgaggttctcctttcttgagaaagcggcccctcaaatatgagaaactcgttgggccctttcctattataagcgcatcttaacacgtggggggtgtgtcacaagtgcccctataaggctggtgggctttctccccattttctgcgtggcccctcccaaggtgtatcttcgttcctgtggggggctttccctccgtggaagtggtttttcctatcttccaacccgcttgtggtttccaccgccgttgtgcgtgcccttatttctccccatcttttctccagttccaagaggaagagcgcccttttccacatctgccgagaagagaagtgtgggccatttatcttttcaaagagtttttcccaagatgttgttccccccccggtgtctgtgtgcgcgccccaaaaccagcggggtggctggtggggggatgtggatgtcccactccttttctgcccccttatatatggacattacctttgggcgtcgggaaggcttcttgcgcgtggcgcactctaccaagcattttgcct

SEQ ID NO: 566449 - DNA, 402 bp, Homo sapiens
tgccttggccgatgggtcgtacagccctctgcgtgcaatatacaactacgaggagttcagtacacggtgagtcagtgaattccacttatatccgagtgtgaatagttagaagctttggctgttcatgaaattgaaagctctattgtggatattccattattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtggaaacattctgattcagtttatccttccagaactgaaaacacactactaattctgtgcccatttcaa

SEQ ID NO: 566450 - DNA, 304 bp, Homo sapiens
tgttgtctagagatcccataggcgaagagtgtagggtgagtctgcactgtgagagctctgatagttgtggcttccatgtgtctggtgagagtgggcaaatgccaggcataaagaaggtggagagggtgggaatgggtgatcatgtgtgattgccaacttgtggaggtcagcattgagctggcagtggaaaggggtggtggtggtgacaccagtcatggtggctgagacgtgtgtggttcagatccccgtaggtttggtgtggtcagcttcagagtgcggaagcagatatcatagattggcctcg

SEQ ID NO: 566451 - DNA, 423 bp, Homo sapiens
tcgaggtggctcaaaatataaaactatacgacatttatttctggaataaaccatttaatattttcagaccatagttgaccttgggtacctggaaatgtggaaagtgaaaccatggatggggagggggactactatattctcatccagcaattgagctcctttgtattcaaatgaattgaaaatctatgtccacataaaatactgcacacagatatttataatagctttatttatcattacgacaacttggaagcaaccaagatatttttttagtaggtgaatgaataaactgtggtacatccaatggagtattaagcactaaaaagaaataagctattaaaccatgaaaaagacatggaggaagcttacatgaacgttactaggtgaaagaaaccaatatgaaaaagccgcatactttataat

SEQ ID NO: 566452 - DNA, 336 bp, Homo sapiens
ctggcctccttccctgtagtcctgccgcctcacctgggcctccaacactttcttcttcctcctcttcatcttcctcctcctcttcgttttcttcttcatcttcctcctcttctccttctccacctcctctctccagcaatatcatctgttgttacctctgagtgataatcttggaggcttctctcccccatgatatcttacaaaccagtgcaggcaattcacagcacatgaatgtcttgaaaccccagggcacagcagcccccagtctgcttgctgcacaccaggcatgttgtttgttccagggcacagtgcaggcggggcatcctctcacagtct

SEQ ID NO: 566453 - DNA, 346 bp, Homo sapiens
  misc_feature (119)..(119): n is a, c, g, or t
  misc_feature (139)..(139): n is a, c, g, or t
  misc_feature (150)..(150): n is a, c, g, or t
  misc_feature (152)..(152): n is a, c, g, or t
  misc_feature (178)..(178): n is a, c, g, or t
  misc_feature (220)..(220): n is a, c, g, or t
ggtggtgtgttcacatacagtgacccttggccaccaagaccacagaggatggagcctgggaagcagcgaggaaatcacagccccctcgcccctgcctcccttgcccctaccccggcganatgttccccccgaccgctcncttgggccaantntagatgaagcacgttctgccggagangcctcaccttccagagaggacagacacagatttcctgctggnggagggaggagtccacgcatcctgatgctgcctggaagcttattttccccgtggccaaggatgcatttctctgaagtggaaacaggttcttgcatgtggaatgtgtgtttccccaggcaagacggg

SEQ ID NO: 566454 - DNA, 203 bp, Homo sapiens
atgtgggagtccgaagtcgcccaggacaaacattgccagccagatgccagtcacaggagctgaaaactcactatcttcatcctgtgcaacttctactgaccatgccatacccagctggccctgcccatcaacagactctaacttacagacatagggccagctgctcttgctcatgaaaggggcatgaatccgaggattgctca

SEQ ID NO: 566455 - DNA, 711 bp, Homo sapiens
  misc_feature (513)..(513): n is a, c, g, or t
  misc_feature (534)..(534): n is a, c, g, or t
cccgatgggcttccatttgcgcattgtccacgggtcacccaatcttgaggctgttgcactgctcatcagtaagcgtccgaagggtcacaccaatgggggcaattttccccgctttttcatccgggcaccccggtagtgactagattcacagcctcctcctaaaggtgaacccgcacttctatcgcacttcggcaccgctaatacccgggtcatcacaactactgtttgccccgatagtccctgttaggaagacttcgttcacccccccggtaaagaagcctcagcagttttcttctatgtcatgttccctctcgctccattcaagggcaattcacagttatttcctgagcatgctgactaaacatacttcaaacacagcagaaggtaaagagtctgtgtttcgtaagtaaatgccgatttcttgccaacagcagaatgcgatggtaccatgaagagtaccttgagcatcatcttcaactgagctccagctctggcaaacagctgctgggtggncctggccttctggcctggatngggcctccaaggaactacttgttctcatacttgtgcttgatgtgtttccacagcttcccctcgttgatgtggtcgtagatagcgtccgcgccttgatcgaaggcgcgctcgaagaacatgacgccacacgatgatggtgagggcgaaggtggaggtcctgcggaacaggcagggagt

SEQ ID NO: 566456 - DNA, 1646 bp, Homo sapiens
  misc_feature (572)..(572): n is a, c, g, or t
cggacgcgtgggttggagaacgacgtgcagaaatgggcacctcgaaaggggaaggaagaagaaggaatgaaaagagtcatcgagaccatcggacctcaggatgagctgaaggagacgaatggtaattcggatggtctgctcaatatcattgtgctagtcctatcaactgatcatcttgtaggtccgattgtcatggtgactcgttacttggacaaggaaagccgatctgccgcagtgacatggctagggatggactggctaagaggcagagccgacgactcgaagtcctgcaccatgagtgcctgctaatgtcggactcgaccgcaggaatgtgcgccgcagcgaggctgacgatggtacgcatggggatatgcaccggaccgtatcaacatcaaatctctctgggaccgaacagcgtacggacagatatggcacgcacaatatccctcgtggatactctgaggaggcccctagattcgcgctcgctacacggaggcctctttggccccgtctctgaggtcaatgacagaatcagggccgggaagttgacgggaatgtcgagccctctgcantaccccgctcgtgttaaccagccaacgtcggcagaggaagcggggcgtgtcgagcacagctgagagtcggcccgttccctgcgagaagcgaggcaattgcctccaagaatctatataccttgttgccaaataagattggaccgtttccatgttagagacctaggtaaggccaggatccatagggagatacacacgcaaggggggtgcgcgagagctgaattgacaaaagagagaaaaagaacacccacgccggaggggggtggcaccccgaaaggagcaagagccgcgggcaaaacgccacaagggcatttgcctgtgtgccccaagaaccggggtgcgcccccgacaagatgggggaagctcggggacccgataaaggtgaaaaaaggccaggagagtggccacgcaagttgatccacagacaacggctctggggaacagcggggcgtaaccaacgggggtaaacacgtggggcgaaccacctatggggagaaaagggcaaaccaccttatacatgtccgtcgcggcggggggcaacccacaacacactgggggatgtcagacacactccccctagcagcgagcagattttacaagagccccgactaggcggacgtataacttgaaaaagcttctaagaaaggcgggagcacacacaggcggctgctgaaacaagtcaagaggcgacaaacaataattctagcccacacgcgaagaaaattgtgggtcttcaccacgcaaactacaactacaatcgggccaaactctaactaaacagagcagacgcgacgagaaagccacaacaacacgcgacgcaccaacgagctagcaaaaaggaggcaaacacagagaaggaataaaacaagcggacgcggacgcaaccacacgaaagacagcgacaaggccaaacgaagacgagccggagaagagagacacacgaccaaacagacacaagatcaacacaacagaacgagagagaagctagaaacaagacaacaagaaacagcacacgacggacagaagagaggccacgaacacaactcaccaagagacgcacaagcaaagcgcgaacgg

SEQ ID NO: 566457 - DNA, 720 bp, Homo sapiens
atcaataggacatagtggaagctggtatacgaggctcatgcactgattaccactattctgaggctacacccttaaaccaaactacgcaaaatccatttaactatcatatcatcggcgtaaatctagactttcttcccacaacacgtttactacggcctatccggaatgccgccgagcgtgtactcggacttacgcccgatgcatacaccgagcatgaaaccatccgtagtcatgctgtaggctcattcattatctctaaacagcagtaatattaagtaactttgcatgatttgacgaagccttcgcgttcgaagcgaaaagtcctaagtagtacgaagaaccctcacatagaacctggagtgacctagtatggatggaccgccaacgaaacctaccagacattacgaagaagcccgtattaccataacacacgtcgttagaaactaagaagagccgggcaagggaacttccgaaaacgcccgcccaagatgcctgggtatatccaaaggcaggaaacgacgccacaatggagcaccttcaccaatggagcagtttatggtccaagagcaaatacggataccataacgacaccgcggccgagccacgggcctcagtagaaagtgatatgccccataccgaaggggtcccccacatggtcgtaggatacgcatgaataccgcacgacttattgtttgggttaccccaaaggggggtactacc

SEQ ID NO: 566458 - DNA, 102 bp, Homo sapiens
tctagaggatccctcggtcgcgaatcaggtagagggaacagcaattgcaaaggccctgagggaggagatcatctgtagaaatcacccagtaaagtggcttgc

SEQ ID NO: 566459 - DNA, 754 bp, Homo sapiens
gaaagaagtcggctctgggctccagtgagggaatcagcacacatacctcagaatcgtcggagtctaagtccgtagatttcatcaaaacaaattgcctgaggtggaagatgtagtgatgatgaatgtcagatccagttgctgaaatgggggcttatgtagagcttgctggaatacgaatcaatagttgacggcatgattacttcttagtgaattattcagaaggcgtatccgtctatcaacaaagctcatccgtagattggcaggaatgagtgtgtgagattgtcgattaggggtggatacagacaaaggatatatggatgctggcaaaaagaagagttgctcacagtaggaagcccaaatcaaatgtgaagaccaaaattcaaaatcatgccacataagctgtgtaatggcatgcttcgtcatgttgctgaggtgttagacatacactcaaggatgagcagctggacgagcgctattccaaagagagaactcgtcgtggggtcttgtgattgacaagtaacacgagagcctgagtataatgttggcctattgatggataaaagccatgaagtcctcgagaacgcatctatcttgcattcgatttagattgtgccttgacaggattgaccggggaagtgtctcattctataatactaagagggggttgaaccccacaaggctgggcacgattcgaggcagatttgaaggggtgctgttgtatgaggcttcgtgtgaacgcgctacgagtttgatg

SEQ ID NO: 566460 - DNA, 237 bp, Homo sapiens
cgtggcctagtcggatgtggaaggaaggaaggaagcagcagtccctcagggcctccagagaagggaggacagagaaagtctgtgtggtgtggcttcgtaaccctcactccgacggggccttcctggtccccatgtaggatgcggtggcagggccccactcaccatagaccaccaggcctcgcagggtcctcagctcttcagcatgagcatggtgctccacattccgtctgagccctg

SEQ ID NO: 566461 - DNA, 112 bp, Homo sapiens
ggttcctcccaccctagcatactggtagccacgcctctttcctgaacaccccgcccccctttttttcaagcattggccaagtaaagggaccagcagcatgtttagtagacgc

SEQ ID NO: 566462 - DNA, 305 bp, Homo sapiens
acatcatggccgagatttgcaatgccaatgtcccccaaattcgccaaagggttccccagatcctaaacatgcgaggaagccccctcaaaattgtcaggcatatcctcaaggagtatgcaaaaaacatcggggccggccggagcccggagttccgggagaacgaccaaaagcccatcctgggcttgctggagaacttctaaaggccccttggccctgcgcctcatggcctctctcagcttcccccccaggatcagtttttccccacctctgtgtggcttttggccaaattaaagctagttttggta

SEQ ID NO: 566463 - DNA, 229 bp, Homo sapiens
  misc_feature (6)..(6): n is a, c, g, or t
  misc_feature (153)..(153): n is a, c, g, or t
  misc_feature (181)..(181): n is a, c, g, or t
aacctnatgactctccatccccttgaaccaaacatctagcactcagctccagcatatttcaccattcaacccgaaattcacaaacgctacttgtcgacttgtaaccaatttactcagcaagtgctgactccttaacggatcatccccatcctncgctgcaaggtgactcactaaaatcatntgttaacaccaacattatttttacacccagtgtgtaagccagaagggc

SEQ ID NO: 566464 - DNA, 183 bp, Homo sapiens
aattaaaaaaaaaaaaaaattagccacatgtggtggcacgtgcttgtggtcccagctgcttgggagactgaggcaggaggattgcttgaccccaggagtttgagaccagtctgggcaacatggcaagaccccgtctctaccacaaaagaaaagaaaaagatggaaggggaaaagagaagagtt

SEQ ID NO: 566465 - DNA, 483 bp, Homo sapiens
  misc_feature (368)..(368): n is a, c, g, or t
ggagagaactagtctcgagtttttttggtttttttttgaaactttaaaatccctcaaaaactgttttttatacaagtgagtttggagtcacgagtgggcttatcggtaggattctctggtagcgagcgcgggccaccagggccctccaaaatttttgggacctcgcagcgacgagggctcagctaccagcagggtctccggtcatacgtggagtgaggagtgctcttgagatcctcccttctgggaagccctcattccacatatatttctcgtggataaatagcgccaccagggcgcttgtggaagcatgtgtgaccgtgacgcggatatagccatataaatctcgtggggcccaccgtgtagaccancacaacccctttttaacagcgcgacccaccgggatttgttcttaacacccaggcaaaaatgtccggctctcccttttgtcccgaaaaaaaagccagaaaagcgtgggcgtctcac

SEQ ID NO: 566466 - DNA, 414 bp, Homo sapiens
aagaggggcagagggggggctaaaaaggaaagggggggtgaaaagaaaaggggggggacagttcagagggaggaagggagggcgagaagttcaagaaaaaagcgaaaaaagaagagaagagcgggcacagcaaaaagaaaaaggggtgagaggggatccggaggcatgtgaaagaaagaggggaacgcggcagaaagaaagggggtagagagggaagaagaaaaggtccttgcaatagagagagaaggtggggaagacgagagaagccaggctgggaaaagaaggctggagtgactgtctgggaatcaaagtcgctcgaagtctctatatgtctatcagtatctctctctctctctctctctctctctctctctctctctctctctctctctctctctctctctctgcgcgtgg

SEQ ID NO: 566467 - DNA, 383 bp, Homo sapiens
  misc_feature (336)..(336): n is a, c, g, or t
gaactggaatagcaggtttgtccccttccctgtcctactatcatacactcttaaaggatctctcagacagcctacaagacatagcaaaatccacccttactctccaatcccaaatagactccttagcagcagtaactctgcagaaccaccgtggcttagacctcctaaccgtcgaaaaaggtgggctatgcacctttttaggggaagattgtttttccaccaaccagtctggactagtacgagatgctgcctcgcgtttaaatgaaaagggttcttaaaattcaggacaatgtcttttcaggactttttaacaccaatctttgggagctggggctntgtgggtttttccctataggtggggcccctcattttccatcattttt

SEQ ID NO: 566468 - DNA, 801 bp, Homo sapiens
gagccaaataaaagctaaccaatcattgagccaaagcttgccttggactcatagactggtatttctttaaggaaaattgtttgttatatattgtgagctatacagagcaaaggctcttgaacgaatatcctagattatggagacactttttcccttcccttttctctggaaaaattaaagttcttttttactgtccactgagactggagttgctagatggctaagatcaatagcatcaacttagcagcgctccaacgtcctggggtcaagcgatcgtcctgcttcagcctcccaagcagctaggactacaggtgtgcaccacctttcctggctaattttctgtttattttgtgtcacgagatggaggagtctcacttatgtgtgccctaggctgagccttgtacttgtggtttcaaagtgatcctcctgtcttacctcccaaagtggttgagattacaggcatgagccactgtgcctggcaaaaaacattttaaatcccttgtctgggggtcaggcctctaaacatccctcagatttcagatagtactttcaagcctgtcgtaacatagcaggtttgcagtaatcttttagaatatagcttgtcaaattagagaatggtttgacccccacatgttctcagtaggagacagttattattttagaaacctaaggtagagatgtttcaaagtcaagggcctaagaaacagaacttggaaaaatggcggaactgttttaaaagctggaaattggacaaaatgtatagtaattaatgatgctaaccggtggaacaagttatttaga

SEQ ID NO: 566469 - DNA, 349 bp, Homo sapiens
  misc_feature (26)..(26): n is a, c, g, or t
  misc_feature (99)..(99): n is a, c, g, or t
  misc_feature (109)..(109): n is a, c, g, or t
  misc_feature (111)..(111): n is a, c, g, or t
  misc_feature (120)..(120): n is a, c, g, or t
  misc_feature (152)..(152): n is a, c, g, or t
  misc_feature (165)..(165): n is a, c, g, or t
  misc_feature (176)..(176): n is a, c, g, or t
  misc_feature (183)..(183): n is a, c, g, or t
  misc_feature (186)..(186): n is a, c, g, or t
  misc_feature (208)..(208): n is a, c, g, or t
  misc_feature (216)..(216): n is a, c, g, or t
  misc_feature (237)..(237): n is a, c, g, or t
  misc_feature (265)..(265): n is a, c, g, or t
  misc_feature (274)..(275): n is a, c, g, or t
  misc_feature (285)..(285): n is a, c, g, or t
  misc_feature (319)..(319): n is a, c, g, or t
agaggccatgcagagggggcgaaaanaaaagcgaagaagcgaagaggcggggagggccggcaggaaaccaggagaggaggagggggaaggggcgcaaanaaaaagcaananacggcaaanaaggaatacagcgcgctactgcagccattgcncgagcagccaaancaatgcccganagctggngangcaaccagggcacagggcaacncgcacaanaggacggcgaccccagaacancagcaagcggaagctagctggctcacanggcgggcgnnaatggcgcgngggggcaagcgcaaacaaagaacagggcgccagngcgcgtgcagctcaaaaacaaaacatgctc

SEQ ID NO: 566470 - DNA, 203 bp, Homo sapiens
cggcatgcggactgaagctgcctgccctctgaacgtggatgattctttgtaacagggggaaaaattatgattttcttatttcgctaggacctgtgaatgacaccctgatctctgctgcctggcgagcgctctctgcagagctgccaggcacatgctgtgtgcttcagcggtaggtgcttggcaccttcagtcttttcctgacg

SEQ ID NO: 566471 - DNA, 437 bp, Homo sapiens
  misc_feature (219)..(219): n is a, c, g, or t
gcgctcgggtagatggggcccacctcacacccactcttcacccccaaaatcacgctggggctgggactcaggactagggacgcatgtgtgtgttgaataggagccctaactgtcgttcttgctttcacacgcagcggataggacagagggatcgcggcaccatgtggagacggatgaggttgatggtgaggtggggtatctcgcctgcctctgaccttnagatcgagtcctccacagatagcatcaaagctggactggtcacatcatgggctcctcttcacacggccacaatcgatgtgtcctctcctctcggtgctggtccgtgtatgcacatgtttgggtacctaggagccgtcttgtcagagcggcagtctgtgaatgtgcatgctgagaattgctcttgtagcagttgccctgcccgttcttgcaggtgacct

SEQ ID NO: 566472 - DNA, 115 bp, Homo sapiens
gagagtctgcagctgtgggtgggcctggggcagggctggactctcagaacttgagtctctgaggggggtctctttttcaagagttttatgatcccacgaagcaaaagcacagatt

SEQ ID NO: 566473 - DNA, 575 bp, Homo sapiens
ggaggggcaaagttcccagtcgcagcgctgcagcaagcggatccagctgcacagcaagcaagctgccgcacctccccaacaaagcccttacacaagcatctccaaagtttggcattctgcccataggtcagtcagcacggaccaaagcaacagctcatcacagccctatcatcctatcaaacactgtggatcaaagtcaagctctaacgcaaactggttccaaacctctgtgctcccaccaacacttctttcagtaaggcaagcaagctcttctacatgcacagcatgcacagcatagttgaaccaagaagcgaaattgccgtcctaagacagcaaacagcatgcagggattgcaaagaatcattcgggccaagggcatacaacaaacaattctagcttggaaccaaaaacttcctttttcagatttcacccggcgcaaaccaggccatgggcggtcacccgtggattcacacccgagccacagccttggttggcgcagccgcaaaccccttcaacccatcctgttttctttccaatcctgctcctggggcacaactgtccctatgcaccacagg

SEQ ID NO: 566474 - DNA, 374 bp, Homo sapiens
  misc_feature (195)..(195): n is a, c, g, or t
  misc_feature (243)..(243): n is a, c, g, or t
  misc_feature (245)..(245): n is a, c, g, or t
  misc_feature (249)..(249): n is a, c, g, or t
  misc_feature (272)..(272): n is a, c, g, or t
  misc_feature (309)..(309): n is a, c, g, or t
  misc_feature (334)..(334): n is a, c, g, or t
aaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcanaacggtctgcccctgtacctctagaatagcctgagctgaggagtgcanangatntatccggagaatcccttctcttnataactcttaatctttcaagtaagtagcattattcanatgctatatgcttattttaactaancatcctatcttaacttcactattaacagtaatcttccttg

SEQ ID NO: 566475 - DNA, 893 bp, Homo sapiens
caccgtctaccagagattcaccaactcagcattggaactcctcccccaggttttaagtctgagttcacgaggaccagcagaatactggccatggtgcatcttctggttatgtctgtggcttttacaggacaacaaggatatgaacatgcatgagcagggtttctggacaggcttggaaactggatggaactactaggatatctgttaggctgtcgatagagcggcaacatcctcttctcagagtcgtggtattacccgttcactatcctcactctccgtaccctggcacgtggtaatagggcttactcagcctcctttcatggtagtgctctggtgctagctagttcgtgatatggttcaatagttcaggacaggataaaccagatacatgtaatcaggatgatggttgggtaccaggagatgataaagtacgagagtgggagtcaactactggtatgcagtaaattttggatgtatttcattgattttgtctcttgtagaaatagaagtattaccatgtaaacaatggggaaagggggatgttcaacaagttctgtggtgttatgtccagtgtatcttatggtattctattatttgaggctaaaagttgatgtgtgacaaaatacttatgtgttgtatgtcaggtaacatgcagatgtatatagccagtttgggaaaagtgatcatttacgtgtgggaatgttaaaaatacgtttaatttctaaacacctgtgaatggccctaagaagccttaagaatgaagggtgttgtactaatagaaaataagtacaagaaaattccagttcaaagtggtagtagtgatgaagttataactatagaagaatataatatcaattgggataaatatggaggggggggctcaacatttatcg

SEQ ID NO: 566476 - DNA, 842 bp, Homo sapiens
gtgggggcccctctgtccacttggccatttccccagcaacccagttgaacaggtcccaagttcagaggcgcactgtgacccccagttcggcctggtcctccaacaccaagcacagcagcctgggctgcctcccccatgaccaatgaggatgatacattcccagcagacagctccaacctggccgagtccaagctgggagatttcacagggacgccctgaattggggtctggcagcctccccatcccagggcgccccatactcgatgcccctggctgggacagtggctccaacccagccaatttgtcccaactgagcgccccaggatggaccacgcccacccatccaaagaggctcgaggctgtgccaccagagaccataccggtgagcccagcaacacaccaaggccacattgaagggaaggccctttcaaccttgtgcccaatgccccctggaccaagagctggctccaagaagcagggccaatcattggctgtctcctaggagaaccccatatcctgtaccctccttgggactgaaggggaaccccggggtgccccacacggccgccctgcgggtgaaccaaaccagcccacgaggtgccaaccaggtccttctgtccagtcaccagccaacccctgagatcccggccaaccatccaacccccagagtccattcgttttttggagggacacaatggactcagggcagcgcccggctgaccacagcacaacccacacgcacctgcctcaggactgcgacgaaaccggtggggctggttctgtaattgtgtgtgatgtgaaacccattcagaccggccaattaaagtgaccttttaccctga

SEQ ID NO: 566477 - DNA, 1234 bp, Homo sapiens
  misc_feature (71)..(71): n is a, c, g, or t
  misc_feature (79)..(79): n is a, c, g, or t
  misc_feature (87)..(87): n is a, c, g, or t
  misc_feature (92)..(92): n is a, c, g, or t
  misc_feature (116)..(116): n is a, c, g, or t
  misc_feature (136)..(137): n is a, c, g, or t
  misc_feature (172)..(172): n is a, c, g, or t
  misc_feature (177)..(177): n is a, c, g, or t
  misc_feature (678)..(678): n is a, c, g, or t
tcctacattaaactttttaaagggggtctcaaaattctggggacaaattttggggccaagtggttcccatnaaaaagtnctgatttnaaaantctaataatcttaaaagtgccacncgcaaaaaagaaaaccaagnngtggctccacaaaacattctccttttcctctcggnagggntttacgagtgcattgtgttatcatttaaccagctcttttactactaaccttaaatgtggccaattgtgaaacaaacagttcgtgagaccggttctttcccaccagtgtggtttaaaatggggggggcaggtataagggataatatccattatagccttctggaagcttcggggcagaacttggggtgaaccttgggccagctctccgagcaagccttctttgctccacgtgctttgtgatgaaaccccacacgcggaaactgtgggtcgtgtttctcaatattcccaaacaggcaaagggacccaaggggtggatacgctcgtgaaaacgttcttcaaacacacatggggcttgtgccaggacccattattcaccaatgggcacgcattcaccaagatttcaaaaatatatagggggccattctacccacagctatttaaaccaagaaccgggcagacaacaactccttttccctatacagtatcacacgaacaacctttngcttgcgcaatggtgagacgcctgtggtggggcaaaatcccaataaacagggggcgcataacgccggggccgctataatatgagcgcctggagaagggtactcagggggagtaaattcccccctgtagtagacaatttagaaaccgcccacggcttgcttacactcatgatgggacggacgatccattaatatcgggcgtgtgtcccaccaagccaaactcgtttgggcccacacaacagaaaaaatattctctttggacagaggaacacatttctttttgacacaattttggaagcgaccccaaaattggtggttccccccaggagaagaagaacgtcttcaacgactacaagaagccttcaaggggggcgacaaattcacagcacacgaatattacccttcccgcggtggttacaccggatttgactggtggacgcacaagggtgtgtaacacaccaaatcccggggtttttggtaacaacccacaggttcttcaactatcggcgcacaagggaaccatgttccaataaccccacaaattttggtaaacactcg

SEQ ID NO: 566478 - DNA, 366 bp, Homo sapiens
agctgccccttctgctattttgacatattttaagccaaccttctttctaaaattatcaaaccatcctttgccgacattaacttatccagctttagatccttcaccttcctttcgctttaagttgtcatgtaatgattttgctttttcttgaatcctattagaagctgtaggtaggcctttctaataacaaccctgtacccacataaaagctgtgttttcaatatgaagataaaaaggtattgtgcaaagcatgcagggttttcatgcctcctggcataggtgcagtgatagcttcatgaatttcctttttttttttttttttacagtgttccttaggctggatttagttatttttatataagcctt

SEQ ID NO: 566479 - DNA, 927 bp, Homo sapiens
gcgctgtggggatcctcctatcagaggtctaatggatttcacctatcatccgctctctgattcttttcagattcgaaaactctgacctagattcacccgcgtgaatgtgttaactttgtctcgcccgaacgctctattagctgggcgcaccccctcctcatagaagaactgcatgcccttatactatatggagatctcacgggtgatcatccgtacgcgccacaacagagtacctgttgcaatacaagagggcacgactataatcctatggtgacatgatatcctcctcattccatggacatatagggcatgcgtctaatggtcttcagttctgcgatatgaatctccttgcatgtgaaattttctttacccatttctatcatttttccatcccgttaaacataacattgggattgttttacaagtgaatcccccttcattgcttacataccgcgaaaaccttgtgagtctttactccttgtgagcgtcatttaattccccaccaggacagactgagtcatgcgaggttcagatggcaggcccgtagcactcggcccgtggaccctatccatgccatatatggtttggatacacctgtgagtcttagtggcgtacccttattccacccatatattgggtccgcatctttgatttgctacgaacttctttcgcaattgacttccatacgtcgacatcctgatgacaaaaacatatcttagctacaatacataatgcattcgaacgtggcgcaacagacagagagcttatttccaattacccatcactatgaattccccaagaaaatgtatcaatttagtttgacctaggacgtataagttacacacaatacagcgggtacattgatgttccaagaagattccgcctctttaaccctgattcgactggttgctagaagtgccctataaa

SEQ ID NO: 566480 - DNA, 244 bp, Homo sapiens
ggacactttaggtgatcgtctctctcttcctcgctcgaccctcaccctcatgccagctatgtttattaggtccttgcttgtatctaagttgcctgggcggaggaagtgggcaagctttatgaacctgacatcagtgggcacagggagatcgggagcctctcaaaaaacagaactcgctctccaagagctgcttcctgatgcttgagcctccccagctgttggagagtctccgtcgcacggggtc

SEQ ID NO: 566481 - DNA, 327 bp, Homo sapiens
tggtttgaaggaagatggttataaacgtccctggttctgccaggcttagaggggctttgaagcatgtgagaaggtgctcttttgttctgtcacggtgctatagacttggcagtcttggcccctgaaggctggatatcactgttcctccctagaagaccttagcctcttcagctgacctcaggccagcgcctctctggtgagaaggggggctgtaactagtcattggcctggtagagctttgcttggcatgtggaagtgaaaccatcagaagccactttcttgttgccttcttcttttgaacaggtcacgtctgggtggaagcgatgt

SEQ ID NO: 566482 - DNA, 395 bp, Homo sapiens
  misc_feature (52)..(52): n is a, c, g, or t
  misc_feature (54)..(54): n is a, c, g, or t
  misc_feature (80)..(80): n is a, c, g, or t
  misc_feature (145)..(145): n is a, c, g, or t
  misc_feature (193)..(193): n is a, c, g, or t
gggctgggcgcggtggctcatgcctgtaatcccagcactttgtggggggggngngggaaaaaaaaagggggggggggggncccccccccccccaaaaaaaaaaaaggggggggggttttttgggggaaaaaaagggccccccggnaaaaaaaaattttctcccaaaccccccccctttggaaaaaggagggtncaggaggtttcgaagaccagcctggccaacatggtgaaatcctgtctctactaaaaatacaaaaattagcctgggtgcctgtaatcccagctactcaggaggctgaggcaggagaatcgcttgaacctgggaggcggaggttgcagtgagccaagatcacgccactgcactccagcctgggcgacacagcaagactctctta

SEQ ID NO: 566483 - DNA, 395 bp, Homo sapiens
ctatataaagtatttttagtacagatggggtttcaccatgttggccaggcaggtttagaactcctgagcacaagtgatcgacccacctcacccttccaaagtgctgggattacaggcgtgagtcaccatgcccagcccaatggttgctttaaaaaaattaaagaagttaaaaggatattaaatggaaactttcgacttgaggtatcaagatgcgatagcagtgaaatcccaatgtgacgtggtaaccagcaatataaatcttcaaaaagagtgtaaattactttatgagatttaaaaacccttctttacgaggatgagagtcaaagactgagaatacattttgagaaaagaaggattttcggggtgagaactgctagacaatgagcctagtaccc

SEQ ID NO: 566484 - DNA, 1253 bp, Homo sapiens
atgcatcgatgttctcgatctgtcctccttcctttccctacctgattccttttgatggctcgctgtgtcggcattacgtgtggtgtgattgctgtctctctctctctccattgtttgatatctatctgtcagcgttttatccatcagtcctaaggcaagatgttcagatctgaggcacttgctgtatccctatactattgtgagttggtcttactctgtgtactgctttattgttcctgtgcatttctactagaatgcatattactatatatttttagtttacttctagttgtacttctagctagtggacgatgtactgacggctactcggcgtgttgtgatcccagcaacgttgttgctgcgaaaactcgcgtggcgccaccaaagtcgggttgcctccccttttccttgcgagacctcctcgcaaagacaacataggttagctaagtgagagttctgcgatgcgctgtgtgaacgcccgaagaatactactgctaaaattcagacttcgttagccccgtcaatatcgatccattgtcttagtagactttaaaattagagtctctattcgtcatgttatttgcgatcgaaggtattatactaccattttgagtctcgagcattacccctaaagtagggttcatgtacccttcaatgtgcctcttgtgtgcatccgttttccttaacgtagtaaatggttgtttgcacacgggactcaggaccaattgactccctccttgtgagggccacactttcgagttggttattacattccttgcgcaattcaaaagaccaaagtgccttaagtgtctctccataattgtgtcgttccatagacgctcggcaattttacggttttgggacaggggggtttttaaagtggaacaggggacaattgagttgttcccacaagtcctagaataccattggtttttttagcgcaaacaaggaattggaatttcctttggggacattgatttagcttcctttaaggcaggaaaattagcactttgggagcagcgggccagcggcacccacgcagttctggcaatttgcgaattttggctgcctctttggtaaagttaattaagcgtgcaatggcaataaactttgaaacagaaactcggcattcccatgcacccgcgactttgggaaggaatttaccaccagtctttggggctccttccgagtatactgtggcgtgacacttttcaacgccgaaacacacaaagagtttcttttcccaaaacaga

SEQ ID NO: 566485 - DNA, 862 bp, Homo sapiens
gctgaaaaccaaataagaagattctggctcaaactctcaggttaacagtcttccggcagaatggtgtgaagctcattcacagtgtttacacgcagagaccagtgatgacttatcattcaagcaggggacgaccggatccagattctgcgaacgtctggacttctgactgtgctgcagagggcagactgcaggacacgggagtgggatcttcccagcagtgtgtgtgagcgccctgcccagctgaggcaaaaagtactgttggccatagtaccgaacggggacggaaggccaaagccttatatgatttccgaggggacgactgaagatgaactttccttcaatggctggagactataattaacagagctggaatctgtagcatgagtgactggcctgacgtggagaactatagtggcgaaagctcgtggaactatgtgcccacaaatggctacaatacaggttcctacatgactcagtgacagcgagaacgcttgtcctgcgtagcactttggtcaacagcgaatctcacctttgaacctaatcaacctcatgactatcacgatacggctgaagtggcacctagttactgacatctacgattgagaaacaggaaactcatcataaaggctcgtccaacttagggtatgcaactagaaggaaacgtgttggccttggaatacctggcacggattaagactcagttgcccacgcaattattactcggtgagaggtatccgaatatgaggggccatatctacacgcaccatccatgggaaacaaacattggccagccctttggtgaaaaaatcacccatttggtatagcttacattggacttgtacttgcgacggtagaggaacaa

SEQ ID NO: 566486 - DNA, 337 bp, Homo sapiens
tgctgggtgactctagcaggatcttgcagctatcggttcaatgtagaacctttaacttcagcaaggtgtactacctgttactaaaagtaagaagtaagtaaagactgaagaacctcagcaggtggcggtggctcacgcttgtaatcccagcactttgggaggccgaggcgggcggatcacgaggtcaggagatcaagaccatcctggctaacatggtgaaaccccgtctctactaaaaatacaaaaaattagccggggcggtggtggtgggtgcctattgtcccagctactcgggaggcagaggcaggagaatggcatgaacccggggaggcagagg

SEQ ID NO: 566487 - DNA, 630 bp, Homo sapiens
tgtctgccaaagatgataatctacatctattaatcttcattactatttaaaaattgacattctactgtaaagaagagctgtctcttacctcccatttataaattattcgacttcacgataaactaaaaaatatttattctatgggtttctaatctattactgtcaatattataatgttgctcaaattgtcacagatttagctatttaaagatctttgggatttatgtccttgagacatgctagctacccattaatgagtacttccttaccttctggcaccacaagataatcttatagttgccctttcctagctctgaattcagccatttatccaaaaagatctagtttctttaagttaacaaatggcatacagaaactaagatttgggaacctaggtttgcattttatcattggttgtcactgcttctatgttttctcaggagacagggctaattgatataagtatgtatgctaattgtgcatactaacacatgtatatgtaattgtttatagcatctttctatgtgtgtacacataacaataaattcacattgatatttcattccaatcaatcaccacaggattcattctagagttcctctccttataagtaactctttctcaaaagaa

SEQ ID NO: 566488 - DNA, 793 bp, Homo sapiens
cattaaatattatactagtcatttagccatctcacttctaggaatacatagtatatcgctcacacctcatatcctctccatactatgtcctagaaggaataatactatcgttggttcataatagctactctcataatccctgcaacatccactccctcttagccaatattgtgcctattgccatactagtctttgccgcctgcgatacacatacggtgggcctaaccctacatatgtctcaatctccaactatcagtatggacctatgacttacagattaactataagcgtaaaactactccaatgctataacaatcgtaagtaccgtcgccgaatccaaattagtaattactatccacatgagcatgacatttccaaaaaaaagacactaactattgagagtcaagctacaaatcgacccagcagatcgtaattatgttattcattgccatacaatccctctacttattttttgtcacacctagatatcaagcaactaaactctatattacgcttgtgtccccaaacctttattaccttgcccaggaatcgccccgtaaactaacacccaacacgtggctaaatatctaactaccattgattccatactctccttcagaatcatggactaatgccaaagtccactgtgtatgcagagaaacagaatcaggaaaaaaaaactctacctcgtctgatagctaagtctcgctacaagatctccttaattagtaacatatacagacgactgaaaaatattcatatatcatatcttctgcgtaaactccctttgccc

SEQ ID NO: 566489 - DNA, 146 bp, Homo sapiens
gaggcagctacgggtgaggtacagctacgggtgaggtacagctacgggtgaggtcagtatgttagtggagggagtgcgcgaaaggagatgccagcgggtgttaagaaggatattgtcagaagagctctttgtctccatccacgggg

SEQ ID NO: 566490 - DNA, 415 bp, Homo sapiens
  misc_feature (107)..(108): n is a, c, g, or t
ctctatagaatcccctgtatgcgaacacccctctttttacagatatgtaaaacaccacaattttcctatacattttttttccattaattttagagaaaaaaagccgnnttttttttttttttttttttttttttttttttttttttttttttcttttttttcttttttatttatttttttttttttttttgcggggccaaaaaaaaaactttttaaattaaaaaactttgaagaattttttttattcccccaaaaaaaaaagcttaaaaaaaaaaacccctaatttccctttttcccctttttttttttttttaaaagggaaccggaaaaaaaaatttccaaaacctttaaaaaaaaaattcaaagggtttttttgtttaccaccaaaaattttttttttacccacccccaaatt

SEQ ID NO: 566491 - DNA, 200 bp, Homo sapiens
cccttgagactgatagaatagaatagaatagaatagagcagaatggaactgacagaatagaatagaaaagaatagaatagaatagaatagaatacaatagaatagaatagaatagaatagaatagaatagagcagaatagcacagaatagaatagaatagaacacaacacaacagaacagaatagaatagaacagaacag

SEQ ID NO: 566492 - DNA, 577 bp, Homo sapiens
aaacggcaagatttgattattggcatgtcatgcattgagatcaatcctttgattgcaccacccatttaatggaactttcacaaaaatagcgtcggggaatcccacaacttatgtttccggcaatttgttaggggatttgacacccagaatcttctttattgggggggcagggaaacaaagatgctagtgaactggatgcgtttaaggacaaaaaacctgcctttacaatgaacaccgcaggtcccaggctagagagggtcggattaaaaacaaccggtctgcatacttcagacggaagataggagtatctttccgcattagttggccaatcagtgctatagagcaccgagggcaatgcacactacttagaatctacgatcttgtgaggagatagacttgttaccgaccgcagatgcgctacaagaagcttacatacacgaccctaaaaggttaccaggcctgatgaatgacctttagagctggcagttccaatgtgacgcacaaagaggccatagaggtcactactcgcactgtagaaggcaacatgagtgttcagccgaaactcttttgtaaaggg

SEQ ID NO: 566493 - DNA, 597 bp, Homo sapiens
attctatttaatatatttttttttcttttgtttttaaattaacacataaataaaccaaaaaaaccaaaaccaagacaaagaaccaaccaaacaaacaaaaacaaacccaggccggacaaaaaagccaacgcgcaacacaagcgcaagcacaggcccatccactacacaacctatagacacaagcatgccctcccacaattagaaccaagaacccccccgaacataagggcccaatttccccccaaccaacccaccgcccccccctcccgagaaaaaaaacacaaggccaaaaaaaagccggcccctgaccaaaacaaaggcataggccccccccgaaagaaaatccccgccacaaacaaaaagccaaaacactaaacaattgtccgcgccctgctaccaaccaaaacccccgccctaatatttccacggaaaacccccatcaaatacccccccgaggcaatacgccaaaaaaccctaacgaaatacttgcctcaaccccccccccctccaaaccacagcataactaacttgggaatcctctccctatataaaaatgcctcccccaatccagcgctaatccttcccctaacaacaccc

SEQ ID NO: 566494 - DNA, 666 bp, Homo sapiens
tgaatgctgctgggctcggctttgtcctggcacagccgctgagcagcgccaggaggccaaggctgaaaataaatgtcgaggtgcgaccgcccatgcaggctccttttgcgtgatgccgacgttcaagtgtgtatgcgactgtgagcttagatcagggttccttatctgcatggaggatcccatactccaatggttcccatgctgactaaatacacatgcttaaaaccctcgcggtggccaattaccgctcgatcaacaaattggtggtgcccctggaccggctgaacctggtgacagggcccaatggcagcggcaagtccaacctgtatcgcgccctgcgcctgctggccgaaactgcccagggtggggtgatcaatgcgctggcccgcgaaggcgggctggattccacattctgggccgggccggaaaacatcagccggcgcatgcgcaatggcgaagtaccggtggaggccgtggtcgcccaaggcgtcaaacgcttgcgcctgggctttgccggggaggacttcagctacgccatctccctgggcatgcccatcccggttcccggcagcgagttcaaactggacccggagattaaaaaggaatgtatctgggccggccctctctatcgcccggccagcctgctggttcagcgctcgggaacga

SEQ ID NO: 566495 - DNA, 1014 bp, Homo sapiens
  misc_feature (1014)..(1014): n is a, c, g, or t
cgtgtatttgggtccttgttatgggcgctggtttgtattgggctgaaccgatctgttttggggctcgtggtttttggtatcctcttttgtatgcatgtgcctggtgtatccctggtttctcggggacttttcccccggggaagtgttttcgcgtccgatccccagtcgtcgttccccgggtcttgtctccgggctgtaggatgtcgctcaggtcgatgggccgggaacggtgattaggccttgtcgtcgaactggatatgtgcgttggaggtccgctgttgttctttggccctgtcgccgttgagtgccttgccggtggggctccgtgtgatgggtgcttgtcctgctgagtatagccctgtgaggatgtaggactgttaagcaaagtagaataattagtaagccactgtgttctgataggaccctgggattgacgaggtttactgtcgtcacgtttgtttagatcatgagttccgaggactaatctatcctagttttcggtttcttgttaagatgccctggaattcgtgtgcactctagcttgggcgagtggcgtcaggatccctgttcttgagatcatggtggaatggtatatataagtccaggtcactaatagttttcttctagcatactaatgagatgtggcgatcaaggggatagtgaagtttaccaactgggtgatgctcagtcaacatagactatcatggcacaggatatcacgtatatccggtccaggcgctcagatgagctgtggcatatccactatgtgatagaaatggggtctcgaatttatttggaagggatcaatagactactggtgagatacatggataaagaatagatgtgaggcgacagatgcaacgaaccatcatagctgataatattatatttctgagtgaccagacgaaagagaacggagtagtaaggatgattcttctttggccatcatttggtacagtctcagttccaagtcatgtatatgtttaccctcctgacagataactctcgtggggn

SEQ ID NO: 566496 - DNA, 646 bp, Homo sapiens
aggcctgtaccgcccggagtacgggatctgtcaccagcctgcgattcgctgctctccgacctcaggccgctgttcatccggcctggatgaggggtgcgctggatgacgtgttagggcctgttcgattgtgatcactatattatcaacatcatgggaaacgcctcttcatcctcaactgtccagtgccgcctgaaggaaaagtggctgtgatcctgaccccggaggaggtccagcatgcgtgtcgataggagaaactgcagccagttactatggcacgttgcgaagatattcaggagaccgtcgttgccttgtatatccagagaacagttgatagatggtatggaaaaaggtacagaattgtcacgcatgatcctttgggattgggacttaaaacaatggtatgagcctcattatcaagaattctggaggtggaaatggagttgatcttttcagtgctaaatgaggctcgcaatatggtgtcagatcttctgactgatccaagccttccaccacgagtcatttcctctctacggagtattagtagcttaatgggtgctttctcaggttcctgtaggcccaagattaatcctctcacagcatttcctggatattacccctgttctgaaatagaggaccagctgagaca

SEQ ID NO: 566497 - DNA, 421 bp, Homo sapiens
ctaaaaatgcactgttacttacagtttgtttcctgcagtaaagaaaaattcttcatttgtgcagtttgaacaaaggggaaatcatcttcatagtaatgagacgttgtgaagtgttcctgcatctgtcattgttagggggactacttttctccagggatgctttgcacccttttgactaatttctataatttatgattcagaatttgtaactgtttgcagacactataggaaggtgggtattagactgtgatagacaacagttcctcctctgaccactcctgggtactggcagtttataagtgcaagtagcattttatcacctgtcacatcattgcggttcatttgggactgaagcgtaagtgaccgattctgagccttgagtagagatgtagtgggacctctgttgaactctccgccaggc

SEQ ID NO: 566498 - DNA, 230 bp, Homo sapiens
agggaaaatggcaaaaaccccttcccaaggttttgtattgaaaaacaattaggaatcattgcaaatttttttttattttggtccccccccccccccggggaaaattgggggggactttttttttttttttttttaaaaaggggaagattttaggttgtcctaaattttgctgtccccccttccaggaaagggacattgtaaatgaataaaacattttcaactccttttga

SEQ ID NO: 566499 - DNA, 1022 bp, Homo sapiens
  misc_feature (300)..(300): n is a, c, g, or t
ggcctacctgcggtggttgttgctacctgcggatgcctagtagactacggtagaactggccacttcccctctgaataggataattccgcatgatactattgaactcagcagcacatggaaatactatgttgctatctgtaaagaatgaaagaatgatataatgtgggatcaagttggtgtctattatatcacagacgctccttttgacactacgaaatcacaagtctaattttggacttactatgatcacgcttccacggcgcaatcggcgggtattgggtagttgctacctacacatgngtttacttgtacatccagattatcctctatgtgacgaaaaatgtgcacccagtactaggttgactcgaaccactactcggatgaagctcccttaacctactaacgaactgagagaggataggaccatctactgctccaattataaacagctcttacccgccagttatcgtgagatagtagtctaggcgcttataacattatgagcacatgtccagagttatatgttatcactctccctgcgatcttaaatcccatagtcagcaatcacgcatatacccagggacaagcgtattcgagattgcctatgcctgactgagatgttgcaaaactagtatagccagttaagcggaagtttttttatacggaccatccacgtgttttttgacaagaaatgttccggaatccgaaatctcctgacctgtactctgtttttacctcttgtttcttcctgttaaggggtgtcttcgttcaatatagacgttccctggcctattgattgaacttctttctggccattcttggtgaagggtccaggacacaatgttttcggtgcacccgaactgtgtcttacaactccgttttgaatgtaaaaacctcggagtgtatcccttataaacaacggttacagggagggacatacagataaaaggggcacaattctgatagaatggagcccactacaaaaaaagatgccacataaacgacacgcactacattacgca

SEQ ID NO: 566500 - DNA, 911 bp, Homo sapiens
  misc_feature (738)..(738): n is a, c, g, or t
  misc_feature (817)..(817): n is a, c, g, or t
  misc_feature (904)..(904): n is a, c, g, or t
aaaaaaaaaaaaaaaacaataatgagctctgaaattaaatcagtaataaataacctaccaactaaaaaagcacaggaccaaatgaattcacagccaaattctaccagatgtacaaagaagagctggtagcatccttactgaaactatcccaaaaagctgagaaggagggactcctccccaactcattctatgaggcaagcaacatatttataccaaaacctggcagagctcacaaaaaaagaaaacatcagactaatattcttgatgaacattgatgccaaatttctaaactaaatagtgagaaaccaaattcagcagcacataaaaaagctaatccaccgtgatcaaataggctttctccctgggatgcaagtttggttctacatatgcaaatcaataaatgtgattcatcatacaaacagaaataaagataaaaatcacctgattatctcaatagatgcaggaaagtcttttgataaaactcaacatcgcttcatgttaaaaatgctcaataaactaagtattgaagcaacgtacctcaaaataataagagccatctgtgaaaaatccagagccgatatcatactgaatgggcaaaagctggaagcatatcccttgaaaaccagcagatggcaaggatgccctctctcaacactcctatttagcatagtagtggaagtcctggacagagcaatcaggcaagagaaagaaataaagggcatccaaataggatgaganggagtcaaactatccctggttgcagacagcatgattttatatctaggaaaacccccatacacgtcccaaagcttcttgngctgataaaaaaaaacttttacgaagttcagaatccaaatcaccttaaaaaatctttacattctatttcccaacaccggtcaactgngagtcaa

SEQ ID NO: 566501 - DNA, 125 bp, Homo sapiens
aaaataaccgtggatgcctgcaccattcccgtaagcacacaggggttaaagctgtgtgtccctcccagtgggtgtggctgtgacagtgacagcgacacgcacagtaaagaggcgattgaatgcga

SEQ ID NO: 566502 - DNA, 308 bp, Homo sapiens
acctgatctaaatgttaaaggggtggttctctaccttttttttccacatcatgacatccatagaaatagtatttgtacagcacactgggataaattaaaggggatttggaggcagctaattacatggggcttggtgaaaaaaattgtttctttatattacttacttttaatgagaaaaataaacatattaaggatgacactaaatattgaatttgtatacatttccaaacaaagatgtctaaaaatttaatgaaaaacctgagattgcttctgtaaacataacattttttatacagggttttatgatt

SEQ ID NO: 566503 - DNA, 371 bp, Homo sapiens
  misc_feature (162)..(162): n is a, c, g, or t
tttgagacatagtctcactctatcacccaggctgaaatgcagtggcgtgatcaggctgaaatgcagtggcgtgatctcggctgactgcaacctccacctcccaggttcaagcaattctcgtgcctcagcctcccaagtagctgggattacaggcgccacagncatgcccagctaattttagtacttttggtagagatcgggtttcgccatgttggctaggctggtctccaactcctgggcgtcaagtgatccacctgcctctacctcccaaattgctgggattatagatgggagccccaagcctgggtcttatgtaccttttgacaagaaagtaattttaaaagcagtcggacacagtgggtaaatatttc

SEQ ID NO: 566504 - DNA, 214 bp, Homo sapiens
  misc_feature (39)..(39): n is a, c, g, or t
  misc_feature (57)..(57): n is a, c, g, or t
  misc_feature (64)..(64): n is a, c, g, or t
  misc_feature (72)..(73): n is a, c, g, or t
  misc_feature (75)..(76): n is a, c, g, or t
  misc_feature (160)..(160): n is a, c, g, or t
  misc_feature (198)..(198): n is a, c, g, or t
  misc_feature (208)..(208): n is a, c, g, or t
cttgaacttgccagatgcaaataccacagactccaaganaacccgagttggggtttnccttgtnttgatttnntnnttttaaagcgggtaaaagagaaaacactgaaaattgaattcttatcttccagagggtacaattattataatggacaatactttnacctttgcctctaaagatcagattagttttatttgttnacttacgggntttgat

SEQ ID NO: 566505 - DNA, 217 bp, Homo sapiens
cacgcgtccgccatggggctctccttccgctctcaagatccccccagcctgacgggccgtttaccatcccctctgccctgcagagtcagccgacaaggttggacctcagcttcggagccacctctggatgaacgccccagccctcgccccattaaagacccggaagcctgaaaaaaaaaacaacacaagggcggggtaaatttccctgaggggccaa

SEQ ID NO: 566506 - DNA, 576 bp, Homo sapiens
ctgctggttgactctatgagcatccccctttgtcttggaatggtgacggtttgctatcagacaactgctgcagtcgtcctagacactggttgagtgctcgcgtggtgccagtgctgcggtggttcgtggagccggatatattcacaggatctgtgtcatgttctgaccgagtatccagcagttttgctgaggcttgcgcctgtgttgttctggagctggagggatagtttgcatcagttggtggtgtgccatagcctgttacactcacagctgccatagctgctgatgttctggcccctgctaggttcacagctggggctgtgtgagtgcgagggtcggacaggttcacaggcgaaggtgccagcgctgtcctgggtctggccaagtgcatggccgttgctgcaggtggcgttcgagagtcacccatgttcactgctgttggaatggcaggtgtcctggcgctgtctacgttcatggctgccgcagaggcttgtggaatcctggtgtctaggttggctgctgttgcggttctgaaactcatgagaggcaccggtgcttgaacctggtacattcttg

SEQ ID NO: 566507 - DNA, 396 bp, Homo sapiens
ccggttagttccaaccctgcccaggaaaaagggcccgtgggggtttgcctgggcccgtcccacaaagggtgttaagtgttttggaatcagcagcccttcccattccaatcccaggcaggttgggtggaccatcaggttttttagccactttggattcgttgggttcaaaagaatattttgcctccacatatgtacccattctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaa

SEQ ID NO: 566508 - DNA, 502 bp, Homo sapiens
cacgaggacaccgccacaccgagttcatcaaattcctcaacacaatcgaccgcgaagttccccaggggttacaggtccacctgatcttggacaattacgcaacccacaagcacgtcgaggtcacgaactggatgaagcggcacaagcggtttcatttccatttcaccccgacctcatcgtcatggctcaaccaggtcgaacggtggttccgcgacctgaccgacaagaacctacgccgcggtatcttcggcagtgtgcccgagttgatcgccagcatcgagtcatacctcaacgcccacaacgccgatcccaagccctacgtgtggacggccaccgccgaatccatcctcgccaaagttcgccgcgcacgcaccaaactccaacaagtagtcaaccaaaactgagacacaccactagcgctaagggaacgagcggactgccagcgctcgcgtcagacgggcggccctcggttggtgccgggcttcaggatcaacagatcgtc

SEQ ID NO: 566509 - DNA, 444 bp, Homo sapiens
  misc_feature (444)..(444): n is a, c, g, or t
agtgattataaatttgattttcatgaagtcaatgcaggtataaggacaagaccaaataacatcaagatttaactagataacaagccacaaacaattgttaaaggccaactcttgacttaattttatatcctatattattgtgtccagttttcttttgtgtgcaataaaatgcaaatttctctcagcacatttatccaacatgactttataatactgaaatatggggataaaaggatctttcttttttatgcacagacactttgcttttcaagttttgaagatactagtgttgctttccctttcattgaaatggaataggacatttgcaagtcaaaaatgatcacctgggagatgttggtcggtacgtttcagttaggaagaatatgttttcaagatttattgcacagcatggtgaccatagttgataattctattgcacatttn

SEQ ID NO: 566510 - DNA, 212 bp, Homo sapiens
aatctgagggtagcgggctgccacctaccttgcagcactggaggacaagcccatcgcccagtttcatgatgtcggccttgtgcacggccgtcactttcttgcgcacgttctcctgcgccagtttgaaggcatactcggcaatgcgcagggacttggccttggggctgatcttcaggctctccaacataccggcaaagtctcatgctcaaggc

SEQ ID NO: 566511 - DNA, 105 bp, Homo sapiens
ggccagcatcgaggacactgatagttgggaagagaagatgggttattttgccatatcatttagctggaagtgacactttcagagcaccctgcatcactagtttat

SEQ ID NO: 566512 - DNA, 154 bp, Homo sapiens
  misc_feature (7)..(7): n is a, c, g, or t
  misc_feature (41)..(41): n is a, c, g, or t
  misc_feature (62)..(62): n is a, c, g, or t
  misc_feature (82)..(82): n is a, c, g, or t
  misc_feature (128)..(128): n is a, c, g, or t
tgttcanctcatcacttgcacttttgttttaatgtatggantcagattagactgagaaaaanggatggtattttcttaaaantgtgccaccttagagccccccccctttttttttcttccttcactgncttaataaaatatgtgaaaaagtgga

SEQ ID NO: 566513 - DNA, 428 bp, Homo sapiens
gtgatactctgttacccgggcgacggaagttgcagtgaggcgagattgcaccattgcactccagcctgggcaataagagtgaaactctgtctcaaaaaaagaaaaaatgatataaagtatttatttgtgtttatattttatggatacgtgtctatgtttatagattgcctgtatggtaccaacttgacataaataaattagtactcataaattaagtaaataagcccaaacgcttttcaagttcacagggcattagtaatctgtggtaaatgaagatagtttaaaatttggggtaaaataaaatagaaacattttctgaatttaatttagatatttttctgggtctatttgttagacaggtttacactatctctgctatttttttaaggacctaaaactgattggacatagaaattgaggaaagaata

SEQ ID NO: 566514 - DNA, 178 bp, Homo sapiens
gctgacactccaggtggtagaagacggctacgagttctttgccatgttgcagctggtgacacttttctcagctcccaactgctgtggtgagtttgacaatgctggcgccctgatgagtgtggacgagaccctcatgtgctctttccagatcctcaagcccgccgacaagaacaagggg

SEQ ID NO: 566515 - DNA, 581 bp, Homo sapiens
ttcggcacgaggagagagagagagagagagagagagagagagagagagagagagagagagagagagagagagagagagagagagagagagagagagagagagagagagagagagagagagagagagagagagagagagagaagagtggaccgatgtgttgaaacagatatcgtaacgatgaaagggaaacgaacgaacagaagagagagagtacgggcgcagaacttacacacagtgatgcaagaattagccaacaaaaatagcgctccgttcgggaatggacaaaagatttaaacacaaggagggtaagagccaaggaactagggagtaatgagagtgaggcgggaaaggtggacataggccgagtaggaaacatgactagggaaggaagaaccctatgtaggaagcgggaattttggaaaacgagaattccaaaagtgggctatacaaagaaggctctgtagggagacacagggaagctgaaccatgctgggccactgctgaggggcagtgacatagaagggggttgggacgtatgcgaaggcagctggtaccactctctgggacaggggatcggacgc

SEQ ID NO: 566516 - DNA, 233 bp, Homo sapiens
atgaccatgacaactaattatttggacgtgcttacacaaggataatgagctgttacacgagcctccagaggggccatgggtgagacacacctgctgcaccgtctgctgctgctgctgctcacgctctgtggtcaagacactggtgcctggaccacatcatacgtgccctgtgcacagggccctgagctctggtgccaaagcctggagcaagcgttgcagtgcagagctctagg

SEQ ID NO: 566517 - DNA, 170 bp, Homo sapiens
gggggggggggggtttttttttttaaaaaaaaaaaacccctttttgggggggggaaacccccccccccccccccaaaagggggaaaaaatttgggttttttttgcccaaccccctttcccaggggaaggggggattttttttttcccccccaaaaaccccctggggttta

SEQ ID NO: 566518 - DNA, 175 bp, Homo sapiens
cacggcttcaaggaaaaggggaatgatgaatccgaaagaaattaggattccgatctgtgcaccatcaagcatcatctaaataggagtgtcttgagtaaagatgggggtatcaccatgaggcctgggctggtctcaaagtcctggattgtacgcaatctgcctgacttagcctctt

SEQ ID NO: 566519 - DNA, 362 bp, Homo sapiens
  misc_feature (362)..(362): n is a, c, g, or t
ggaagctggagttcaggacaaggaaagtgaaatgtgaaggagggatagataatttaaggatctgatagcgcctaggcagcaggtgttcaattccactagaacctttttaggaacctatggaatggaatgctctcagaactgtgtgcttaagtaccatatgcataactgcagaataacgttcaagagatatactaatgcaggatgtgtattgagcattagcaatgaggcagtgtatgtctgcactgatgcaccagcatgaagacactgtgagcctgcttgagactagtacatgcggcagtgtaggtagtgagcactgctatctcatgggatggaagaaggtttgtagagacatacaacgtgtn

SEQ ID NO: 566520 - DNA, 1694 bp, Homo sapiens
tggatgtaaatcttttttttatttattatatctatttttcactattatttgtgggaacctccactataattttggcataatatacacttcttacacaaaacattctatgcgcaaaaatgtcacaaaaatatggtctgggtaaacaccaacacaagtctggttattcttacacaaaaagagattttataaaacaacctatggcaattctcttaacagggcacgctatactctctctgtaaacacaggagacaaggtggaattctcttatttttatccacagagaatatctcttcctggctggccaacaaatatggcgctcaaagaagagcctggtggatctatctctatccccatttataagcgccctcttgtgtgagctcctatatccctcgtgggtctcgtagagtatatatatcgcggtatctctcatcttttatcacatcttattatgtgtgagaagactatctctcttgagcgccctgagtatcgcgaaatatatatctctctctcgtgagtatattatagagcaaccctctctaatacgcgtcgagtcgcgagaaaacgccggggaccatattatctctcatatatcacatcatgtgtgaaggagtaccatctattatagtgagtaaatttctcatctaaactctaatatactacaaacacagctcctttatggtgagaagagataatattgggtgacatcatctctctatgtcctctacacggtggttgcctcctcgagacgagtcgtatatctcccctcttatttctctcttttaccgcgagatttccccagcgagtctctctcttatttcgtcgcgtggcgcctctctcctcttatactcatcctctctgctatctactaatggtggttccccccaggtgaggcgcctcctcttagtaattttcgccgcgcagatgctcttcgtcttataccctcttctctacacactactataacttattatctattaccctattcacaagtagttggcctaatcaaccaggtcgaccctactacagccacataaaactctcttacttgttggcaccgtggtccgttgctcttactgccccacccacaacgtttttgatataaccactgatgggcgacaagcctctctggctcactaacttgtgggtacaccaccataatacacactgtaggcaccagaacacagttggtccacaccgcaacaatgatattccccacaatcatgcggcttgttggacacacactctaataaccattctctccccactacagtggtgcagtactcacacaaacccactcgtgggaccaaattaagaaaaaaaccagtggtgcgccttaccatccactacacaaacaagcttcctgagctcaaacacaccctgcccggtcacaccaaaggcttgctaactactcagcaaccacacttctcaactaaacacccactttagacctccagcgcatgcacagctacacaaattgtctcctctagaagcgcctcagacgaccagccttcattaagctaatcaaagaacacctcaacaaaaaattacaagaggcgaaaattgcggccccttatgaagctactctccacgaagacagcatcacactcgtccacacaacacaagtgtgcggcaccctaccaccgtgcgaaccccccccttagcagcagggtagtaaaccaaaaacacttatcaag

SEQ ID NO: 566521 - DNA, 975 bp, Homo sapiens
acttaacgcacagctggtaactccgcgacatgcacaggggtcaccccgggtcccagggagcacccacgtttgcgccctcatcttggccacaacctcctttttcggcatcaaggcccgtgtggtcccccccccacagtggtccccccgggggacagcttcctccccggggggccacctggtgaagcgccgccctctgtgtgtggggcgcctcccggagccgaccacaagggcgcaacgtggtgtttcctagcccgcaaggaggaccccttccttttttctctgtgcgccgaacatatggttgttgttgccccccaacagccgggcgtctggttttcggaggccgcaacacccctgctgccccccgccgggggctggaccgcctccacgccccgcagtgctgctcccccttttgggtgtggccgacaacccgcctggccgagcttctctccctcgccgccccccctcttttctttgttccccagcagcgggggggcaccccgcagacgggggagaggatgctagatggagggctccggtccccctcctcgggtgctgcgtcactcggcaggggtggccgacagacacacgaagggaggctctccctgcgtggagggaggtgtcccccactgggcgataatacgagaagaagatatgcactgtggtaaaaaatatatacccgcgtgggagacccctttcttccacctggtcccccccagaggcgcagagagagaatttttcgtgggcccggcgccccccgccgacggcaatgggtggccaacccaacgatatacaagcatgcaaccaccaagcaggccttttcgtgtgcacgaggacgcaccccccaccacgctccccccccgggggcccgcgcaaatttctccccgggagagcagcgcggggggcccaaaggtttttccccccccccccgggccggcgtggaaaaaaaaaggtttcccccccccggggggggtgtga

SEQ ID NO: 566522 - DNA, 160 bp, Homo sapiens
ggggtatgggacacatgggggtcattgtactctctacatttagtacatttggaaatttgcaaaattgagtttaaaaagactttaaacctaataaatactgaactaaaaagaaaaggttgataataaatgtagggtttccagtttttgcaagggtagaaag

SEQ ID NO: 566523 - DNA, 249 bp, Homo sapiens
ggtgacagggaaagactctgtctcaaaaaaaaaaaaaaaaaaaggtagggttaaatggactccggaattgtgggcggctttttgaacccagaaaggttaagggttaaaaaaaattttgcggcattaggataaggcctttaagcccttgttaaggtggggcggtttttcttggtggaaaggatgaaattttcccagcacttggtttagggaaaacccccagggccccttgtgataagcccccaaggcttc

SEQ ID NO: 566524 - DNA, 771 bp, Homo sapiens
taactgattaaataagatagatgaataatcaaaacatctggtgaggcatattccaaggaattctatttaaaaaaaacattttttgagagagaagttcgctctctgtggcccaggctcgagtaccgtgggatgatccatagcccatgggagtcggtcgatctctggggccttcaagctgaccctcctatggagtcgctgggccttaagaggagtgtagcacagaacacgaaaattttattataaagtggagggtagagaaattgggtcaagtaaagtggagggggaagtgagttaagaggaattttgaacttgatgtgtgtgatgggtttcaaaaggaggggggtcttgcgtctgtagcccaggcatgctggaagtagccagaaggctgcattcatgaatcacttacagccttggatctccctggagctcgaagtctatcctcaccagctcctgcactcccaaagtactgggattactagtgtgagcccactgactaatgatatggagcaacaatgtttcagcatgtcctgtggggttgagtacggacaaggatgaagagatgggcgaagggttgaggtctggacatagaatgatcaatgggctaggaggcaatgtacctaaggagtaggtaagaagggagtggttgggggctgtggtcggcaaaccgttagcgggacgttgggtgacaggatattatagtaaaacaacatctatgatacgtgaatgggccgatagggatggcaagggatttagacaggttgcctggatcgg

SEQ ID NO: 566525 - DNA, 222 bp, Homo sapiens
aatacggttttttcaaatttgagccatgatcaccttttcctattaagagcactggcatcgctctgttggtcacaatgacctctccaacttttcctatctcgtgacggagaacccctctcgcgattcagggtcaatccctcttctccaaacactgcaccaccagtagcaatagccatatctttaagctggttctttctattgtcaccaaaccctggagccttg

SEQ ID NO: 566526 - DNA, 706 bp, Homo sapiens
actcacaaacttcccgaaagtgggaaattctttccaaggggcctctttccaaaaagagcacaaaaaacagggggacaatcgagagcacccccagagagcaatagcagagaatgccacgaacggttaatcacctcagattacaaccttggggaaccacggaagaccaggtgaacacaactacgatgaacctaacgagacacacacacgaactcggactgggtctttgtgtaaccctgaattcttggaacatattgcattcattgactgttgggcacgttgtttgaaaacctagcacagaagctatgaaaaaaccttgacaacgactggtccgtctgctttaccggaaggccgctgaaacaggactaacgggatggtcgattttatttaaacgcgatccgccacaagtttcctgggttcacttgggtcgtgggttcaacggcttcattttccaaattcctggtggccacttcaaaaaatttcccacggaatagtgaacagacaattaaccattacggacagcctttttgtgtcccctttataattcaaggttccccctttgcgggcaacaagggcacggggttcccgtggaaagcgaactctcttggctttcattaaacaaactgtgttcgggcaagtccaaacggacgctttccacaaaccaaaggcaaacacacgttccaccaccattatttaaacggaacgggac

SEQ ID NO: 566527 - DNA, 122 bp, Homo sapiens
  misc_feature (29)..(29): n is a, c, g, or t
  misc_feature (85)..(86): n is a, c, g, or t
  misc_feature (89)..(89): n is a, c, g, or t
acaaaccattcttatttctaacttcaggngttgatgtttttcccagtccatcttaaaatattactgctttaatcacaggtccgannacnaggccaacatgcacaacctccacctagaatcct

SEQ ID NO: 566528 - DNA, 1250 bp, Homo sapiens
  misc_feature (1007)..(1007): n is a, c, g, or t
  misc_feature (1116)..(1116): n is a, c, g, or t
  misc_feature (1123)..(1123): n is a, c, g, or t
tccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaacgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagnagccctgcactccacgctggccaagaaggcttccacgcagaatgacaagactgcaaaaatccgatgtgcttccttccctggcgcagtcgctccttcgagccgctgcccncaaaaangctgaagccaatgccctgcccccacaaaagacgctggaacttgtatcttagacccaggggcagtgggatccctagaaatggctaccgtgacataagtgttcgggggctaaatggtttcagggaaacc

SEQ ID NO: 566529 - DNA, 111 bp, Homo sapiens
aggggttcccaacaacagctgatacggccaacgttcaggatccaacggtaacatcaacgtgcgggacgtggacatctgagtctacgactgttgtgcgtctacgaatggttg

SEQ ID NO: 566530 - DNA, 673 bp, Homo sapiens
  misc_feature (415)..(415): n is a, c, g, or t
  misc_feature (419)..(419): n is a, c, g, or t
ggggagaaagaacagaggttgtttgataagcaaagcataactgtatgccctgcgatgcaccgagaacaaactgccttttggctccaacagtttcatacagaaccaaggtctcagggcggtaccggaagcccaaacaaacgaaggaaatccttgggctggaacccggggggggttaacagggccaaccagagaaaaagtggttagtctctgtggaatccctgatctgtgcttcgtggttgccaccttgtccccaaggccacctttaaacttcactccttggactcatcctccagaaagtgtcccaaagacctgcagtggggagagctagaaccaggagagctgggctggctctggttgaaacctcgggaaatcacttaatttctgtgagcgtgtattctccgtcaaaaaaaaaatntttnaaaaaaaaaaaatgtgtggcccgttggcccaatcaactatagactagaaaagttaatccatgcgcccgaatttagagctcattggcaaaattcccctatatgggagtcgtatcacatccaggggcccgttttacaaagttttgacttgggaaaaccctggggttaccaacttaaaggccttgaggaacataccctttttccaattgggtaataacaaaagggccccaaccgatggcttttcaagttggcctggg

SEQ ID NO: 566531 - DNA, 114 bp, Homo sapiens
tccagctggagtgcgctgcagtgctgctgcaggaacttagtatgtcgcaggccaggcagtgagcagactcgatcttcttgaagaagagctcctgtgccagtcccttatgaaagg

SEQ ID NO: 566532 - DNA, 558 bp, Homo sapiens
gactaaaaataaaaaaaattggccaggcatggtggtttatgcctgtggtcccagctacatgagaggctgaggcgagaggatggcttgcacctgggaggtgaaggtcaaggctgtagtgagccatgatcatgtcactgcactccagcctgggcggcagagcaaaaaaaaaaaaaaaaaaaaaaaaaaaaacctgtgtgcgcggcgcgcgcgcccgcggcgcccccgaaaagagttttctaaacaacacaactccggtgtgggcgcgcgcgcgcgggcgcccagaggagggaaaagggagacaatgggggccaaaacggtgtggtcccatgaggaaaaccggggggccagagagaaaagagcgggaggggcatctctccacaccaatataaacaaacagcccggggggggacaaacccagagagcgggttcctagagaaaaacatccccaaagggagaggtccagagagggccataacggggggggctcatacaacaggggggagcgtcaaaggcgaaccccaaaaaactaaaattaacgcccccgccccgggggggagc

SEQ ID NO: 566533 - DNA, 441 bp, Homo sapiens
gatacacagagaattttgttttaaagaaaaaaattacagtcagcaacttaatgtaatagaagggctagggagtgtcacttagagataatatacatattccgtatttgtgacgccctgggttcatgcctaggacacaaagacaattggctgtctccatgggtatgaatcccctcctggtttagaatcagcagaggccaaaggctttatattccacctgcctgagataagcagctccttcctacaattaggaacccagatgccaccttctgaaagagtctttatttgtacatcgctgaattgcaaaccatcagtaactttttaatatggacaatcaaatttttacccacagaatgtctacaagaattatatttttaaaaaatacaaccagtttttatattttaaaaatatctgaactcaaataaattaatatcttaaaaagta

SEQ ID NO: 566534 - DNA, 541 bp, Homo sapiens
  misc_feature (460)..(460): n is a, c, g, or t
  misc_feature (469)..(469): n is a, c, g, or t
aaagagacacagagagaaagacagagacgaacagagagaaacagacagagagaaggccctagccagtagcaatacagtgccttttctttcattttctctttcttttcttttctttttttctttcttgtatatctgtatgcatggatgtatgtatgtatgtatgtatgtatgtatgtatgtatgtatgtgtgtatttatttatgtaccgtatttatctggagaccgggtctcactctgtcgcccaggctgtagtgcagtggtgcgatcttgggtcactgcagcctccgcctgccaggttcaagcaattcttccaccccagcctcccgagtagctggggttacaggtgcctgccccacggcgcctgactccatttcgtattttcagtagagacgggggtttcacacgttggccgggctggtctcgaactcctgacctcgggatgacagacgtgagccactgngttcagtgnacagtgccattcctagaatcactcctcacgggaacacacacttagaggtgacgtgtagagatttatttattt

SEQ ID NO: 566535 - DNA, 731 bp, Homo sapiens
  misc_feature (6)..(6): n is a, c, g, or t
  misc_feature (62)..(63): n is a, c, g, or t
  misc_feature (67)..(67): n is a, c, g, or t
  misc_feature (83)..(83): n is a, c, g, or t
  misc_feature (89)..(89): n is a, c, g, or t
  misc_feature (92)..(92): n is a, c, g, or t
  misc_feature (100)..(100): n is a, c, g, or t
  misc_feature (126)..(126): n is a, c, g, or t
  misc_feature (133)..(133): n is a, c, g, or t
  misc_feature (144)..(144): n is a, c, g, or t
  misc_feature (156)..(156): n is a, c, g, or t
  misc_feature (173)..(173): n is a, c, g, or t
  misc_feature (189)..(189): n is a, c, g, or t
  misc_feature (193)..(193): n is a, c, g, or t
  misc_feature (195)..(195): n is a, c, g, or t
  misc_feature (203)..(204): n is a, c, g, or t
  misc_feature (211)..(211): n is a, c, g, or t
  misc_feature (258)..(258): n is a, c, g, or t
  misc_feature (260)..(260): n is a, c, g, or t
  misc_feature (269)..(269): n is a, c, g, or t
  misc_feature (299)..(299): n is a, c, g, or t
  misc_feature (317)..(317): n is a, c, g, or t
  misc_feature (338)..(338): n is a, c, g, or t
  misc_feature (347)..(347): n is a, c, g, or t
  misc_feature (349)..(350): n is a, c, g, or t
  misc_feature (354)..(354): n is a, c, g, or t
  misc_feature (356)..(357): n is a, c, g, or t
  misc_feature (359)..(361): n is a, c, g, or t
  misc_feature (373)..(374): n is a, c, g, or t
  misc_feature (377)..(377): n is a, c, g, or t
  misc_feature (418)..(418): n is a, c, g, or t
  misc_feature (455)..(455): n is a, c, g, or t
  misc_feature (489)..(489): n is a, c, g, or t
  misc_feature (494)..(494): n is a, c, g, or t
  misc_feature (521)..(521): n is a, c, g, or t
  misc_feature (526)..(526): n is a, c, g, or t
  misc_feature (547)..(547): n is a, c, g, or t
  misc_feature (591)..(591): n is a, c, g, or t
  misc_feature (593)..(593): n is a, c, g, or t
  misc_feature (598)..(598): n is a, c, g, or t
  misc_feature (604)..(604): n is a, c, g, or t
  misc_feature (606)..(608): n is a, c, g, or t
  misc_feature (610)..(611): n is a, c, g, or t
  misc_feature (618)..(618): n is a, c, g, or t
  misc_feature (644)..(644): n is a, c, g, or t
  misc_feature (656)..(656): n is a, c, g, or t
  misc_feature (722)..(722): n is a, c, g, or t
taaaanagtaagaaaaaaaaatcatatttaagtccccgttaacactaagccatattaatcannatgngaaacaaaaaactcanccaganaancaaatctnagtcactaccttagtataaatattcnctaaganaatagtcaagnaacagaaatccnttgtgagacaccatctngagagaacagctgcantgcnanatataatnnattaacntagtagtttagtttctcaatatttagcaagtataaaaattaccattncnattggtttntagtgccattaatataaatccataatttcnaagtcatcattcctttcnctgtgaactaagacttcttanaagttagtngnngggngnngnnntgtaatgactgnngcngatgggcagtgttcaaagccaaaaagactggcaagcttggnaaggcatacactatacatacacacactctcagtatantactgttccccttatttttgctgtccattcttgnctganaagatggtataaattattcccttaganttgtnaatacaattaagatgaatacnttttcatcttcaaaattatccttctaaatagaaaagttcctcangnttgtnaaatcngnnnannagtgggntttaaatactttcttcacaacatgtncaatgttttcanccttactgcctcattacaatcagtttggcaataagacctccagtgctttatcaaaaatggcattcnatagattat

SEQ ID NO: 566536 - DNA, 427 bp, Homo sapiens
  misc_feature (31)..(31): n is a, c, g, or t
  misc_feature (39)..(39): n is a, c, g, or t
  misc_feature (42)..(42): n is a, c, g, or t
gtggcagagacacaaattaaacggaaccgcngctgtcanccngggcaatttccctaaagaggtgcctatctgtcctaaacagcaagaaacatttattgtaactcatggctatggtgccttcccagattttcgggaagtaaaaggcccatgattggtgtcccccaaggcacagaaatccttatttcggaggaaaagctacacacccagccagggtggctgagaaccctgccctgaagaacaaatccaactttccctcagccacacctcaaagaatatgaacataaacagagcctcactccctacatcccccagcgaaggccacagctcaaacctgcacagtcctgaggccctgcatgttctgcctgaccctgtgtttatgtattggccacgtgcagaaatcctgcaatcaatgagagatacatttgag

SEQ ID NO: 566537 - DNA, 1034 bp, Homo sapiens
atgacccaccaatcacatgcctatcatatagtaaaacccagtggacatgatccccctaatcaggggcccgtctcagacctcctaatgatgctccgggctagaccagtgtgatttcgagttctcactccataacgctcctcatactagtgcctactaatgcaacacactaactcatataccagtgatggcgcgagtgtacacatcgagagaagcacatactcgaaggtccaccagaacaccaccttgtgcaaaaaggccttcgtatacgggataagtcctattttattacctcagaaatttgtttgtcttcgcaggatgtcatctgagcctgtattacgcaacgtgccagacgcatagacaccccgtaatcgcactgcaaattgcagcgaccggggggagcttgggctcctccgcaaagtaaggactatgcaattctgcgactgtagaatacgacgcgtaccaaaggttcccaagactttcgcttgacaacagcagtccgcgatagtaaaactaccggcagtgcaacagcagataattcggaactcccacgccgttcgaagtccttgcgactgcaatatagacttcggtaatcgttacgcaagaaaaaacccaagtcctgggacataaagcccacacaggtaaaactctcccaaaatcgcaacgatgggcgtttgaatattagcaaataatgtgcaaaacccagggaggttcggtccttattaatgtaatgacacccggtgcccataggaaatgttccccttggaataaggctaaaacctagacagaatggctgcattcaccccttggcatacaccaactatgcgcggaaatcggggcgagaatacttgagccgagggttgcaattacacgtgtcttaacactgaattagcaccccatgcgagggggcgtatcccaaccgcggaaaccttttacaccggtatgcagcttaaacttcgggtccctccacggagttttggacgcggttcgaagcgtaaatcctgggcgttttcacgtaccacgttgcaaaacgcaac

SEQ ID NO: 566538 - DNA, 180 bp, Homo sapiens
tgacaagggtccgccatgaaaagtacatcaggttaaaagggtcgccccgaaacacacacgcaggtaaaatggtcccccgacacacacgcaggataaaaggctcccccgaaacacacgcaggtaaaaaggctcccccgaaacacacgcaggtgacaaggttcccccatgaaacaacacgca

SEQ ID NO: 566539 - DNA, 492 bp, Homo sapiens
cctaccggatgagtgcgacacctgcacttcactggctcttcctagggttttatcccctgtcgacttgagggcatttaacgcgcttttgtcatcttggaggaccttggcatccaacattattgagggggacggaagtctctccattggtagctatttctgaatttaggattattccatgtttctcgagcatttcctctctttgcttcagggcctccttgacttcagcaaactgaaattgcagtatactgtgggcgagcttttccctttcaaattctttgtttttctcttcgtactgccgcctagattcagccagctgttcttcaagctccagcagcatatcttctagggtatcaacctggtacatgaagtttgtcttttcattgtctagctgagcattggaaaccatagccttcttatatttctcttcaacttctgctagagagtccttgacttccctgatggatgccctcgtgtcgatggagatggaggcgt

SEQ ID NO: 566540 - DNA, 205 bp, Homo sapiens
cttatgacaggtgcaatgaagcacagtggctcaggcctcttatcccagcactttggcacggcaaggcaggaggcctgtttgaggccaggagttcgagactagcctagcctgggaaacatagtgagaccccatctgtacaacagaatttttttttactagccaggcatggtggtgtatgcctgtaatcccataacaccacacaatt

SEQ ID NO: 566541 - DNA, 411 bp, Homo sapiens
  misc_feature (64)..(64): n is a, c, g, or t
  misc_feature (79)..(79): n is a, c, g, or t
  misc_feature (122)..(122): n is a, c, g, or t
  misc_feature (159)..(159): n is a, c, g, or t
  misc_feature (173)..(173): n is a, c, g, or t
  misc_feature (214)..(214): n is a, c, g, or t
  misc_feature (218)..(218): n is a, c, g, or t
  misc_feature (257)..(257): n is a, c, g, or t
  misc_feature (308)..(308): n is a, c, g, or t
  misc_feature (312)..(312): n is a, c, g, or t
  misc_feature (389)..(389): n is a, c, g, or t
  misc_feature (395)..(395): n is a, c, g, or t
catttctaaatagacaaaaactaccctaaaatgtggagatttactccttttgaaaagctgtttnaaaaagtgtggcctnagctctggaggccacccccaggaaggagtttgaggttcattgncattatggccacagtttggtgcttgtgcacgggactnaaagggcagcgtcnaagctggggttaggtgtagggttgtgagcaaagctccctgnttgnggcccacctttcctttcaaaaaggctattaaatctactnacccactaattggggggaatgtaaaatttggccacagactttgcacccaanttangggctggggtcaatgcaccggactggatggtcaattaggacacccattcggaatgggccaagccttgcaatggtggnccgggngactgggctcccgagg

SEQ ID NO: 566542 - DNA, 352 bp, Homo sapiens
tcagtatgacatgaggtatgatacatttgtgttttctatttttcttgcgatggatcgctgttgtgcccagggtggagtgcaatggcgcaatcttggctcactgcaacctccgcctcccgggtcaagcaactctcctgggttcagcctcccaagtagctgggactacaggtgcgtgccaccgtgcccagctaatttttgtattttttgtagagacggggtttcacaatgattggccaggatgatctcgatctcttgacctcgtgatccgcctgcttcggcctcccaaagtgctgggattacaggtgtgagccactggtgcctggccttgaacactattctcatgtcaaacatt

SEQ ID NO: 566543 - DNA, 342 bp, Homo sapiens
  misc_feature (1)..(1): n is a, c, g, or t
  misc_feature (103)..(103): n is a, c, g, or t
  misc_feature (114)..(114): n is a, c, g, or t
ngactgtgcttgtcatttctttttcttctttacaggtttatactctaatcccttctactttcatatcatattggcatatgaagcctgtgttgctagtatcatnatatttttctngagctatttccttaggttctgttattttccctgtttatttgcctttatctgccttcagtacaacttctttgatttcttcttctatttgaggggtttggtctcccattccttatttaggagcagtgtattaaggcttgccgctagatgttgttagtttcaggtaccactacacactccaatctctttttacttcacttgtaggtactttgtcaatatacattgtccagt

SEQ ID NO: 566544 - DNA, 413 bp, Homo sapiens
  misc_feature (147)..(147): n is a, c, g, or t
  misc_feature (183)..(183): n is a, c, g, or t
  misc_feature (190)..(190): n is a, c, g, or t
  misc_feature (338)..(338): n is a, c, g, or t
  misc_feature (345)..(345): n is a, c, g, or t
accagctccccactgccctgagcggcgccggcctgctcggacgggaaaaaggaagaggagaaggaaattgtcccgaatccctgcagtctttctgtaggttgcagctcaacgccaggcaaaagaagaggaaggaatttaatccaagcnaggctaggtcgatttgagggtctgctgtagcaggtnggctccncttgaagcgagggaggaagtttcctccgatcagtagagattggaaagattgttgggagtggcacaccactaagggaaaagaagaaggggcgaactgcttgtcttgaaggaggtcaacccccaagaatcaagctcttgtggccttgaangttgctnaaagacggattcaccccttccacaaggctttgaagcccaagtccccaaaagcctttccttcccccaag

SEQ ID NO: 566545 - DNA, 235 bp, Homo sapiens
  misc_feature (176)..(176): n is a, c, g, or t
tcactcatcactgggaactggtcaggagcagttggtcagtacctggcctgctggccactatgtgacctcaggcaggggggtgtctgtggagcctccttgcctccatctgcagggaaagtgagttggggcaccctgtgagggtgcgctggaaagacgaaggtgagaacgcatgtgtngaatccagatacgtgcttggcaggacctacaagctttacaaagtgaccgtgtgttccac

SEQ ID NO: 566546 - DNA, 650 bp, Homo sapiens
ggaagcgtgtggtatcagatggagtaatggtcacaaggtccagtatccactcccaaagttcagacttgccaggctctctttctcttcttccccaggtccttccttctaggtctggtagtctgcaccatctgcttggttcggctcggctacgttagagagcccttgtgtgggagagcgaagggggtcaagaggaagacttgaagcacagagggctaaggaggtggggtcaacatttctctgagccagtctagggctgggacatgacaaattgaattgcaacgagtggactagacatgtgcgctaataggagaagaacccacagtgctaggggatagaggggctttcctaggggtcctgttaccctaaccccattttgtggtctacagccatgaagctcacccggcgtatgaacctatccttcccaagttgcgttctcatccctgtagctctgtctccctctccatatctccttgccctaaaactcccttcctccagacctccttactacccctgggcatcttctggccttgacttggatcgcgaaggagaacttaggaatgctacacacgcttggcatgtatgtcttgtgcttctttatctctgatttttaacacaaacagatactataatcaaatatccactacaaaagg

SEQ ID NO: 566547 - DNA, 954 bp, Homo sapiens
  misc_feature (719)..(719): n is a, c, g, or t
ggccggcaaatcgcgctgtgcgacaccaggctacgcctctgatgaggcgaatccgatgggtatcacacccattgaatacaccgccaccgatgacgggtgcggctaagagctctgatgatgctgcaccattattgacttacacccatgaggctgcgtcctgccgatggtacggcacgtagtgttctattgagacgccctcgttcaatggactttgttgactaatgcgactagtgcatagttttagatccttcatgctgcagcgtgtgtagtgagtttcacgacatggatcaagctctacagagcaacgtgcccaacctatatgcaatgaccagtggtacatgaagaacgctgacgatgcctcgcgtgctgcgctgcgtgccttgctagggggagaactcgtgagtctccacatagactatgccacgaagtgcaacgcgtcgcttcacctaagaagcaatactcggtactatgctccgacgttcacacattgcttcggatgcttgccggagcgtgcgacccgcatgccgatctggctagggtcctagactagtacacgagtgtgaattctaccaagactagaggagtttccccaagttgcacctcaaggcttttcgttgacaaggacttttgcttgggaccagtcccagtaggaggttaggctgggcctatcccgcaaccaaggtagattgatcccccacgagagggcaagagcgctacantgttgcttgcctgcatgcagagctgcttgtccgacaagccattgtatttgccctggtggtctccataccccatgttaaccccagcctggtgccttgtggtgtgtgttcctcacccacaagcttattggggccggatggaagcacaccccccctttcaacaagggacattgaattgggggccccacccttcccttgtggtattgaagaccctcccttatttgtggttcccccgcag

SEQ ID NO: 566548 - DNA, 244 bp, Homo sapiens
ggtcacacaaattagactaatcttgacactttgtaaatgtaaaacttcaaggaagaagtagccacggacagttatgtttataatcagtaggtggcactctttcctcaggtagccccccattttcacatgatgtttttaagggtaaatgccacccaaaggtcctaggtaaccatataacctagtgccctaattccatgtgccccttaaatatgtaatcattcaagagtgtaaaaaaaattagcac

SEQ ID NO: 566549 - DNA, 335 bp, Homo sapiens
cagacatcattaataacttgagggctgcagaaaaggttaacattcagcttctggaaagtaatactaaaattccttctgaatactaaatatgctcaagtccactgttgaactatctaccaagatgaagcctgctggagtttcaaaatgtccccagtgctctcaacctctgtgcgtctctctccacatcaagagtgaagtcagaggttatgtgaataacccaccccaccccccaacaaaagtggaccagggccagacgcggtggctcacacctgtaatcccagcactttgggtggctgaggcaggtggatcacatgaggtgaggtcaggagttcaag

SEQ ID NO: 566550 - DNA, 186 bp, Homo sapiens
  misc_feature (31)..(31): n is a, c, g, or t
  misc_feature (182)..(182): n is a, c, g, or t
cgcttccattccagcaggccacaccctgcancttggcaccaccagcattctcttgactgcggctgtggtgcaggttcctcgtgtcctcgtggtggctgaactgcatttcctggtgggctggtggtgtcaagcctctttcctgtgcccaacagtttatgctgtgtcattgctggtgcctgtcngatc

SEQ ID NO: 566551 - DNA, 528 bp, Homo sapiens
  misc_feature (82)..(82): n is a, c, g, or t
  misc_feature (208)..(208): n is a, c, g, or t
ccgtccgatgatatgcacagctcgtgcgacagtcctccagagacatggccccgatgggatggagcccgaaggcgttccaaantttcccgggaaaaagaaagtactggaatgaatgtgaccttgatactactccggatccttctcgggcatctacgcctatggtttgaggaaaaggcccctcgttgccatccaagcaggcgagccattnctaccttgtatcaagggttatgatgtgattgctcaagcccaatctgggactgggaaaacggccacagtttggccccccaaaaatttaatcaagattcttgcaagcacgattgacattacgatctacaaaagccgaccgcagtgcccctttttttgagatccctatgcacccaaaaaaaccccttcgaagaacttgcgctccagggcccaaggataccagaagtgtgggtcactggcacgtaggagacttaccattggcggccgccccttccttgttccaaaacccccgggggcccctgggtattcgcgcgtgtgcccaac

SEQ ID NO: 566552 - DNA, 597 bp, Homo sapiens
  misc_feature (597)..(597): n is a, c, g, or t
tttcgaagcggcggtgaaggtcctggttgaggtagggttggatggtgctggcggggaataatggttgcctccggaaaactcagcactggccgtttccttccgttgcccacgattcgggaaatcattaagtggttaagactgcaggcagcgaagcagttatcacagaatttcctcctggacttgaggttgccagataagattgtagggaaagctggcattctgccaaaggctaatgttaacgaaggggcccttggcccagggggaatcacaggatctattcttaaggccgacgtcgttgaacttctgggggttgaaagggccactcgattaattcctggattacagatgctttctgatgcagcacctgggaaactgagaatggttcatggagatgtcttgccattaaaggtagaaagggctttttcagaaggtcttaaaggaccttgggaagatgatcctccaaaggtatatataatgggaaaactgcctttaagggtttcacttccactgataatcaggtgccttgaatttcctggggagttgcagagagacttgagccattaccgaaggccggggtatcgcttttctgtttgctcn

SEQ ID NO: 566553 - DNA, 194 bp, Homo sapiens
gcggccgcctactactactactactgctcgaattcaagcttctaacgatgtacggggacatgcctttaatcccagctactggggaggctgaaacgggagaatcgcttgaacccagtaggggaaggttgtggtgagccaagattgcaccattgcactccagcctgggcaagaagagtgaaactctatccaaaaaa

SEQ ID NO: 566554 - DNA, 142 bp, Homo sapiens
aagccccattccctctctactcttgacagcaggattggatgtggtgctattgtggtttacttcttagttttccttccattctgttctgcaaattaagagtatgcgaacaatacaagaatcatgcccgtttttatacaaacaa

SEQ ID NO: 566555 - DNA, 400 bp, Homo sapiens
  misc_feature (11)..(11): n is a, c, g, or t
  misc_feature (17)..(17): n is a, c, g, or t
  misc_feature (20)..(20): n is a, c, g, or t
  misc_feature (35)..(35): n is a, c, g, or t
  misc_feature (46)..(46): n is a, c, g, or t
  misc_feature (253)..(253): n is a, c, g, or t
  misc_feature (279)..(279): n is a, c, g, or t
  misc_feature (312)..(312): n is a, c, g, or t
  misc_feature (325)..(325): n is a, c, g, or t
  misc_feature (371)..(371): n is a, c, g, or t
  misc_feature (377)..(377): n is a, c, g, or t
atactcgctgnatcctnganctcctgagctcaggngatcctcctgnctcagcctcccaagtagctaggaccataggcatgtgcacaatgcctggctaattttgaatttttttttttcataagcagggtcttgctatgttggccatgctggtttcaaactcctgggcctcaagctatatttcctcctcagccgaccaaagtgttggggattacaggtgtgagccaccatgccctgccacttgagggagttgttnctatttttatcttcgattcgattggnttttctttggggaaaagtattaactggataatntatgttgggtgantcatattttcaatatttgctgaaatactccatatttcccagtaggnaagttntttttaacccgaagtgttaaggg

SEQ ID NO: 566556 - DNA, 612 bp, Homo sapiens
ggggtccttggactttccctgcacatccagcacgctcatcaatctatgacatgccagtaggacgcattgtagtaacctatgtacaccggatgtggccgctaccgggcgtctcgggaaacacatggcatcgcgcaatctaccctctcattcttatcaatagtcgtgttggcgattgagtcacgtgtctgactggactctcaaagcgctgctgctcagaagccaagcagaaggtgccgcccgtggctgcaggtgctgcattggcggggatgagtccatgctggacattggaggagagcgcgccgctgtgccttctgcgggggcctggtcgtcatcggatcactcgactgccccgagactcgacggctatcgctagcaccaatgcatggtcagcaacagtcgggtcgccaagagacgtagctctgcgcactcacaggctccagtggacttccgacgccgacacgtcttcccttctctgccaagaggcctcagtccccaagactgccaccagtctacacatacagcagccacctggacagaatcagcatttcagctcagctggcctggaatgggccaggctggtcctggctgcctgttcaatgcctcttcagatac

SEQ ID NO: 566557 - DNA, 157 bp, Homo sapiens
tccacgcccgcgagactgggactccgccagttttggagtcgggattcgaacacatgtcccagggcggagcgggggaagagggagaccgagggcaggtccgttgagatcacgggtctccaaacacaggggacaataacgagaggagagcttgcggccg

SEQ ID NO: 566558 - DNA, 566 bp, Homo sapiens
cgagatctcggagactccggcgcaccatgcagaacctggagattgagcgtgcagtcccagctacagcactgaaagcatccctggagaacagcctggaggagaccaaaggtcgctacctgcatagcagctggcccagactccaggacgatgacttggcagcgctggaggacgcagactggcccagactccgcgtgcgagcatggagctagcacgaacccacggagtacgaagactccgtgctaggacgtcgaagaacgcgcgctggagctaggagactcgccagcctagccgacgcgcctgtctggaggggcgaggaccgcccacctgctcctcactccgcagttctacctctggatcgcagtcatcacagagactgtgacctcactccagccgccaaatccgcacgcaaggtacatggatgtgcacgatggcaaggtggtgtccacaccagcgagcaggtccttcgcacacaagaactgaggctgcccagccccgctcaggcgtaggaggcacgccccgtgtgacacagatcccactggaagatcccctctcctgcccaagcacta

SEQ ID NO: 566559 - DNA, 386 bp, Homo sapiens
ctggtcgaatatgtgcggatcttgcgctctgcgctgaggttgcggctgtgggcctgctggtcgacgcgcggtgctattgcttcagtttgggtacctcctgaacccgcgacatcatcagtaatggtccccacaatcacggccgtcttgtcttccctgggcgaggaaagcttgcatcttcctggatcatccggtaaagggacgagaggaggactggttgttgcgactcataaacgaactcttcaagacaatcctggttgaatgtggagttggatcttctggactgaaacctgtatcatttgagcaagagcctcaggtacatatcctggctcttgggctccttgcgcagaacctttcggtccttgttatggcggatgtccacgtccata

SEQ ID NO: 566560 - DNA, 113 bp, Homo sapiens
  misc_feature (92)..(92): n is a, c, g, or t
ggcagagcatgccgggagccgccggccgccggtgtccggaccgctcgcccccgtttggacccgacttcggatctacaggttttttttatgcncctgaggcccgagagcacgag

SEQ ID NO: 566561 - DNA, 309 bp, Homo sapiens
aattctcgacatatcgccggcaagccccagtcacgctgggcatcgatattgcccagacgcagttccttctgcttgccgagcttgatgcgcgcgacggcgtcggtcaccttgcgggtgacgaactcgatgccgcgcagcggcgactcatggttgaacagaatgccgctggacgcatgcaggccgaagctttcgcggtagttgaccgtgatccagtgtccatacagcttggcaacgccgtacgggctgcgaggatagaacggcgtgctctcgtcttgccgttcggcctggatcagaccgaacatctcgctg

SEQ ID NO: 566562 - DNA, 468 bp, Homo sapiens
cgaccagacttggttgaggcgagattctggagcctgctgcacctgacctgataccgtttcccggtgagtcaacggtctcagaggggaagtaccgatgtgggtggactcgagcctgctcatctttgtgcgggtgctgagtgagccacgtgatggtgcgatgctgaggtgtgtggctggtgacacgctggagcattacctggacaagcactgaccctggtgcgcggcgtgctcctccactgctcatctgaccaccccagccgagggtctgcaccttattactccacagagtggtagtcgcccaccactcagtaccccgcacactgcttagccacagttccactggggaagtgagacgaccggggaatcacaggaacatgaggatgacttccacggttagactatactgacagcccaaaagggagggagcaccgagcacacacataacaggaggacaaaagaaaaagggtc

SEQ ID NO: 566563 - DNA, 185 bp, Homo sapiens
gaggctacttacgcggctttcatagagaaattccgcagccgaggcaggaaatccctaagtcagaccaacccctccttccatgtcaatccttcttcacagatctgtaagcaaaaaaacccacggatcaaaccagactctctgtccgctcgcagcaggtgtggctcttagcactcgagcggcacagg

SEQ ID NO: 566564 - DNA, 217 bp, Homo sapiens
ggaatcatcctaaatgttcatcaggagacgaatggataaaatgtggtagatatgcacagtggaatattatttgggcttaagaaggaggaattctgtcattcgtgacatcgataaatctggaggacgtttcactaaatgaaataagccagggacagaaagacaaataacggatgatctcacttaccggggaatcttaaaaagttgaactcagagattc

SEQ ID NO: 566565 - DNA, 552 bp, Homo sapiens
aatactgtaacccgatcccctgtgtgctggccccagctatctaagcaggtgttgagatgatctgtatggactctgccagatccctccgtgcgaggatggaatcagtccattgttcaactgtgccctttggcgctgtggttcatttggctctgatttttcctatatgttctctcctccaacccccatagctccatcttgtctacaagattttgttagaagccgtcaaaatcctgctgactcgagatgcgctgtgctgcatgttctccctgggcacagcaggctactaatcctgttacaaagagaaatgccgtacattgcgagcagtgctggcccctgggactcaccgtgcccttttctaagtgcttacagactctctgtttaataatccattccagaaattttccagggctcattgttgagcttggtgtacgcaactttgagtgatcagcccttctcctttgtgggagcaccaggacagagcagcctttgtccctccccagtctcggttccctcccactggccctgtggacctcgaatgccgagcttatgcac

SEQ ID NO: 566566 - DNA, 293 bp, Homo sapiens
aaattcgcggcggtgcattcaatgaacgcggtaacgggagtaactatgacttctaagagccaaatgcctgcatctaatagtgacgccataatggatgaacaatccactgccctacctctatcacaaccacaccaggaacggctggcggaatacggcgacgcggcgcattatagtgagtagcaccggatccgaccgactgcagcgtaccacttcctatggagtctataagctgcgtatatggcatagctgttctgggaaatgtatcctccatcccaacatacgaccgagctaag

SEQ ID NO: 566567 - DNA, 1076 bp, Homo sapiens
  misc_feature (498)..(498): n is a, c, g, or t
  misc_feature (532)..(532): n is a, c, g, or t
  misc_feature (537)..(537): n is a, c, g, or t
  misc_feature (549)..(549): n is a, c, g, or t
  misc_feature (571)..(571): n is a, c, g, or t
  misc_feature (573)..(573): n is a, c, g, or t
  misc_feature (583)..(583): n is a, c, g, or t
  misc_feature (585)..(585): n is a, c, g, or t
  misc_feature (587)..(587): n is a, c, g, or t
  misc_feature (592)..(592): n is a, c, g, or t
  misc_feature (595)..(595): n is a, c, g, or t
  misc_feature (599)..(599): n is a, c, g, or t
  misc_feature (607)..(607): n is a, c, g, or t
  misc_feature (611)..(611): n is a, c, g, or t
  misc_feature (641)..(641): n is a, c, g, or t
  misc_feature (653)..(653): n is a, c, g, or t
  misc_feature (775)..(775): n is a, c, g, or t
ggctaaaaacatgttgccgcatgctttgggcgctttgattatcacagttattttgtccaggacatgttggtagtgccacatacttccacaccaagactctttggtttctccccaagtaattgtgaaggctgtgctgttcgtttagtgctattttatacttacggcaaagttcgcttcattctgtaaacatggaagtttgtcacttatctcaatagtcgcattgaattatatggtctaatgcaactagtctgtactggcattctcagattatacttgcggtctgaataactttacttaattgtcagccttattcgaaatgtctataatgtattctttggtttgcattttttcacattagacatccacagttaaggtatgggccagctacctttggggctgaccccctcgagttgccataacatcctgctccattgccctctatagactgtaggaagaattcggatccgttaccattggaatcttccatcgaacatactntatacacttttggaccaggatttgagtctctgcntggcntatacttgattnaaaggttattactaacctgttnanaatcagcagntntntgttnttnaganacaccctnaaantcttttcttctacatagttgaagacagcancatattcactgnatgtctgaatagaaaccgtcgtacctaaattagataacaactagacacttgtagtgttctcacagctatggatactttgtctgaaaagttatttgccaaaactgaaagccttcagatgtttnccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttattgggcaacggtaatgcataatatttaataacgagatgtgtttcttaacaag

SEQ ID NO: 566568 - DNA, 1066 bp, Homo sapiens
  misc_feature (498)..(498): n is a, c, g, or t
  misc_feature (532)..(532): n is a, c, g, or t
  misc_feature (537)..(537): n is a, c, g, or t
  misc_feature (549)..(549): n is a, c, g, or t
  misc_feature (571)..(571): n is a, c, g, or t
  misc_feature (573)..(573): n is a, c, g, or t
  misc_feature (583)..(583): n is a, c, g, or t
  misc_feature (585)..(585): n is a, c, g, or t
  misc_feature (587)..(587): n is a, c, g, or t
  misc_feature (592)..(592): n is a, c, g, or t
  misc_feature (595)..(595): n is a, c, g, or t
  misc_feature (599)..(599): n is a, c, g, or t
  misc_feature (607)..(607): n is a, c, g, or t
  misc_feature (611)..(611): n is a, c, g, or t
  misc_feature (641)..(641): n is a, c, g, or t
  misc_feature (653)..(653): n is a, c, g, or t
  misc_feature (677)..(678): n is a, c, g, or t
  misc_feature (709)..(709): n is a, c, g, or t
  misc_feature (711)..(711): n is a, c, g, or t
  misc_feature (765)..(765): n is a, c, g, or t
ggctaaaaacatgttgccgcatgctttgggcgctttgattatcacagttattttgtccaggacatgttggtagtgccacatacttccacaccaagactctttggtttctccccaagtaattgtgaaggctgtgctgttcgtttagtgctattttatacttacggcaaagttcgcttcattctgtaaacatggaagtttgtcacttatctcaatagtcgcattgaattatatggtctaatgcaactagtctgtactggcattctcagattatacttgcggtctgaataactttacttaattgtcagccttattcgaaatgtctataatgtattctttggtttgcattttttcacattagacatccacagttaaggtatgggccagctacctttggggctgaccccctcgagttgccataacatcctgctccattgccctctatagactgtaggaagaattcggatccgttaccattggaatcttccatcgaacatactntatacacttttggaccaggatttgagtctctgcntggcntatacttgattnaaaggttattactaacctgttnanaatcagcagntntntgttnttnaganacaccctnaaantcttttcttctacatagttgaagacagcancatattcactgnatgtctgaatagaaacctcttttnnttttttttttttttttttttttttttttttntnttttttatttgtctgaaaagttatttgccaaaactgaaagccttcagatgtttnccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttattgggcaacggtaatgcataatatttaataacgagatgtgtttcttaacaag

SEQ ID NO: 566569 - DNA, 606 bp, Homo sapiens
cccactggagtacagtggtgcaatgtcagttcactgcaacctaaacctcatcaggctcaagtgatcctcccactttagccttccaagtcgctggaactacgggcatatgccaccatgcccaaataaccttttaattcttttgcgaacacagtgcttcactatgttgtccaactccaatctcaaacttctggggtccaggaaatccttctggctgggcgcttcccaaagggctgggattacaggcatgagccccccggcccaggtggtatccatttttctaaaccacattttaaaaagttccagtgtagaggtggcccaattggatttaacaactgcggttttaaaagagaaactgcggtttcttttattaacaaatcaaccacggtgcggggcaagttcctggtaaccattgggcctgaaccatcggggaccaccaccccaatgtaacccggctaccccggagggttgggaccactcccaacggactttgcgccccccctctcgataaagaactatgtgcctttgacacgaaaggctcccctctcagacaaacacggcgtccgctccacagctgtgtcccctcgttgcgatcagatcatttccgct

SEQ ID NO: 566570 - DNA, 664 bp, Homo sapiens
gtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctatttttttttttttttggagacggagtctcgctctgtgtcaccagggccggagttgcaggggtgcgactcctcggctcacttgcaagctccgccttcccaggttcaccgtcattctccgtgcctgagcctcccgattagctgggactacgggcgcccaccaccacgcccgggctaatttttgggtgattttaggtaaaagacgggtgtttcaccatgttacgccaggatgggtctcaatctcctgacctcatgatccgcccgtctgggcctcccaaagtgctggggattacggcgcttgacgcaattggcgcgcccagccaatttctatcttcttaaaatctcacaaaaactatgttcaacatcggagtgactggtccgtattgtccaaagtgtgttccaccaaaaaagagctaacaccagtcattttatttttacctttttttttcaacttcaaaactggttaagtgcttcgaaccttcctatgaaggtgccttattcgtgcttagac

SEQ ID NO: 566571 - DNA, 344 bp, Homo sapiens
  misc_feature (156)..(156): n is a, c, g, or t
ttaatttttgtgtacccatagaaaccataaaaaggagagcaatgtgagtcctggattttattgatggcagagatatatagttttgaccaggatcaattttcgttaacgataaaaaatatttaaagaataaccccatggaaatacgtgttgactgantcatttttccgaatgattgttttctggaactaaattatgtaaaggttatgctgtcatatttaaagcgattgtaagctaatgtatgtaataaatgagataatttacagtaagctaaaaatcagccaggcgataaatgacctgggctgatagtttttagccttttagctgttgcattttggttttatgaa

SEQ ID NO: 566572 - DNA, 625 bp, Homo sapiens
gaggcaggcgcgccccggacccaggatttataagaggcgaggccgggacgcgggcgcgctctcgtcgcccccgctgtcccggtggagccaacctgaaggtgccccgcttgatccgtgtccgacatgctgcgccgcgctctgctgtgcctgggctggggacgtcgctggtgcgcggcctgaggcgcgcccgaggaggaggaccacgtcctggatgctggctggacaaagcacgttcgcggagtgcgcatggggcccacaaggtacctgctggtggcgtgctatgccccttgtgggtggcactgaaaggttctggtccctgagtatgccaaaagccagctgggaagctgagagggccgaaggtgccggagatcagtgttggccaaggtgtggacgccagggagggagtctgagcgtggcccaaggagtacggcgtgtgcggatatccatcatcaagttcttcaggactgggggaccacgaggtaacgccccaagtggaagtattacatgcgtgccagaagacggctgatgacgttcgtgaacgcggtggacgaggcggcaagggccgggttgcgaccaccggcttgacggggcagtgtgcagaggccttggggaagtccagcgaggg

SEQ ID NO: 566573 - DNA, 598 bp, Homo sapiens
tcttccacctttgtggttgtcggtcgctactttaggctcggcctcctctcctccttatgatctgccctcccactatagcccctttttggttcgattgtccccgagtttggactgcacggctacctaacgtccatgctgatctgcacacgcggtgtggcttttctacgtatgtggtacatttcgctctatctcttcagccatagagaggaaatattgcaaatggacatgtgaagctcattgttatacactttactgaaataacagagcacacgtacctcttagtggcaaagttggcctctcgtggaacactgatattcttcgatggctgtatacacagttccgcggtgtgcctgagagtcgcctgccacaccctctgacagctctagcttacttgggacacgacatacaactgctggactacgttcgatgcggataggcaagcagtgcacgtggagactggtgtggatctagagagaccgagagaataccctattgtcaacctggtcctttcatcttagtatcgcataaaatcaaccacttggtttgggactgatatattagcagtaggtggcaaagtaattactcccatggtgttata

SEQ ID NO: 566574 - DNA, 454 bp, Homo sapiens
acaacgtcgtggctgcaaagaacctgaaggagtgtgttgttagttctacaaattgtgaatctcctgttatcctccatgttaatttctaactttatcgctgtacagttggagaagatactttgtatgatatctgtattttaaaatctattgagacttaatatgtggtttaacatatgatctatcttgtagatggtcctgtgtgcagttgagaagaatgtgtaagctattggcgtcgggtatagcatcttgaatatgtctgtgagcactagttggctcatggtgtcgatcaagtcctctatttccttacctacttttggtctggttatttaatacatcattgagagtagggtattgcctccatagattcgttgaacagtctgtttctcccttcaattccgtacattttttcgattggctcttgatggtctaattatttgccacgatttcctcatcg

SEQ ID NO: 566575 - DNA, 872 bp, Homo sapiens
ttcgccagagatttttttccccttcaaaaattcttggaaacgaccatctctgaagggttttcgtcaagagttatccctcgtggagaaggaaaaatgtcctttaaggtcctcaacaggatcccctcggcacgctactccctcacagattggtcttgggagacttttatttgagccccacacaccttgggagtgaaaatttatagagtaccttacatgattttggagacagaaatatcttgatatacacagatgtccccacttagggggaagacggaacaaatggaaatctcttctggccccactttttcacggggttctcccccaccctcggattactccgccgtaacaatttttgcagcacgtctctgtttaaacaacagcggcgatatagcccttcttcgcacgagggaactctaattgagaataatctgctattctataaagagggctatttcagagcaccaaaacgctcgtgcttgtcacaaatgggaaagtcaaaaggatatgagaaacttgtgtctgcccctacggggcatcttagacaccgggagaacaccacatctttcggggacgagactcgcatttattccgcgtgccccacaagaaaaactcggaaatgggccgcattcacttcgagtggcaacaaccctcgtggctgattgctggctgcttctgggtcttgagggctggtcgggcgctccaccctggaatttggaatttctcaggttctctgcccgtctacaccaccccctttctgggggcaccgcaagcagtgccccaggcccgagttggggcccggtttttatgggggaagctttgctgtttaattaactgtgaatttgtgataaaaaaaaattttttaatttttcgga

SEQ ID NO: 566576 - DNA, 759 bp, Homo sapiens
  misc_feature (30)..(30): n is a, c, g, or t
  misc_feature (63)..(63): n is a, c, g, or t
  misc_feature (133)..(133): n is a, c, g, or t
  misc_feature (166)..(166): n is a, c, g, or t
  misc_feature (215)..(215): n is a, c, g, or t
  misc_feature (271)..(271): n is a, c, g, or t
  misc_feature (322)..(322): n is a, c, g, or t
  misc_feature (348)..(348): n is a, c, g, or t
  misc_feature (368)..(368): n is a, c, g, or t
  misc_feature (378)..(378): n is a, c, g, or t
  misc_feature (393)..(393): n is a, c, g, or t
  misc_feature (421)..(421): n is a, c, g, or t
  misc_feature (429)..(429): n is a, c, g, or t
  misc_feature (436)..(436): n is a, c, g, or t
  misc_feature (441)..(441): n is a, c, g, or t
  misc_feature (452)..(452): n is a, c, g, or t
  misc_feature (455)..(455): n is a, c, g, or t
  misc_feature (476)..(476): n is a, c, g, or t
  misc_feature (524)..(524): n is a, c, g, or t
  misc_feature (539)..(539): n is a, c, g, or t
  misc_feature (593)..(593): n is a, c, g, or t
  misc_feature (621)..(621): n is a, c, g, or t
  misc_feature (623)..(623): n is a, c, g, or t
  misc_feature (682)..(682): n is a, c, g, or t
  misc_feature (684)..(684): n is a, c, g, or t
  misc_feature (686)..(687): n is a, c, g, or t
  misc_feature (689)..(689): n is a, c, g, or t
  misc_feature (698)..(698): n is a, c, g, or t
  misc_feature (752)..(752): n is a, c, g, or t
agttatttattccaaccacccctattgganggcccccattttgggggaacggccaggcatttnattacccacccttcccatcccttaaaggctcccacgggttccggtaaatccccattacccccgggacggngtccgggagtggccccaggggggtcagaagatncaccatcaacccaccccaccagggcttggaaccttcctacaaggcggangccaacagcacacggcaactggggcaaacagatagggcaaaggtttagagggcgcnggccagctcctcccaaggggtgggagccttgcatgaggcatgcaagccacnggcagggccgcagcccaaataggggnccgaccccaggggttaaagncttacgggancgaagtagtaaaacnctagtcattccgggaatataatagtggncgaaaatngaatagncactngaagaggtttnctngagcttctccactttgccttnaaagggcaggcaaaaaaaaccacggccataccgggcaaagcggaatanccccacaccatcggncaaagaggcctgtccaaagacaaaattccacgagcccctggggtaaagatcaancattgttattcccacaacacagaaggcntnttcaggtttcttctttttcaagaacttcaggatgtcccctgcatgaatttgtaggttgngngnntnctcattgantctaaaggaacatcttgttacagaaacaggaactggttctaggagttttactcncaagcca

SEQ ID NO: 566577 - DNA, 887 bp, Homo sapiens
gaccctgtgctgcgctggctggggaggaagcggttctaggggatggcgtgctgggcgccggggtccggcggacgtaggaggccacacttctggccttgtgatgaatcctcgagtttccgccttctcagatggggttgtcgtgagggtacaacagtcggcattcatgacattccaggtggacgcccgatacgcggttgtgtgcggattcgaggccggagactcatggaacgctggcgcctggaggcgtcgacccctcgttactgatgcagggacgcggtgcggaccagtcaggcccagagctcgtccttagatgtgggttcgaatctctgccccgcacaacttgtgatcgtatcgactcggcccagacgcaattttcttctctgcaaaatcgtcataagaataatcacttgttcagggtagctgcgggcatcccattcgttcctttcatcagcgccgggcatatggggcgtcacgaggctgagaaacggttgccgtgaaagaggcttacaagcaagacccggagttggcgaccttacaagaggacggacctgaagcaaaccgcgcgcgcaattgagctccagaacgcgggacgttcctcattcctacgaaggttacagtgtaaggagatgtctagccgtgacccgtggacttttgggagaagttcaaaacctttcagaaagagttgggagacagacggaaaatttgggcagagaccttgaacatgttaggaaggaaattgggaaaagaaaccaaaatttacgtcgtggaagaaggctgacgctctttacccaagtgcggcagttcattcactggcattatgaaggaaggcggacgggaagtatggaaaagcaggcctcctggacttgcctcgcttggtggtggaatgc

SEQ ID NO: 566578 - DNA, 150 bp, Homo sapiens
acaagtagacatttctattcagatgttcatgtgtatatgtggtgttatacacacacgcctatataccatgtcggtttggacacactcgacgtcaaagcagttcacatgggagtgtctgggagttcaagagaggctagcacatagtgcagc

SEQ ID NO: 566579 - DNA, 486 bp, Homo sapiens
  misc_feature (81)..(81): n is a, c, g, or t
  misc_feature (85)..(86): n is a, c, g, or t
  misc_feature (112)..(112): n is a, c, g, or t
  misc_feature (128)..(128): n is a, c, g, or t
  misc_feature (131)..(131): n is a, c, g, or t
  misc_feature (246)..(246): n is a, c, g, or t
  misc_feature (261)..(261): n is a, c, g, or t
  misc_feature (273)..(273): n is a, c, g, or t
  misc_feature (314)..(314): n is a, c, g, or t
  misc_feature (317)..(317): n is a, c, g, or t
  misc_feature (326)..(326): n is a, c, g, or t
  misc_feature (332)..(332): n is a, c, g, or t
  misc_feature (349)..(349): n is a, c, g, or t
  misc_feature (353)..(353): n is a, c, g, or t
  misc_feature (362)..(362): n is a, c, g, or t
  misc_feature (371)..(371): n is a, c, g, or t
  misc_feature (379)..(379): n is a, c, g, or t
  misc_feature (385)..(386): n is a, c, g, or t
  misc_feature (388)..(388): n is a, c, g, or t
  misc_feature (390)..(390): n is a, c, g, or t
  misc_feature (401)..(401): n is a, c, g, or t
gattttctctaatgtaacttcctcttggatggtttcaccaaggaaatattgagagaaagtcggccggtagatgaaccagcnatgnntgcgcaagtggattaaagccaaaganagaagagtccaggaanggncggggagaagcctgggtggctcagcatcctccaacggtgcgccgtctgctcggggctgagctggcgggagcagtttgcgtgtttgggttttttaattgagatgaaattcaaatancctaaaaatcaatcncttgaaagtgancaatcagcggcatttagtacatccagaaagttgtgtaggcnccncctctgtcncgttcnggaacattctgtcatcncccngtgaagcantcatttccnctcccgtnttcctnntncnctggcaactgntgatcgacatagaatctctgtagtctcaaaagggtattccctgatctggaaaatacaactaaatgagatcaaacacaaaacaccc

SEQ ID NO: 566580 - DNA, 1199 bp, Homo sapiens
ggggaaagtggaaaactatcggcggtggcctcaggctctgtggctcactcctggaatcctcagcactttgcgtgaggccaaggtggggggatcacgagggtcaggggatcgagaccatccgtggctaacaggtgaaatccatgtctctactactaaatacaaaagaattagccaggcttggtggagtgcgcctgtagtcgcagcttactcgggaggctgaggcatgtgagaactggcggtgaacccagtgaggctggatcctgcaagtgagccgagattgctgcactgtactccagcctgggcgacagaggacacgactccgtcctcattaatatctataaccttacgcaacaggctacaatttgactggtcgtggtacactggactccaactaattgcactaccagattgtgtgttgaaccttcttagaaccagtagccctgtgattctgcctatacaacttgttcccgtggaagccagagttctggcacaacttgaggaccatgacgctatcgttgtaaagatccctagggcctgtgatgaattgcaagctctaggcccgaggaatacgacaccttgggtgggcttcgtcccaaggcgttgttgccaaggagcatatagaaggacctcttgtcgttctcaacatattctcacacacacactcttatatacagcgctcgttgtattcttcgaaccgcgatatacaacattagaggggacgtgacatagcactgatttctggcccccacacaactcttggtttgctcgcaattggacgtttaagattacgaacttagaagcttacccaatatggcccagttagagatatggaaggggcaaagacgtcccgcaagagaatcacacgcggggcacgtttggttaacatcgtattccctcatgcctactagttggcgtcctcagaatgactgagggaccattgagcgcctagccacgagctgtgcgggccccaacagatccatcgtattgcctacttggatgattatatcaacaatccgccagaggacgggcgggtatcacaccacgttgatgtgtgatcacttgaacgagaagaaagatacccccccagctgtaagtcttgtagctcatttcccaccaaccgatagccctcatagagtgagagagcccacatcttcacaacggtgtggaggagtccccccgcaatagggtgctacagactt

SEQ ID NO: 566581 - DNA, 319 bp, Homo sapiens
tacagataaggaagtgtacaagcataaagaagacagcagtgagagctgatctgtgtgtactatttggttccttcagaaggctgggtcgtggaagtgcaggacatatttcacggctgcttctcctgataatgatcttcttctcggcccaccttgagaacataatccctgagctccgaagccctttttgactgaagctcctgtagaacaagatttctcaccgtttcttacccctgatccaccttctgccgccgccgacgcctctccagagcccggctccttgtccgactcccttgatgtacaaatttttccagctccagaa

SEQ ID NO: 566582 - DNA, 237 bp, Homo sapiens
accgcattatagctcgtaaggatcaagtagttgtctcaaatacggcaacagctttgagtgcctcgtattatttaagttttattttttttaatttaataacaggtaagttgctgtacatcctttgcagatttccttatttttttttttttttttgggaaagggatcccccccctgtggcccaaaagggatgtccagggacaccaccactgtacctcccgctccccaggtccaatgtgt

SEQ ID NO: 566583 - DNA, 476 bp, Homo sapiens
  misc_feature (81)..(81): n is a, c, g, or t
  misc_feature (85)..(86): n is a, c, g, or t
  misc_feature (112)..(112): n is a, c, g, or t
  misc_feature (128)..(128): n is a, c, g, or t
  misc_feature (131)..(131): n is a, c, g, or t
  misc_feature (246)..(246): n is a, c, g, or t
  misc_feature (261)..(261): n is a, c, g, or t
  misc_feature (273)..(273): n is a, c, g, or t
  misc_feature (314)..(314): n is a, c, g, or t
  misc_feature (317)..(317): n is a, c, g, or t
  misc_feature (326)..(326): n is a, c, g, or t
  misc_feature (332)..(332): n is a, c, g, or t
  misc_feature (349)..(349): n is a, c, g, or t
  misc_feature (353)..(353): n is a, c, g, or t
  misc_feature (362)..(362): n is a, c, g, or t
  misc_feature (371)..(371): n is a, c, g, or t
  misc_feature (379)..(379): n is a, c, g, or t
  misc_feature (385)..(386): n is a, c, g, or t
  misc_feature (388)..(388): n is a, c, g, or t
  misc_feature (390)..(390): n is a, c, g, or t
  misc_feature (401)..(401): n is a, c, g, or t
gattttctctaatgtaacttcctcttggatggtttcaccaaggaaatattgagagaaagtcggccggtagatgaaccagcnatgnntgcgcaagtggattaaagccaaaganagaagagtccaggaanggncggggagaagcctgggtggctcagcatcctccaacggtgcgccgtctgctcggggctgagctggcgggagcagtttgcgtgtttgggttttttaattgagatgaaattcaaatancctaaaaatcaatcncttgaaagtgancaatcagcggcatttagtacatccagaaagttgtgtaggcnccncctctgtcncgttcnggaacattctgtcatcncccngtgaagcantcatttccnctcccgtnttcctnntncnctggcaactgntgatcgactttgggtttttgttgtttaaaataggttttccctgttttggccatttcatataaatggaatccccca

SEQ ID NO: 566584 - DNA, 266 bp, Homo sapiens
ctgccccgggtgtccctaccatctgagacacattgcctgcccccgcctccacgatgggccagcagtgccaggcttttgaggccaaaggaaaggccgtgctggtgggcaccacgtggccaggcaccagcaagggcccaggagtgcgctacacacagagctggggcctaaatgccagatagcccttcctaaacatcggctaaaaccatcttcgcagaggggtgttgtaggtgatcttctttatctggccagtttttctctatttttcc

SEQ ID NO: 566585 - DNA, 584 bp, Homo sapiens
acgcaggccacagggagggattgcagaacaaaaggtgtggggaacacaaggatgtgagtgtgcctattcaatacccaaacagggcttgacacaccacccccccctaaagggaaaacttgtgttggagaaaagacaggagcccaaccccaaggccttcttaaaaaccacgatccaaaatttcctgggtcattgagtgctctggagtgggagccacatgaagcccccaccagactccaagccatcaaggcaaaattaactgcagtgtgaaagacacttccctggaccaagcagaggttaggtatcaggtagggaacactagggaacactacactccgaataaaggcaggactcccgccttggccagcaggccaccagaaaaacagggcctcactgtgccagcacgagccacccccgggttggatggggagtacattctgctacaccgggctttccagggtaatgggtatgtttccctgaacacttgcaggagcctgaggaaaagaggtctatttcaaatagtgtaagaaatgaaacatgccctgagctttctccctttactaaacacttaaggcccaagaaactgt

SEQ ID NO: 566586 - DNA, 1002 bp, Homo sapiens
tcaagtgacaactacttgggcaaaggggaaaatgacaccaatcattggattacagaaaagggtttaataaatcctcctcttgaaataatgttcaggcccagcagggtagcttatgcctgaaatcccagcacttcgggaggccaaggcagaaggatcgcttgagcccaggagtacgacaaccagccggggcaacatagtagagaccgccatcctcaaataacaaaaagaacacacacaacccacaacaaaagaacacaacatcgccggaggcccatttctacgcggcgggcgggcgcaacagccggcacacaaaaacgcgcccccaggggacaacagcccgcccccaggacccacccgctgcggccacccacgcgggtgaaaaacaacttgccgggcggcaccaacccaaataaaagggagggcggcaataatcacaacgcgacacaaacagagcccggactatacaccaccgcgcgtctacagagcaataccgggcacaaaagacaagacaagcaccacgcaacacacacgccgagcaccaatctacaataacagccaccagaacgacaacaagaccagcaaggagcgcgcccacacgagacgagagagagagaagaggaggagaagagaggagcagcacacggcgacgcagcggagacgcggggtggaccgggggagaggggccgacacagagagaagaggaaggaggaccagaggaagaggagaaggagaggagaagacagggcggcacaaagacagcgagggcgacgcgggcgcacaggcgaggcgcacaggagcagggagggggcaaaacgcaaaagacagtaaccaggaacgagccaggcacccagcggagaatgaacgaaaagcacgaagctgaaaaaacagtagagacctcaaaagaaagaaaaaggacaggaagaaacagaaccaaaacacaaagcaacacaccaaacagacgacagcgcaacgacaaacaacacaacaacacaaaaccaaaaa

SEQ ID NO: 566587 - DNA, 303 bp, Homo sapiens
gcagaaacaggagatgatggtggcgtgtgtacctcgtctcggctcatggccgttgtgcgtcgcgcactgaatttccggtgctccgttgccggacccaggtgcgaggttcgtctgagcgaaccatgtggagttggactgtgttgcttatgggcaaccgccgtcataagttctgacgcgagaatacctctgtggaagcgactgtggtgtgcaatagccttacccgttggagcagaatagactagagcacggacatgcgccttggatgcgttgatcagcttggagagttgaggcgaaggccgtcga

SEQ ID NO: 566588 - DNA, 207 bp, Homo sapiens
cctactgtatctattctcccagtcctagctgctggcatcactatactactcacagatcgtaacctcaacaccacctcctaccggtggggtcgaagaaggtggtgttgaggttgcggtcacagacatttaggtaacagccatttaggtagtacagacaaattaggtcgggtacctgatgctcgacattcgtaactcacttggtcacta

SEQ ID NO: 566589 - DNA, 298 bp, Homo sapiens
ttgcctagaggttccctccgctcggacaatccatctctctttacactctcacaatcaacgaatcccaaatatcactgtataaactaagaagtaataggaaacttgagaacagagtgtttttttcttttttcttttcctttttttagagacagggtctcactattacccaggctggtaagtggagcaacacaatcacagctcactgcagcctcaaactctcaggctcaactcatcctcttgtctcaacctctcaaagtgttgggattacaggcataaaccatggcacctggtccgagcg

SEQ ID NO: 566590 - DNA, 169 bp, Homo sapiens
ggagttaccgatggctatacatccagagacccctcacctcacgagatccttctgcctcagcctcctgagtagctggaactacaggcatgtgacacagtgccctgcttgcctttttaaaatattgggtggtttgggctgggcacagtggctcacacctgtggtcccagca

SEQ ID NO: 566591 - DNA, 753 bp, Homo sapiens
gcattactgagtacatatttttaaagaaaaatgaacatatatattgtaaagatgatatagtatagataattgaaatgccttttagaaatataggatctaagtaatatctttattgagcataaactctggagccaaactgtatgggtttaaattacagctctctagcttattagcttgtggccctgggcagttacttagcttcttgtgtctcagtgtattcatctgtaaaatggggatcataagagtactaatctcttaggatttcatgaggattaaatcagctagttaatgtaacttgcttggaatagtgattagcacacagtaagcattcattaagtgcttgttttttcatgacttgaatgggaatggttagctcatctaaacttgggaccattgctaagataaatggcatataaaagttatacaaccagtgttcccataacagtttctgtgaaacatgttgcttttattattgcttaatccactaaaaaaaagaaacaaaatacagcaacaaaaacaaagtgtgacagagactaggcccccgagaaaaaattttaagaacacacttgttgaggccgacgccccacaacggttaggaaaagtggcacatccgtgttcccaaagaaccaccggccacggaaacggttgtggctctccaccgtaaaaaacccgggggaacagggtctgagaaaacaagagagtatgggagcaggggcactacaagagaccggaagcgaataatacgcggttgta

SEQ ID NO: 566592 - DNA, 197 bp, Homo sapiens
  misc_feature (7)..(7): n is a, c, g, or t
  misc_feature (12)..(12): n is a, c, g, or t
ttagtcnggacnacatggtgaaacccctctttttctacaaaaaataccaaagctagctgagtgtgggtggcatgtgcctgtaattccggctacttgggaggttgaaacaggaggatgcttcagcccaggaggcagagtttgcagtgaggtgagatcatgccactgcactccaatctgggcaatagaaccaaatcctg

SEQ ID NO: 566593 - DNA, 754 bp, Homo sapiens
  misc_feature (749)..(749): n is a, c, g, or t
catagataactgctttttatgacatattgaagctgtgtggcgactgtgtcaaggaagcctattggctccattttttttaacagcgttgtgcatcaatgtccttgactctatcacattttggtgattctcacactatttcagaccttttcattattattatatgtttcatggcgagctgtgatcggtgattcttagtgatactattgcaacagctttgagacgccatgaaccatgctcatatattataggacacttaattggtgtatatagtgttttgactactctaccaactgaatgctgttttatctctctctctctaaatgtgtgtacctgttgcctgagacacagcagtattgtaactaggccacttaataacctaattaattggcttgattcaattaggcctctaactaatgatgatgggctctaactatgtaagtgacaggaagagtctcgcatctctcactttaactcaacagccagaaagaattaagcttaatgtgtatggcatgttgaaagtcaagatatgctgctatgcctcttgctccaaacagagaagttgtgaatataagggataagttactcgcggaaattaaacgtgctactctagtgaacacatgactaataagaacgcagtacagccttcttactgatatggagaaagtttgagtagcctagatggaagattaaccagctgcacattgccttaagcgcctctacacaggatggccctattctcttcatattancgctg

SEQ ID NO: 566594 - DNA, 930 bp, Homo sapiens
agcggagaggctgttgggaggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccaggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaataagcacctactcctcagaaacttgcatatgaaaaaaaagcagaatgaccagcgcagtactggttaactgttctgatttccttgctttccaaattaaattacaaggtcagatgttttcagtccatcagataaacgtagacgaattggggacattctttgaaggattaaacagtcaggacataggattttattaataaaaggcctggtgtaattatggtgaagatggtaaagccgggtta

SEQ ID NO: 566595 - DNA, 169 bp, Homo sapiens
ttggcgtgaggccaacgggtccgaggggtgaaagaggcccccggggcatcactgggaagcctggccccaaggtatgtttttggcctcctgggcggtgggcggcgtgaacccaagttgcaaggctacagagacgtggagcgtctgagggtgtctgtgcaccttttttatt

SEQ ID NO: 566596 - DNA, 100 bp, Homo sapiens
tagctcggaccgtcgtgtcatgtgattgctgcataaaattaggcctattctacgcccaaattgttgcggtccaactgtttcatatctttggacatcataa

SEQ ID NO: 566597 - DNA, 1055 bp, Homo sapiens
agcggagaggctgttgggaggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggagcttggaaggttcttccatttgtttgtgtcctcttttatttcgttgagcagtggtttgtagttctccttgaagaggtccttcacatcccttgtcgacctgctttagttttgtggaaagccaatgtccaggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaataagcacctactcctcagaaacttgcatatgaaaaaaaagcagaatgaccagcgcagtactggttaactgttctgatttccttgctttccaaattaaattacaaggtcagatgttttcagtccatcagataaacgtagacgaattggggacattctttgaaggattaaacagtcaggacataggattttattaataaaaggcctggtgtaattatggtgaagatggtaaagccgggtta

SEQ ID NO: 566598 - DNA, 536 bp, Homo sapiens
agcggagaggctgttgggaggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccaggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgggtatgtctgaaaggaagatctgcaaagatttttgcttcaatgactagtttcctatgtcatcacttgaattatttattacactttcctgggatgttaatcatagaagtctaatactgcaaaataaagtccattttgtcatataaaaaaatttacagtgaaaaa

SEQ ID NO: 566599 - DNA, 383 bp, Homo sapiens
  misc_feature (45)..(45): n is a, c, g, or t
gcggccgcgactactactactactacacaagttcgcaggacgctncgaccccagacaagatgcatattcctcagaactgcgggaggaggcttgtttcccttccctcccggcgacaagctccagggcaaagcagtcacctccggcggcccagcacttccatcagaacaacttcttcactgactgctccagtcgtggggatcatcacttaaccacccaccaagttcaagaccgaatattccagctgcacccttcgtgtttccctatgtttgctgatagatgggcatgtctccaggaaccaaaaagccctcagcctgagtgtaatctccctgacccttgttaattccttaagtctaaagatgatgaacttcaaaaaaaaagtcgac

SEQ ID NO: 566600 - DNA, 117 bp, Homo sapiens
tccgacgcccaggtctaccgtctggttaccggtgaaccccaacgcattccatcacgaacattcgccgccctgtgcgacatcttcgactgcacgcccaacgacctatttgagccgtac

SEQ ID NO: 566601 - DNA, 285 bp, Homo sapiens
gtgacctagtatataatgataatttaccatgatacttgataaaatagttttgtgtgttcagaataatttcttttttctttacctttgaaaacaatgcatcgatagttaattttctcctaaattgtctgtttttatttccataaaaggtatttattgaatatctccttttaatataactaggcattgtgtgatcaaagtaaaataaatatgttcttgtttctggaattactaaagctttgaaaatggacttatcgacctcaaaccaatgggacatattcccatgtg

SEQ ID NO: 566602 - DNA, 326 bp, Homo sapiens
tacttgggttacacaacagtcaattattctgaatttttgatccaggactctgggttgtagcatggagacagagggaacattccaatctctgggtttaaaaacaaagacaggccgggagcagtgacccacacctgtaatcccagcaatttgggaggctgaggcaggtggatcacctgaggtcaggagttcaagaccagcctggccaacatggcgaaacccttctctactaaaaatacaaaaattagctgggtgtggcggcaggtgcctgtaatcccagctatttgggaggctgaggcaggagaatctcttgaacccggagggagagg

SEQ ID NO: 566603 - DNA, 432 bp, Homo sapiens
  misc_feature (173)..(173): n is a, c, g, or t
  misc_feature (180)..(180): n is a, c, g, or t
  misc_feature (217)..(217): n is a, c, g, or t
  misc_feature (230)..(230): n is a, c, g, or t
  misc_feature (313)..(313): n is a, c, g, or t
  misc_feature (322)..(322): n is a, c, g, or t
  misc_feature (324)..(324): n is a, c, g, or t
  misc_feature (335)..(335): n is a, c, g, or t
  misc_feature (373)..(373): n is a, c, g, or t
  misc_feature (380)..(380): n is a, c, g, or t
gggtgcggcctttgtctctcgctgcagtcagagctccaggtctggttcttacttctcctaaaggcccaggctgtgtggccccgtgtcctgcaggtattgggagatccacagctaagacaccgggacctcctggaagccaaaaatggtgagatgagggtccgacatcccgacanaggagangggactggttggaaccggtgatggctgtggcgggatncaggcctccccgncagtcagctccacatctgctcccccattctccttgctacagctcgcctcatcctgtttcagccattggcagctgcgctgacanccggcaacngncgtcttgtcgntacaatgcgcggtgactaccctggcctggagccctctntgggcanctctgcaaccgcagcgtggcgtctctcccagattgtgcaggaccagggggtg

SEQ ID NO: 566604 - DNA, 513 bp, Homo sapiens
aaaaagtatgcttatcttataaaaatatgtcactcgatcttctggaatgcttagcaagaagtcatttctacacaaaatcaaggcaaacagatactctataatagagtctagctataatttcaacaacaaagtgaaagctaatgtacttacgaagtatatacaaaggcccactgataatgctgcactcgcaatgctaaacccaatgttaactaaagtcaacatatccgctctacgcttactggcaccaattcatgcctacatcatgggaacgtacctcttttacagaatgcagatcactgctaacaatccacatgactaagtcttcagtttcccttgcttaacatttgttagcatatatttcagcaaagattaacagtataatgaatgttgagtagtaaaatcctatttaattcgcttcaatttaaaaatgagatatgctgctatggggaacaaatgacctcttgagatttacaaccccctttataaaagtgggaaagctgcctccctaaaaaa

SEQ ID NO: 566605 - DNA, 476 bp, Homo sapiens
cgagtgccgattctgatgtctggtaatatgaatgcctcggcttagttgctgtctgtcaagatggtcttcgctggtctggcccctgtgcctttccatatgtatcttaatatccgcttgtcaatttactgtatatgtgagtgtgtctctttctggaatttctactgtgatttgctgaccttgcatcaacactgttttaattgctataggctgataaacgtagtcttgatgtctggtaatatgaatgcctcggcttaattgctgtctgtcaagatggtcttcgttggtctggaccctgtgcctttccatatgtatcttaatatccgcttgtcgagttgactgtatatgtgagtgtgtctctttctggaatttctactgtgatttgctgaccttgcatcaacactgttttaattgctataggctgataaacgtagtcttgatgtctggtaatatgaatgcctcggcttagttgctgtctg

SEQ ID NO: 566606 - DNA, 328 bp, Homo sapiens
  misc_feature (293)..(293): n is a, c, g, or t
  misc_feature (299)..(299): n is a, c, g, or t
atcactacttcctagtttcagagctttttcaacacctcaattggaagcctcatacccgattcagcagtcactctgcataccccctcctgcagcccctggaaacctctcatctactttctgtctctgttgattggcttagtctgagcattgcatataaatgaaattgtacaatatatgacctttcatgtctgcttcgttcagtgagcaggtatttaacgttcatatcacaccatggataagttttattttctttttagaccctaactaaaaagaaaaaaaattgtaaaaaacanaaacanggaacagaaaaagaatataggatggagat

SEQ ID NO: 566607 - DNA, 135 bp, Homo sapiens
acctgtaccgtgttatcgatgcactcaggaagaggaggcaggaaatcacctgaatctggtaggtggaggttacagtgagccgagatcatgccattgcactccatcctgggcaaaaagagtgaaaccttgtctcac

SEQ ID NO: 566608 - DNA, 146 bp, Homo sapiens
cacgctctctctgtggggccgaggctggagtgcagtggcgcgatctcagctcactacaacctccgcctcccaggttcaatgcaatcctcctgcctcccccctgagcgagcctcaccccacgagagcgtcccccacagagagagcgt

SEQ ID NO: 566609 - DNA, 244 bp, Homo sapiens
gttttaaaaaaaaaaaaaaggtagctgttattcaaacccccgggcccccccccccccaaaaagccaaaaaatagttcctgtgacattccgccttccttccatgtagtcccttttggtaatctacccccaagcttgtggacttcccccccacaaaattgtaagcgttgttaggtttttgtgtaaaattcttgctgtagcgtggaaaactgtgattggtgagtcaaccgtctgtggctaccagtta

SEQ ID NO: 566610 - DNA, 313 bp, Homo sapiens
  misc_feature (37)..(37): n is a, c, g, or t
cactcagtcgtgacgggacgtgtgaggaagtataagnaaaataatgttatcggtagtatatgaattcagagtcatgaatgatggtaatgccaaacaaccacaagttgtccacgtaagtggctcagatagtgacacttttgatttctgatggttcaatgtataataactttgtttcatgcataaaattatttaaaatattgatatcattatcttcaggttatgtgtataaggtatatatgaaacataaaagcagttcttgtttagacttggatcccatctatctctattgtgtatatgcaaatattccaaaatc

SEQ ID NO: 566611 - DNA, 392 bp, Homo sapiens
taattcgggggttttttttttggcccctggggttttttttttttttttggcccaaaaaaatttggggtttttttaaaaaaccccgctttaagaaaaaaagaaaatttggtcatttaaaaaacccggggggaaaaaatttttttttaaggccccaaagggggtttttatttttttaaaaaattttttttaaaaaaaaaaaaattttaaaaaaaaagggaaaaaaggggcccaaaaattttttttttccccccccaaaagaaaattttccccccatttttttttttaaatggggaaaaaagacccaaggcccggttttccccaaaaaaaaaaaccttgggggggggaacttttttaaaaaaaaattttttaaaaaaaaacccccttaaaatttt

SEQ ID NO: 566612 - DNA, 673 bp, Homo sapiens
  misc_feature (190)..(190): n is a, c, g, or t
agtaaggataatggtgggtaaaatagatttaaaacaggaaaattggtggtaataaatttaaatgggagtattatatttattaaacttttatcaatggttagaaagtagggtattaaagattttaggaatgtaataatgatgtatgaaaaattatgtaataaaatgtttttatgtatttaagattattgcnttaggatagtctgtaagtgataagttgttaaaaaatgtatattttggttatcttcatgctctcttgatgcattagggggtagtaagatgaaatataaagtaaacatgcatataaataaaaagcataaagctaaaataagtaacctgatggtaataggtgaaagtggtaacctgttttaactttgaattcttgccgggtgaggtggctcacgcctgtaatcccagcactttgggaggctgaggcgggtggatcatgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaagcaac

SEQ ID NO: 566613 - DNA, 426 bp, Homo sapiens
tgtaacgctggcagtcccttctacgctgcgtcagtgtgcatgcccggattatcctgaattacattttccaggtagtacatgatatttatgattaagtaatataaattggtagtgatcacatcagtatgtaaaatgttcatgaaattagtgataacatgaaatttaactatgacctaagatatccagcttatgcatgacagtgattcatcataatccaagcataggatttaagtattaagtctgcaagtgaactgatcaataacacctacaccatgtacgagttttaacacagtaacctgaaaccagagacaaaaaataacctgatatactcttaacgatatcgagctctattacaccttaaaataatcaagcacaaaagaaaaacatctatagccccaaaaatgctttaaaaggtaatgcccaagt

SEQ ID NO: 566614 - DNA, 113 bp, Homo sapiens
caggagctaaccgatagccgacaggtctttgtgttgtatgatgatcctattgaggattgtccgcaactccttcacgctgatctccatgtcctcccctgtcgggctagtcgggg

SEQ ID NO: 566615 - DNA, 196 bp, Homo sapiens
ggagtagaaggtagtgcttgggaggctgagttaaaaatcccttagcccaggagtttgaagttgccgtaaggctatgagcactccactatactccagcctgcgcgacagtgagaccctgtagctaaaacctttttttgaatttttaaagggccaggcgcagtggctcactcctgtaatcccagcacttcgtgggcag

SEQ ID NO: 566616 - DNA, 192 bp, Homo sapiens
ctcaggccgtgcggccgatccctactatgcacataccgacagacgacgtgaacgaaacccctcaagcggcatttcggacacggcggaagcggggcaagccaggctggtttgcgcagtccccctgaattcactttgcctgcatcccctgaaacgattccctgaaagagagacccgccatgtccgccaacaaat

SEQ ID NO: 566617 - DNA, 116 bp, Homo sapiens
gaagaagaaatgatggagtggacctcctacaccgtcgcagttaagtccagcgacatcctgggagcaggcactgatgccagcgtgttcatcatcatcttcggggagtgatgctttga

SEQ ID NO: 566618 - DNA, 105 bp, Homo sapiens
gggcaaagcttaaacataagatctctcagttaagcatacacaatcatgctacaagctgagggcagttactacctctctcacaatgacaactagtgactcggctaa

SEQ ID NO: 566619 - DNA, 795 bp, Homo sapiens
taatggtcttcagctgcatccatggtgctgcaaaggacatgatttcattcttttttctggctgcatagtattccatcatgtatgtgtaccacattttctttattcagtccatactattgatggacacctgggttgactctatgtcttgctatgtgaatagtgctacaataaacatatgagtgcaggtatcttttggtagaatgatttatttttcttggttgtatacacagtaatgggattgctggttgagtgctaagtccatttttagttctttcagaaatcaacaaactgctttccacaggggctaactaacttacattcccaccaacaatgtataagtgttctctttcctctgcagcctcaccaacatcttttattttctaacttttgaataacagccatttgaatatgtgagaaggtatctcatagtggcttgattgcatctctctggtgattagtgattgagcatttttttcatgttgttggctgcttgtatatctcttttgagaactgttcaaacgtggactttggccactttgatgaggttattgttttgggtgttcaatagttagcatcttacgatctagatatatcctgggcagatggtagttaataattctttgtcaatgatggcgttatcgtggagtcctggataaactgggttaatagtccgggaatggttggggtgctggggtggtattgtggctggagattcagtctagtgggggtagaactaaaagggggagccgggggaaggggggcaagttgtgggcgggaggtgatgaagacggcttg

SEQ ID NO: 566620 - DNA, 104 bp, Homo sapiens
acggccgtgtattactgtgcaacaaactccctgctgtatagtgggagctactttgcttttgatatctggggccaagggacaatggtcaccgtctcttcagggag

SEQ ID NO: 566621 - DNA, 981 bp, Homo sapiens
  misc_feature (107)..(107): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (165)..(165): n is a, c, g, or t
  misc_feature (176)..(176): n is a, c, g, or t
  misc_feature (229)..(229): n is a, c, g, or t
  misc_feature (256)..(256): n is a, c, g, or t
  misc_feature (271)..(271): n is a, c, g, or t
  misc_feature (278)..(278): n is a, c, g, or t
  misc_feature (286)..(286): n is a, c, g, or t
  misc_feature (363)..(363): n is a, c, g, or t
  misc_feature (403)..(403): n is a, c, g, or t
  misc_feature (456)..(456): n is a, c, g, or t
  misc_feature (461)..(461): n is a, c, g, or t
  misc_feature (469)..(469): n is a, c, g, or t
  misc_feature (871)..(871): n is a, c, g, or t
  misc_feature (881)..(881): n is a, c, g, or t
  misc_feature (887)..(887): n is a, c, g, or t
  misc_feature (898)..(898): n is a, c, g, or t
  misc_feature (944)..(944): n is a, c, g, or t
  misc_feature (971)..(971): n is a, c, g, or t
gggacccaggtgtgtttcgcttgaaccttatcttgggtttctagccagtgaagggctggctcataagtaggcgctcaagaaattccgggagtcagttggtatctgtntaggggnaggncgtngctgttgagatgctcatattcagattgggactgtggaaggctnggggaggacangcaagtctgactgtaattgggcacatgagcttttctcacggcagccccattcngtttggggctccccatgtttcctaaangttctgttccccatngatggtngctgccgntcaccccaggttcccaaaggtgggggcctacccatgaccactgaagttctcaagagcttagcagctcctccagcccnggagaagaagccacaggtggcctacaagacggagatcatnggaggggtggtggtccacacacccatcagccagaacggtggggatgggcaggnagggngtgagccngggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccaccccagagaaacntcctttctgntccatntcaactcaganatgaattcctctcaagcaggcatgttttatttggtgatgtagcaancagcctggtcccgagatgcagctgaancccaggctgt

SEQ ID NO: 566622 - DNA, 570 bp, Homo sapiens
  misc_feature (29)..(29): n is a, c, g, or t
ctgaaaatgaatgcatcaaagagctaganaataagtcaagaatcacgtggtactaggcagcgtgaattttgaatctcttggttataaaacttctggttaggctgggagctgtggctcacacctgtaatcccagcactttaggaggtggaagtggatggatcacctgagatcaggagttcgagaccagcctggtcaacatggcaaaaccccatctctactaaaaatgcaaacattagccgggcatagtggtgcatgcctgtagtgccagctactcaggaggctgaggcgggagaatcacttgggaggcagaggctaccgtgagctgagatcgcgccactccactccaacctgggcgacagaaggagactctgtctcaaacaacaacaacaacaatttctggctaataattgcatattgtatatatgcgtgtgtgtgtgtgtgtgtgtactttctgtaacaaatgagctttgtataaatgtttgcaaatcttagtcgtgacttcagcatgaaagcttagtttattaagaaataatttccataaagaatcctttccaaataatcaaaaaaaaa

SEQ ID NO: 566623 - DNA, 867 bp, Homo sapiens
  misc_feature (107)..(107): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (165)..(165): n is a, c, g, or t
  misc_feature (176)..(176): n is a, c, g, or t
  misc_feature (229)..(229): n is a, c, g, or t
  misc_feature (256)..(256): n is a, c, g, or t
  misc_feature (271)..(271): n is a, c, g, or t
  misc_feature (278)..(278): n is a, c, g, or t
  misc_feature (286)..(286): n is a, c, g, or t
  misc_feature (363)..(363): n is a, c, g, or t
  misc_feature (403)..(403): n is a, c, g, or t
  misc_feature (456)..(456): n is a, c, g, or t
  misc_feature (461)..(461): n is a, c, g, or t
  misc_feature (469)..(469): n is a, c, g, or t
gggacccaggtgtgtttcgcttgaaccttatcttgggtttctagccagtgaagggctggctcataagtaggcgctcaagaaattccgggagtcagttggtatctgtntaggggnaggncgtngctgttgagatgctcatattcagattgggactgtggaaggctnggggaggacangcaagtctgactgtaattgggcacatgagcttttctcacggcagccccattcngtttggggctccccatgtttcctaaangttctgttccccatngatggtngctgccgntcaccccaggttcccaaaggtgggggcctacccatgaccactgaagttctcaagagcttagcagctcctccagcccnggagaagaagccacaggtggcctacaagacggagatcatnggaggggtggtggtccacacacccatcagccagaacggtggggatgggcaggnagggngtgagccngggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggtacaatgtacaatctgaagccatatcaagaaatttttatactcttacattaaaatccattggtcaattttgcactttga

SEQ ID NO: 566624 - DNA, 645 bp, Homo sapiens
ccggtgctcttcattcctgcattaccttgcttgcatctgggatattttttattcttgaagaattctgtttagtatttattttagtgcaggtatatttttaaaaacctttcttggtttttatttaactgaaaatatctttattttaacttttctttcaggcattttatcttcttatgcaagtctatgttggcacttcttttccttaagcacttggcagatgacattccattatcttctggttttcatcatttctattaaagttagggttgagagagaattctccatgggctcttgtgggtctgcacatcttttaagcaaaggaattgcctgcatttgttctggactgttttttaagaatgttgtggctgagcacagttgctcacacctgtaatcccagcactttggggggctgaggcaggcagatcacgaggtcaggagatcgagactatcctggctaacacggtgaaacgccatcctactaaaaatacaaaaacaaaattagccaggcgtggtggcgggcacctgtagacccagctactcgggggctgaggtgggaggattgcttgaacccaggaggcggaggttgcagtgagccgagatcgcaccactgcaatccagcctgggcaacagagcaggatctatctc

SEQ ID NO: 566625 - DNA, 335 bp, Homo sapiens
  misc_feature (225)..(225): n is a, c, g, or t
  misc_feature (235)..(235): n is a, c, g, or t
  misc_feature (241)..(241): n is a, c, g, or t
  misc_feature (252)..(252): n is a, c, g, or t
  misc_feature (298)..(298): n is a, c, g, or t
  misc_feature (325)..(325): n is a, c, g, or t
aaagctactggactagatgatttctgggatgctttctacccctaatggtgtaattttataaacttaatattgagtcagagacttggaagctgaaatcatagtgcctaaaaaatcttggtaagagccatggatgttttgcaggcagacagtccagaagacatgcacagctggattaaggagattggcgcagctgtccaggccctcaagtgccaccccagagaaacntcctttctgntccatntcaactcaganatgaattcctctcaagcaggcatgttttatttggtgatgtagcaancagcctggtcccgagatgcagctgaancccaggctgt

SEQ ID NO: 566626 - DNA, 907 bp, Homo sapiens
gtgcccccagacccctgttcctttggactctacttctgtgtgcagccaccatttggcctgctggggagagaacgagccgcgcaggtgtctctggagtgtcatccctaactggtctgggccccctgcagaacctgtcttcatatacgggcagtgtggcaccaattccacactgcagctatgttgtgtgacgcagcctggggcctctggcaggtggtaagtggtggccgacgcaagcaccaccctcgacagaaccctgagctgtcaactggagcctccctgctatcccctgtagcccagatgggggcctcgatcgtggtgctccctataggcaccagcattcagtattcgttcgttgcgccttgttctttacccaggctggcttgagtttgactagcacgcaacgtgtccggagtacggcagcgcaaagaccctttgtggcaagaccgatatcctccataactccttgagccggagtatctcttggcacacacacatccactcgattcgattgggatcctgcctacctctgagatgccaactagtttcaaggtccacgccgcatggaacgacacgctacgcaggacgtttgtgccaagtggctatgcactggcgcttcacgggtccaggcctttgtcctaggtcccagccggatcagcccgaaccacccttctgccgtcctgtcacgacgagactagactacctgttcagcgtagaggtgcgcccgtggtctggacgcctctcctccggggcaaaccggttccctggttagcggctggagcgtagccacattgtggccagggccctgacgtgccccttcaatgcaaggagcagtcacgtccatcgagcgatgcaatatgcaccgaggcgctcttccagctttggaccagctactgtggcggcatccctc

SEQ ID NO: 566627 - DNA, 299 bp, Homo sapiens
gcccctgggttttaagggaccccctgggtgggtttttgtcccttttaccccccccaccccagggagggggtgttatagtcccaaaggataagcaaaacctatttttggttgggtttcccagcccagacccagggacccttggccccaaggttagttttaagaaccgccccaccccctccggttccaaatttgggcctcccccccatagattgaaattcccctggccccagccctttcctgcctgggctggcttgggacccctcctttttgccagggggcaataaaagccggggccggga

SEQ ID NO: 566628 - DNA, 193 bp, Homo sapiens
atatataaccagttagctgccttcgcctattggtgttcttcctaatatctacgcattccaccgcttcactaggaattccgctaacctctttataattctattttgccaggatccaaagcggactgaagttgagcttcaacatttaactccagacttagcaaaaaacctacggacgctttacgcacaataattc

SEQ ID NO: 566629 - DNA, 165 bp, Homo sapiens
caaaaaaaaaattaaaattaaaattagtcaggggtagttgcacacatctgtagtcctagttgccttggaggtttaggtgggaggattgcttgagcccagcagtttgaggctgcagtgagttatgatcgtgctgctgtgacagaatgagtccctgtctctgaaatt

SEQ ID NO: 566630 - DNA, 155 bp, Homo sapiens
tcccgaagtatctgacaatttggaaatacgtcttgtcagaaaaactcacacttgggaacagaggtctcaaggacatatcttgtatttcaacatcaggtgaaaatcactgtatctgatcagcgtgcgtgtgtggtctgtgtaatctgtggtagaag

SEQ ID NO: 566631 - DNA, 724 bp, Homo sapiens
ttctaaccaaaaaaataaaccctcgtccacagaagctgccatcaagtatttcctcacgcaagcaacgatccataatccttctaatagctatcctcttcaacaatatactctcgggacaatgaaccatgaccaatactaccaatcaatactcatcattaataatcataatggctatagcaataaaataggaatagccccctttcacttctgagtcccagaggttacccaaggcacccctctgacatcggcctgttcttctcacatgacaaaaatagcccccatctcaatcatataccaaatctctccctcataaagtaagccttctcctcactctctcaatcttatccatcatagcaggcagttgaggtgattaaaccaaacccagtacgcaaaatcttagcatactcctcaattacccacataggatgaataatagcagttctaccgtacaacctaaataaccattcttaatttaactatttatattatcctagatataccgcattcctatatcaattaactccagcacagacctatatatatcgcactgaaaaaggtaaatgataacacccttaattcaatccacctctctacctaggaggctggcccgtaacggttttgccaaaatgggcattatcgaagaatcaaaaaaatagctataatcaataatagcaataactctttactttatttactaggtaattatcaatataatatcccattt

SEQ ID NO: 566632 - DNA, 408 bp, Homo sapiens
tattgatatcttttggacatgccgaaagtgaaggggtcgtaacatctacaactgcgtcagtgagctgcggtcacggagggtgaacattgtgcaaacagaggagcagtatgtgtttatccacgatgcgatccttgaagcctgtctttgtggggacacctctgtgcctgcttcccaagtaaggtctctgtattatgacatgaactaactggatccacatgacaaactcaagccagacttaagaggaattccggacgctaaacatggtgacaccaacgctgcgagatgaggactgcaggatcgcactgttgccgcggaaccataagaaaaaccggtgcacggacatcctgcacccagaatcgctgcctgcccttcctcatcaccatcgatgggaagagcagtatctacatt

SEQ ID NO: 566633 - DNA, 1028 bp, Homo sapiens
ataaatatggtgatgacaaagaaatcgacccttttcgtttttgtacttgttctggcttatttatgtgtgtaaaatttggtctcccgtttttactgcgttagtagtttgataatcatcgttccggggatctatcccttattcatgtgccgccattggcaaggccaagtttctacaccactgatcttacgccttccgcattcgcttcctaccggtaatgaggcttccaatttttccaagaataaggatccgggattttcaataccggtacgcttatcttggtaatacccaactgatggaccgactagctggcaatcctcttatgtcactatgttccgtgaatggaatcactctccatgaagaacctgtcgactggcgcgcagcacccgattcatggtagtctttaatttgggcttgtggatggatatcatcaaaatcattgttgagccgcatagttattgtggcaccctaagtacccattaagagcttgcactcgatttcagagccccgaatcctcatctataatacctgaaacttcctatcactaaacggatttcctgtgcttgttacattaccaaactgtcaagtgaacccgccgttatgtaaacgattgatttagtgtcgttacaacaataagtcacgggtgaagttcacagacagaaaaaagccctaagtttttcgacctgaaggccagaatgcagttggtagagctacagacacaaagaccaatacgctcttgagctatatggaagactgtgaaagagctggggaggttcatgctacgtatacggtggcttctacaatagctgctggctgttgtcactgagataaaagaactgatgggtcagaatcttctaccacgtttctggatacagtgaaatagctaacctctgtttcaagaatgcacgttattaagtcaaaggaacaatgtgcaattgatatgtttttagatgagagagacaaaattcaaagctaacaattaagcttgcaaagaagtattaataatcaccttctgcaacaattctaagttg

SEQ ID NO: 566634 - DNA, 1083 bp, Homo sapiens
  misc_feature (1028)..(1028): n is a, c, g, or t
tccgggcgtcgacctgtgggtcctggtcgtatgtgagtcgtcgttcctcgtatattggtgtgtaggtctgccccttgtgcttgtgctgggacccctctccgcgggtgtttggctctcgctgttgcctgcatgtagacgtcgctcccctggtggcgcgttggtgccccctgtgttgttctcgatcagcgggcctgtctctttgcacgttgtggccctgcgcccccttttttctcttgggcccgcggcccgggccttctggggatttggccccagaactcggactttgggcccccccacagccgggtggccccctgccatgggatgggccccccctgggtcatgacctttcgggccttggcagcccatgtctggttttttctttggttaaagctgggcctgcctccctgggaagatggggttctgagacccgtgtatccggtccgggacttggaccggagtccatgtctgctttttcctctgagccccgctgcctggagagggtctcgctgtccctggctggctcctaggggaaccagacccgtgacccccagaaagccttacccccatcccagggctggctctgccctaagagaaaattgccctaaatgaatctcgttccccaagaactacccccttttcagctgagccctggggactgttcccaagcccgtgaaatgtgaaggaaagtggggtccttcggggcgatgctccctcagcctcacgaggagctctaccctgctccctgctttggctgaggggcttgggaaaaaaacttggcaccttttttcgctgtggagtcttgccaccactttctgatcccgaggtgtacccctaaccacttttcccccgaggctcttggcctttgcactttattttatacccgtgcccttgctcggcgcccacccacccccctcaagccccacgcacgccctcaccacggccccgggagggaagtgtgagcgcccttggtatgacttaaaattggaaatgtcactctaacccacttaagtcatcatgtgtgaaccacnactaggacgtgtgtaaatatgtacctttgtctttttctccaaagtaaattgttta

SEQ ID NO: 566635 - DNA, 251 bp, Homo sapiens
  misc_feature (4)..(4): n is a, c, g, or t
  misc_feature (15)..(15): n is a, c, g, or t
  misc_feature (27)..(27): n is a, c, g, or t
  misc_feature (40)..(40): n is a, c, g, or t
  misc_feature (44)..(44): n is a, c, g, or t
  misc_feature (63)..(63): n is a, c, g, or t
  misc_feature (65)..(65): n is a, c, g, or t
  misc_feature (74)..(74): n is a, c, g, or t
  misc_feature (81)..(82): n is a, c, g, or t
  misc_feature (102)..(102): n is a, c, g, or t
  misc_feature (105)..(105): n is a, c, g, or t
  misc_feature (122)..(122): n is a, c, g, or t
  misc_feature (147)..(147): n is a, c, g, or t
  misc_feature (154)..(154): n is a, c, g, or t
  misc_feature (159)..(159): n is a, c, g, or t
  misc_feature (179)..(179): n is a, c, g, or t
  misc_feature (202)..(202): n is a, c, g, or t
  misc_feature (207)..(207): n is a, c, g, or t
  misc_feature (224)..(224): n is a, c, g, or t
  misc_feature (234)..(234): n is a, c, g, or t
cttngcaaaccccgnctttactcaatnccctacattctcntctntggtctctccccgggcttncntcatggccnctgaacnnatcacgttgtatgctatgcnccnactgtgatggaaaacgnaatgagtataacgtattttatatcngtattcngacgntatagagaatattctatgcntctatgacgtgcttactactgcngtgcntttgtcattagtcgtcntgttaatacngtacgtttatccgttgg

SEQ ID NO: 566636 - DNA, 807 bp, Homo sapiens
ggatttggctcagctccctctggccccggtcctgctgctggctgctcgtgtgctgcgcggcctccagtgcgggggtggtgatgtggctggctgccccccggcccattccccggtcccggacccgcctctgaggtacggtgcccccacgagagccgcagggcacccggaacccagggcttaccaggagcgacatattcagcagtctagctgatctggaccaacttcaagcatatcgcgcgcttcagcagcaacaatcgacctatcccatcaaccagacttacctgagatgtacgcagaccagagtctcatggccgtcctggtgggacgaacaggggccagcactaccttaaccatactagcagccttggcagagacccgaagagagcgagcgcttgcttggaggcccttcagccccaaccagaacccatcaggcccgtttcagctcagccgagacgcctcggcagagccaggataccgggctcgtgagccatctaacctagagctacatacagacgagacgccaccccgcataaccaatacctgggagaaaaacgaatccgcaatgacaccgcatagacagggaaatgtcagacctactatacgcagaagatcagagactaactgcgagacaaaccaaccccatgcaagcacttcggagatgacaaccgtggcatgataaacgataaaaggtatacaccatggcaatccaggacccattactacgccaagataatgccattaccaaacaccagaaggcccgaacataaaccgaaagacgcgaaacccattacacgatgacccaccaca

SEQ ID NO: 566637 - DNA, 413 bp, Homo sapiens
  misc_feature (60)..(61): n is a, c, g, or t
  misc_feature (78)..(78): n is a, c, g, or t
  misc_feature (84)..(85): n is a, c, g, or t
  misc_feature (90)..(90): n is a, c, g, or t
  misc_feature (116)..(117): n is a, c, g, or t
  misc_feature (135)..(135): n is a, c, g, or t
  misc_feature (137)..(137): n is a, c, g, or t
  misc_feature (143)..(143): n is a, c, g, or t
  misc_feature (151)..(151): n is a, c, g, or t
  misc_feature (315)..(315): n is a, c, g, or t
  misc_feature (413)..(413): n is a, c, g, or t
cccagcagccctcccgattggcgggcggggcggctataaagggagggcgcagggggcaanntactctaccgccgccantttaannccagntccatacaacgctccgccgccgctgnngccgcgacccggactgcncnccaganccccctgncgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgnctcgatttggggaagttgtagactgcacaagtgatgctgctagtgctgatgttttggaactgagagaacacagactggatggccaattgagagtcccn

SEQ ID NO: 566638 - DNA, 415 bp, Homo sapiens
atggtattttctactgtttgtagcattgtagaagtgggcgaccatctcatgattaggccctccgcttgcctgtagatggtgtataggaatgctagtgatttttgcacattgattttgtatcttgggacttggatgaagttgcttatgagcttaagaagctcttgagctgaaatgatggggttttctggatatagaatactgtcatctgcaaacaaagataatttgacttcctctcttcctgtttgaatacgctttatttttttctcttacctgattgccctgaccagaccttccaaaactatgttgaataggagtggtgggagagagcatcgtggtcttgtgctgcttttcaaagggaatgtttcaagcttttgcccattcagtatgatattggctgtgggtttgtcgtatgtgt

SEQ ID NO: 566639 - DNA, 707 bp, Homo sapiens
  misc_feature (496)..(496): n is a, c, g, or t
cttcctcgctgcggtcgtccctccgaccacagacttacagactggctcctcccctcccattacaacacatggggggttatttgcctaaatgtactatgctctctgccttgcaagtactaggggaaagcagtccccatgatgtacctcattcacgatgtatttgctgatgaactcgttgaccgtcatgagggtctgggaccattcctcatctgtgtacctcgaaccaacttccactgggacagttcggcagccagcgatctcctggatatactccaaactagcaggacacacattggcatcgtcactgctaatatctgttgggcatagtactaagtgtgctttgcatgtggtcccctttcatcctcggccggcatggagaggtggggctccctgctcaaggctgtgtggctcatacacagtgctgtgcagctttgcagacagggccggtaagtctggttggctgggctgctctagttccctgcttgccaacagcctnctcacttctttctttgctcattttgtcactaagctgagaacctttgaacaaatagcggacagcgtggcaggtggcagtctcctggactctgccctctagcctgggactgattccaggcctcatcagttacaggccaggggatctgaggcaggttactgaacccgagtccttgatccccatttacagaatgggggtgatgacaacacctgtc

SEQ ID NO: 566640 - DNA, 354 bp, Homo sapiens
gagcctgccgccgtcccggtccatgcgcccgcccgcccatccggtgcctcctgcagaccgactgctgggacagggccggcgcggcccggccatggagtcctacgacatcatcgccaaccagcctgtgtgtcatcgacaactgtgttcgggggtgattaaagctggctttgcaggagaccatgattcccaaatacttgtttcccaagactaatgtcgtgtgctggcctgaagtcacatgctgggtgatggctgtgagcccatggagtgggtgacctcttcatctggaccaaaagcagatggagcaccgggttgctgctgaccatccgctaccccatggagcacggcgtggtgcga

SEQ ID NO: 566641 - DNA, 304 bp, Homo sapiens
  misc_feature (15)..(15): n is a, c, g, or t
  misc_feature (18)..(18): n is a, c, g, or t
  misc_feature (26)..(26): n is a, c, g, or t
  misc_feature (31)..(31): n is a, c, g, or t
  misc_feature (36)..(36): n is a, c, g, or t
  misc_feature (45)..(46): n is a, c, g, or t
  misc_feature (80)..(81): n is a, c, g, or t
  misc_feature (109)..(109): n is a, c, g, or t
  misc_feature (115)..(115): n is a, c, g, or t
  misc_feature (118)..(118): n is a, c, g, or t
  misc_feature (134)..(135): n is a, c, g, or t
  misc_feature (271)..(271): n is a, c, g, or t
  misc_feature (278)..(278): n is a, c, g, or t
  misc_feature (288)..(290): n is a, c, g, or t
gttgtgccggcgcantanatatagtnccgcnggggngagatgagnngaattataaccaagcatcatatagcaaggactannccctataccttctgcatcatgaatgaantagaantanctttgcaaggatagcnnaagctaatacccccgtaatccagacgagctacctaagaacagcttagagagcacatcccgtctatgttccaccaatagctgggaagattctataggtagaggcgacgaaacctaccgtagcctggttcatagtctngttgctntgtataatannntagttcaactttaa

SEQ ID NO: 566642 - DNA, 114 bp, Homo sapiens
tcgagctcagcccacatttacatctgcttagagaccaagcctggcaacaattatgacatcctgtctactgcatagagtatgacaaatagtgtctactatcctcaaaccttccaa

SEQ ID NO: 566643 - DNA, 401 bp, Homo sapiens
atattcagaacctacaaagaactcaaacaaaatttcaagagaaaaacaaacaacccagtcgaaaagtgggtgaagttccccttcctgtgtccatgtgttttcattgttcaattcccgcctatgagcgagaacatgcagtgtttggttttttgtccttgcgatagtttgctgagaatgatggtttccagcttcatccctgtccctacaaaggacatgaactcatcatgtggggtggggggaggggggagggatagcattaggagatatacctaatgttaaatgatgagttgatgggtgcagcaccccaacatgtcatatgtatacatatgtaacaaacctgcacgttgtgcacatgtaccctaaaatttaaagtataataaaaaaagtgggtgaagatatga

SEQ ID NO: 566644 - DNA, 1106 bp, Homo sapiens
agtgagcagcagagattgagagattgagagagagagagagagatagacggagatctctggaggcagacctcaaggatgacttctatttctatctggtatctcgatcatgggggggccctggccgggcagaccccccaacacttctcctgccctgaaacactggcctctagccaacctgctccgctgcttcacctgcgagcgatctctgcgggggctgcacggcgccagaccccatccagcaccaccagggcattgatccatccagcccagtcgatagccacagtctgtcggacccccgagtacacgggaccctgacactaggacatacccacaacccaaagacctttacctggaaggctaattctagcaccacgagtaggtcacctgcaacttaaccagactagtggtaccaacctagcccactggacaccgaccctagggacgcaaaagaccgaaccggcattgcaggcctataatttattacccaaaggatcccatttacccaaaggggcgcaaggacccagtgggaacaccggaagggcccttaacaccgtggatatagaaaacagcttaactcgggatggaggtttcccaaagcagattggagagaattatgccaagaggaagaaccaccaaaggaccttgcgaaaaaccaaaggaagtgggatcacatgacgattatggaacctattacaaactgcggcgacgtgaaacctataacccaacacattaacaccggcgagaactaaccgaccgcactcgggcaagcacaccacttggtggctgacgccagaaggacattgggaaacggcacaaggccacatcgagtcccaacgacagaaaacacccgccacccacaacacccataggcaggcggaacccacaagggggcgacacaagaaacctcaaaattaggcaaacaggggcccacaatcgggagccagagaattgaacgggggaaacgagccaacaaccggacaaagcgccacgcccacaagggcaacaaagacgaggttaagcagcacaaaacggtggggccaaacaaccgggcgcggacaaacacaaaacggagtacacacggaccaagttaacaacacagctagtgg

SEQ ID NO: 566645 - DNA, 868 bp, Homo sapiens
ggagacggcagatactgtgtctgtggtatctacccgtcagtagcacttggggtagccggtaagaaataaagatcgagggaacagtgactagtgcaggataatgcacgaaatgaagggaccaggtccctggatctagcgtagccctgtatagaggattcaaccataggtgatcgagttgaatcggcgaatagattattatatatgggtagcataggttatggagggaattgagagtgctacagcacccaggagtgatgaggtcttaacaaaaccctacctgtggcgatagtgaaatggcagtcacttaaaaagaccttggtcaccgaaaaagctcggtgaccgtaacaatacgtgctgcttcttaaatggaacgctggtaaggagggtcaaggggcatgtgctgtggtcgaattcaacgatgtgacgggaggaggcatgacaactaaagctgggggtagttcctaaaacaagcagttgtctgggaccggatagaccactgatacgtcggaagaagatcctgatggtgaacatgccacgagagcaattgcaaaaggtgatggcttacgcaccgatcgcggatgggggagggagcatgtgacccaagtattgagttcctatccgcaccacaagtatccttatataaatcgcggggtgcgggaaagagattattcacgcatgacctgcctgcggacgtgggacgacagcacttgttgtggcaatcggtctgatcagctgccggtggttaaaacagcgcccctcaggacactgtgaacacaccggcctatagggcgacaaacgatatgtgcccagaccattgagaggcagcgccaaaaaccaacaaaacacgtgggcgcgcgcaacaataacg

SEQ ID NO: 566646 - DNA, 301 bp, Homo sapiens
ggtcagaagtgaccagtgctttactcacaaagggaaggacagacttgggtaaggagagctggaggggaaggaagaagacccaactccagtggttagtgagagctctgctagcgtcgtgttgaagtttggtcctctttgaagtggacacagtcttccagggcagatcttcttaggctctggttgtggtgagctcgtctcttacattgtgcttacttagatcaatgccttttcagtgtttgtttaaatcaacaagtgttttcctggatgcctacagagctggaacctaaggtcccctaaacat

SEQ ID NO: 566647 - DNA, 169 bp, Homo sapiens
atgaattagaggatccgggcggccctcacgctggtgctcccaggagctgaggttccatgaacagagccaggtatcccaagaggcctccagaaacctgcaggtgccctgagaggggaggccttgccatagcaccagtgagtgtatgaggtcagctggagggggccgcgcg

SEQ ID NO: 566648 - DNA, 789 bp, Homo sapiens
  misc_feature (332)..(332): n is a, c, g, or t
  misc_feature (436)..(436): n is a, c, g, or t
  misc_feature (758)..(758): n is a, c, g, or t
  misc_feature (765)..(765): n is a, c, g, or t
  misc_feature (784)..(784): n is a, c, g, or t
gggggaactgaagccccagcaggtggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaaagcggtccaacatttggctggcnagcagtcaccaagcagaatgtcaacgctgccatggtcttccgaattcctctatacagatgtgtgacgtgatggctgcctactttggcaagatcagcgcaggaanaactatccgagaacaattttgtgctcaatatatgagctgctggatgagattctagactttggctacccacagaattccgagacaggcgcgctgaaaaccttcatcacgcagcaggggcatcaagagtcagcatcagaaaaagaagagcagtcacagatcaccagccaggtaactgggcagattggctggcggcgagagggtatcaagtatcgtcggaatgagctcttcctggatgtgctggagagtgtgaacctggtcatgtccccacaagggcaggtgctgagtggccatgtgtcgggccgggtggtgatgaagagctacngagtggntgctgaatgcaagttgggntgaat

SEQ ID NO: 566649 - DNA, 296 bp, Homo sapiens
  misc_feature (240)..(240): n is a, c, g, or t
  misc_feature (257)..(257): n is a, c, g, or t
  misc_feature (284)..(284): n is a, c, g, or t
  misc_feature (291)..(291): n is a, c, g, or t
tgtgtttttagcagaaacggggtttcaccgtgttagccaggatggtctcgatcgcctgacctcgtgatccgcccgcctcggcctcccaaagtgctggaattacaggcgtgacacttgcgcccggccgagaaacctatttttgatgtttatatttgggatacttgctcttgggagccccacctgccctgctggggagggtgctggggaacacctggggagaagccatgttgcagctgtgtnggccaagcaatcccagntttgtttcccaagccagctgccagacntgggganttaag

SEQ ID NO: 566650 - DNA, 164 bp, Homo sapiens
  misc_feature (1)..(1): n is a, c, g, or t
ngaagtgatcgcgtcgcgcatcctaagaaatagactggtccagtgtagtaatgccgcagagcggcggaccttgtcctggccgcccacatcccatacgttgaacttgacatttttgtaagtcaccgtctccacgttgaaacccacagtgtgaatggtgctcaccg

SEQ ID NO: 566651 - DNA, 536 bp, Homo sapiens
gcacgcttcggggtctccgtggaagtcgcggagccttcggatgtggcggatgctgccgtgagccggcgggggtagttcgtccagatccagctggtgcgcctcgcctgacgtttgaagcgagcgaggctggctctagactcctcccgttttgtcgcgtcgattacttcgaggacttgcaacagggcgcgcatcggatgctgggtgcgtgacgtccacgtgtaactcagatcgccagagtagcacaggagtggtccatcgctcacagcgaggtcagtagcaagcggtgtgaactcagtcctgttgtcagagcctcgcagcaccgatgaacctccaaggaagcgtggtgaagctctggtggctgtgctcgtgctgagtgacgcgtcttgactggccgtgggtggactgcaatgccgcaagcgctgtcagctccgtgcacggggcgagccggcgtgggcccttcgcgttctagagccttggagcaggcctcataggggcccgggttggcactggcgttgtctggtgtggcgtggctcttg

SEQ ID NO: 566652 - DNA, 410 bp, Homo sapiens
caataccgaaaatgaaggttctgggctgacaaacatcaagacggaagagatctcggaagtgaagatggatgcagaattcggacatgattcaggatttgaagtccgccatcaaaaactggtgttctttgctgaagatgtgggttcgaacaaaggcgccatcatcggactcatggtgggcggcgttgtcatagcaaccgtgattgtcatcaccctggtgatgttgaagaagaaacagtacacatccatccatcatggcgtggtggaggtcgacgccgccgtgaccccagaggagcgccatctctccaagatgcagcagaacggatatgagaatccaactttacaagttctttgaagccaaatgcagaactaagcccccacccgcgccacagcagcggcctctgaacttggac

SEQ ID NO: 566653 - DNA, 162 bp, Homo sapiens
  misc_feature (30)..(30): n is a, c, g, or t
  misc_feature (88)..(88): n is a, c, g, or t
  misc_feature (108)..(108): n is a, c, g, or t
  misc_feature (148)..(148): n is a, c, g, or t
  misc_feature (156)..(156): n is a, c, g, or t
ccagtctgggctctgtgctgtgcggtaacnccggtggagatcccggcagaagaaactctgtggaaataagattaaacccgaggagtantaagacggccaagggataantaactcgacttcggagcgtctgcaggaattagagccagcntgccaccntccccc

SEQ ID NO: 566654 - DNA, 148 bp, Homo sapiens
atcatctcaacacgatccctacagagaagagacgagatgaggaggacgaatactattatacttataatcccttttctgatgacaacattctggaacacagatctaaaataatccatgctgttcttcgtattcaacatttctatctccc

SEQ ID NO: 566655 - DNA, 329 bp, Homo sapiens
ccggtaaatgtagatactgtgaaagaaggcctggagccaggcttgttcttatggtccactgttcttttgtgttaagccctgaagatgctattgttgggagggaagcgccaggatcaaagggttccgctgagaaggttgagtaggcagaggatggtgcaacaggagaaatcctgctagcctgtgcatatcactccctccacgaatataagacaggaattccttgcacccctcggtccatgcaaaacaaggcttatcctgtagggcaatctcagggcacctggtgagggtcaaacaggaccactccaggggtaaactggttagcaggtaag

SEQ ID NO: 566656 - DNA, 1034 bp, Homo sapiens
  misc_feature (1033)..(1034): n is a, c, g, or t
gcggagactcgctgcagcagcggagggggagctgtgcagagccgtgcggcctcacagtcctggagcccggcgtgccgtgtcgtatggaacatgcactttgtccattcccgaaaacgagtcccgcagtggggacagtggggctccgctacgtggcctataacattcacgtgaatggagtcctgcactgtctgggtgagctacagccagttcctggggctgtacgagcaggtgggactagcatctctgaccttgagacagcttcaagtcccttccctagcacgtgtgacatcagtgtctccctttaccctgctctatcttgtacccgtaggctgtagttcccctttaatcactgcacgaggttcggcaagacccatagcttgggagcaggagactttcaacagtattcctgcgtctggcacaaacatggagacacagcaggtccccacagagggaacgtgtccttggaaagtgtgctcagcaaagggcagaaagttctggtcaaagtgctaacttcagatcagactgaggatgtctggaggctgtaagctgcaaagctggatcttccatcatgacttgattggatactttagtctattcttagttcgagaaaaaggaggatggggctttctttgtgtactggaattgagagtttgaggtgcttatgtgtctgtcaccaggcttggagtcaagagtataaggatgtggctaagggagagttattgggactctgcttatgatgacggatgtcaatggaaaaccggggttggcttgaaccatggtatatgacaaaggactacatatggacgaggtggattgggagcatggcaagatcggagcagcttgtgaccagaattcagagtatctgagtggcaatcatgagaagagaaagtgatagagttgtgttccaaaagtgttgtagggacagagaaacgacacgtaactgtagagaacaatgttatagtaagaaatggaaatttaatgaaaagagggatagtatatatagatatcctattttgtgtttctgcttttttgnn

SEQ ID NO: 566657 - DNA, 768 bp, Homo sapiens
agcggagtgcggctctgggctggacgaatggttggcgctgcgatcccgcaggtcagagacgcgactctggtgcgggtcgtcttcttccccccgatctgggcgtgcgctgacccgcattgacctgtgaggctgactgcttgtgtcgtgcttggtgcttgtgcgcgctgatcctgctcttcggtgcacgcctgcgtgcagcttcctgacgggctgactggcgagcctgacgctactatgggccgagtgtcagcggactacgcccacactgtgatgctgactgcatagtggtgcgctgtgagcgtgagcatggacgcctccagtggacacttggtgaggagctggacttaccacgttgtctaaactaggagttttctcttgtgctgtctgccagactgattgcatgagctgcacaggcgtgaactcgaagatgcctagacgaatggcacagtttagcatagaacataggatactagctttgtttatgcacccgttgactctgatcgacactggttccccttgaacgcggttaccaacatctgttctccagggagctctggcatgaatcgacattactggtcaacaaatgggtggaactgtcccagccgttctctgtgccatggcattacccagcttggcatgtctacatgaaagctaatagaggcttaattactttgcggacgcgtgtcctttgacagaatgtgttctgcctcacatgatcgaacaggaatcaaggcacagatggtcctgtgaatcacatcctgcgtatca

SEQ ID NO: 566658 - DNA, 136 bp, Homo sapiens
agaggatcccatcaggtgaagtattgtggatggtcagaagatcatggagctttcaatgctctcgggggagcatacagactcacctccaatcccctggcctcccatgactacatccttgaggattgtgcccaaagtc

SEQ ID NO: 566659 - DNA, 259 bp, Homo sapiens
ctgtggctagctggcattttaatccatttctggtaatggctgaatgaacaatatgagcccttaataaaggaatggaccaggtgcaggggcttcatgcctgtcatcctagcactttggggaggatgaggcggtaggatcactcaagcccaggagttggagaccagccggggcaacatagtgagaccccatctctacaaaaaactaggccaggagcaggggctaacacccgtaatcccaactactctcagggccaaggtgg

SEQ ID NO: 566660 - DNA, 153 bp, Homo sapiens
gcctggttctaggaataatggggtgcagtatgtaggagttgaagattagtccgccggagtcgtggtgtactcgtaggttcagtaccagttggtggccaactcgatcttgatggtaagcggagaggatcggttgcacctctggtctgtgattgt

SEQ ID NO: 566661 - DNA, 963 bp, Homo sapiens
tgcgcagccccaaggacgaggcgcgcgtggtgacacaaagagccaccgccagaaggtggggttacaaacgcccgacgactcgcgacacatagtacaactgtcggtgttgtgaaaagcgctcccaccaggtgcggcattgccaaaaaaacaagtggtcccaacaagagtggtgcctcccaccagccagccggtgtgccgcgccaaggacgcagggcggtaggcacgacggcagtgacgaaagttgtgtcccgccgcgcggaaatacatgccatagcccgccgcatgggctccgctgcgtcaaaacgggggggtgaaccgctccaaagattgatggggacgcacctcgtctgtgccataacgcaaaagctgtcttgggagatttttcttgggctagatgaacccaaacaagggggcgctcaggcttattacccaagaattagtttgaaacgagcggtccttacaatagttcggccgaggaattaactgcgcgcggcgcgcgtctaaagagaggagtggcgtgtggcaacacgtcttcttaaaacagagccctccatcttcaatgaaaatactgtatagaaacgactccactacctatataaggttttcgcccgaatcctcgctctccgaacctgggagccccggactaattaacagcggagagccgctcattgggcggggctccacacacacgaaccacctttatgtgcaaagatcggacgcacacatttttctcagaacaatactattaggaaagagaatgtgttgtacaatactgacacgcaagcacggtaggatggaggtcgactcggtgtcactgccggaataatacccccacaactctcctatggggagcgggcgcacaagtgggataccccgtggtaggcaataggggcgtatcgacgacacaccgtgccaaccattgtggcaccccccttttgtcagaaaaaaacccaacaagacaga

SEQ ID NO: 566662 - DNA, 1043 bp, Homo sapiens
ggtgggaccagtcgaaagcccactgcgggtcggacttcggctacagcggtagacagggatgatatccaggaccatatcctctgggctctgaaggggatgactttgaggtacaagaagaaggatgacgtggtcctagagtgaagcagtcaaagtggcaggaatagtcaagccgaggcttgctcgttagatcgaacccatgggatggcaattgaatcaaccaacatggcctcttgtggacaagggggaggacgcgcacctgttcgtaagaacacactgccaattctatgatggcgaggagtctttgctacatcattgatgcctagcttgaaggtcaacctgggacgcgctagactcaagccagcagttgcagccctcgaaactgttatgtccagaatgtacttgcgtggatacccagtgatcttcgcttcccctgggtggtcttctttgccagcgaaatgaatccgggctgggacagaacttacttgggactacaactacgaggtgggcagatgtggaaggcaaggagctactctgttgctgtggggccattgaatgcagaggacgtcttctttaagaggacagaccttcttcccaacccttcttgaatctgtcgtttcctcaggaactgggtcttcctgattgttgaagcctgacccgaagtctctgggctagctactccccccagatcctagttgatagaacatggggggttctggaccagatgatcccttccaagtgttggtgctagcaggcaggatctcttctcctactccaaaggccttacagggtggggagagatcacaatctaagctcggactgagatcctaccagtccatattggccctaagcggtccctggcgctcttagcagaactttgggctcttagacagagaccctgggtatctactatctcccagatgggattatgtctggacagcctttcaccaattcggactggagtcacaaagaacaggacacactcggacaaggctccacatctcaacccagcggcaaacgggcaaaggacccctataaagacccag

SEQ ID NO: 566663 - DNA, 779 bp, Homo sapiens
ggaagtttggcctttaaaaatcaaactgccatggacactgctttacccaaaattttggttcacattcttcactggattaactattggggcaaacaacgtataaccatgtaaaaccagtacgcttgtattggcatttcatggctagagttctaaggtaaaattattggattttcgtttgtgtgtgtgtctacttgtatgtgtctatttgtatgtacacttattgttacatgttgtgtctaccaaactggcttataagtaaaagagcactcatacgttaggtgaaaaagtccaagcaattttcaagttcacgtgacttatgtaaatctttactaaacaaaccggctttaaaattattggtagaatgaaattgtcagcatacatttttgtttgggttttatatatgtctctgctagatattttgaggtttcagtgtttggcatagaaggttataaagctgttaatctagccaaaacaaaatgattttggtatgccttctttgacagatgagactaatttaatgttgttaggtgaatcttctgagttattggaaaaatatctatgtatttaactttgagcctcttattaggtgagcacctgatgttccactgggtattaagaaaatggttgggccaggcgcagtggtcacacctgttaatccccacactttggggaggccgagtgggcggattggtgaacctcaagagttcgagacagtctgggcaaaaacggtgaaaccccattctacttaaaaaaaaaccccacacaatttcccgcgctgg

SEQ ID NO: 566664 - DNA, 626 bp, Homo sapiens
  misc_feature (553)..(553): n is a, c, g, or t
gaggtgtatgttggcaaggatatacagtgcgagatgttctcttcagagggcatgtataactgggtgtcttgaaatccgagcagttcctaagaaggcattaagggagcccttgtggactataccagtgacagtgctgaaaagcgcagggtacaggagctgtgcagtacatgagggggagacgataatagccgattagtacgagatgcctgtgccggctggttggatctcctcctcgcattcccttcttgccaggcaccaatcagtctccggctcgaacatcttcctaaaattcaaaccagaccatattcgtgtgcaagctcatgtggatgttcacccaggaaagctccattttgtcttcacgatggggggatttctgtctactgccacaacagaggttctgcggaagggagtatgtacaggcgggctgggcttgtgggttgcttcagttcgtcagccaaacatacatgcttcccatgaagacagcgggaaagccctgggtcctaagatatccatctctcctcgaacgacaaattctttccacttaccagatganccctcaatccccatcataagggtgggtccaggacacggtatagccccgtttaatgggttcctacaacatagag

SEQ ID NO: 566665 - DNA, 283 bp, Homo sapiens
ctcgtataaggaacgcagtaggctatgtgttcctgtagcgagtctctcgtatatgagatatagatagtgatcttgtaccatatgccgtctacaaacagagtactgcggcgagtactgtttaccgcagctctgattcgcttctccttgtccttggtttgaaacaaaagtggagtccgaaaagagatatctttactataaaagctagtgtgtaagctagtcatattaagttgttggctcaggagtctgataagttcttgggcagacaggtgcagcgtagaatatt

SEQ ID NO: 566666 - DNA, 151 bp, Homo sapiens
gctcgacaagacaactcatggcctcctttggccccgcatgacctgggtacattttgcaaaccacaggtttgcaatgttacacaagggccaaaggagggcatgagttgctttggttgtggggacagagggtaactgttcatgaaaatagtga

SEQ ID NO: 566667 - DNA, 452 bp, Homo sapiens
tgagacatagtctcgctctgtagcccagcttgaagtccagtgtggcacaatataagctcactgcaaccttcacctcccaggttcaacgatttctctgcctcaagcctctcaagtagctgcgactacaggtgcccccccccacacctggctaatttttgtattttaagtagagatggggtttcaccttgttggccaggctggtctcaaacccctgcccccaagtgatccccctgcccaaccctcccaaggtgttggaattcaagcctgccctaacagggtagggtttttaggttcatgttaatgccggaagtttcagtaattcccccccattcgttgttaagaagccctgcaacacatgaaggaagctatttggggatcttttcccctgttaatgggtgtctgacctgttcccagttttgggttgttacaaataaagcctttgtaacccccgt

SEQ ID NO: 566668 - DNA, 268 bp, Homo sapiens
ctaggccggagtcaattaggaggactgagaggacccctgttagggttcatgggctggtttttactatataataggcatgtaattggtggtcattatgttttgtcgtgcaggtagaggcttactagaggtgtgaaaacgtaggcttggattaaggcgacagtattttctaggatagtcagtagatttagattcgtgaagatgataagtctagagggaaggtcaatggtcgatattgctaggctcgcgctcccaatcaggtcataagagg

SEQ ID NO: 566669 - DNA, 299 bp, Homo sapiens
agggaaaaaacggttttttggggggcagtccccccaagaaaaaaaattttgccccccaaaaaaaacccgggttttttataaaattccgggcccataaagggctgaataaacctgacccaaccaatgggggggaaaactaaacccccccctgcttttgggaaaaaaaacccccccccccctaattttgggcatttgctgtccccccaactgaaaaaataaggggggctttttacgggggggcttcacctccccccccctttaaatccaggggaatttcatcaccccccggaaacagtttt

SEQ ID NO: 566670 - DNA, 351 bp, Homo sapiens
  misc_feature (340)..(340): n is a, c, g, or t
gaagattagccccaagcggtgggccgggagcggtgtggtcaccacacaggggttaaacaagcacgggttttgggggctgcacaggccgggctggcaacccgggatctgccaacggggggattttggtctggtgaatggtcctgattctcagcctcagtttccatatctgtagagagggaataacaataaaactcacctcacagaatttttttttttttttaagacagagttccactctggtctcccaggctgggagtgcaggggggtgatctgggctcactggaaatttccacctccgggatccaggcaattctccgtgctcagcctccccagtagtggngactaccaggc

SEQ ID NO: 566671 - DNA, 139 bp, Homo sapiens
cgaccctaaagccaaacaccccgacatacatttcacctccatttattctgtatctttacatttcccatctgctatagaccagacccctctagcctctcacgcgcaggcaactgcagcagtctcctaaaggagcaactcg

SEQ ID NO: 566672 - DNA, 124 bp, Homo sapiens
acaactgctcaagcgatgagacctctgtgtctttcttcttcgtaggcctcctaagatgggtgagagctctgccaagtgacggttgcgggccggcgcaagctaaatctcctccctgtgcggcccg

SEQ ID NO: 566673 - DNA, 907 bp, Homo sapiens
tgagaaagagggggtgggggttgttggggggccgccccctttggggaaaaggtgggtgtctttgggggttcggccgggaatcgggacctgtgggttcggcacagggggggggtaactcgcgtgggttaagtgtgcggcgccccacggaccggagagggggcccttgtctcgcgcccgcgagtgtttagttgtggaaacacaagtgggtggccgagggcgcgccgccgaggttggagcgaacccgggagaccccacgcggtcccgattccacgagccatggggggaataaggattatggagcctattgggggagctttcggatgcctttgatggcgccggatcatgagagatgtttggtgctggaggccaggtatggtcggcccaatctgtgcgtgatccatcgagtttggagtcccacgggagactttccttgaacgcccgctgcagaaaagtggcgtgattcttaagagagctggagtcttaaattgggccacccaacccggggaatttgcctgtaagatttttgatggcgcgccatgcaccagatagttggcttattgtataaaatacaagttcaagaaaataatgtatggattggtaatgatgtccattctacaagtatatggatacaaaaatatgagtgaccctccataagcaattagtgcagctccacttttaagatcaccacgaagaaatttggatgtttgttaaagtgcgccatttacttcgcacccaagttcacccaagggaaagtggttgaagcttctctatatttctgcgtgagccttttgttaaatattaaaatggtttagatagtggtataagaaagccttttttatgacttattttgatcatttttttcctcatttaaaaaattgaattaaatctgtttgattccgttttccta

SEQ ID NO: 566674 - DNA, 616 bp, Homo sapiens
agcggtgtgacagtagttgaacaactttaagtggctctaagaagtttcctatttgaggctgggtgccatggctcacgacttataatcccagcacatttggggagtacccgtacgatgggcgtactcactttgaggatcgggagttcgacgaccagacctggtccaaacgaaacgcccatctctacctaagatagcataagcattagccgggcgtggttgcgaacatgactgtgatcccgagcctaatcagaagcgctgatggaacggagcaagttgacttgagacacaacacgggtgcgtagagtaagaggagtagaggccacgagatcagccgcatccgtggctctcgcaggcctgggctgaccgtgaggcgagcactcgcatctgcgtccgcacagcaaaactcattcgcctgcatcactctcaccttgcattggtgggatgggctagagtacggtgtctcatagtatccctggaacgcactgaactgctggataggttgtgtctgaataggccttgatcgaccggcaacgcgagtgggactaatggggcaaatactggatctcccaagtggacgtactgtggccggcatcggctagaatgctgttagacaggt

SEQ ID NO: 566675 - DNA, 271 bp, Homo sapiens
  misc_feature (190)..(190): n is a, c, g, or t
gtgatctagaggatctttgagtgcatggttgatttgcgttacgtatagctcaacctcccaagtagctgggattagaggtccccaccaccatgcctgtttaattttttgtactttcagtagaaacggggttttgccatgttggccaggctgttctcgaactcctgagctcaggtgatccaactgtctcggnctcccaaagtgctgggattacaggcgtgagccactgtgcctagcatgagccactgtgcctagcatgagccatgcactccgg

SEQ ID NO: 566676 - DNA, 357 bp, Homo sapiens
gttcaacagatcccccagttcctgcagtgctgtaagggatttctttccctatactgatacagtattttctctgctgtttatacagacagtatcaaaaggctaaagagaaatcctgcctttctggtcctgctattcactcctctcgacctaatctatcctccctgtttcttatacctgagccaacattaattagagaagaggaacgactaaaccgtcagtgctccttttatcatctcttgttggctccattatactttccacgagcccgagtgtctctgatccttgtatgtcatccttcaggcctcaaccggctacttgccctctacctgctgaagtttctgcatcattttcatggga

SEQ ID NO: 566677 - DNA, 504 bp, Homo sapiens
agcgggctgggctcgtgtggacgtgagcatgggccactcgagcttcatctcccggcgccacctcgagatcttcacgcccccgggcggcggcggccatggcggggccgctccggagctgccgtccgcgcagcccaggcccgacgccggcggcgacttctacctgcgctgcttgtggcaagaacggggtatacgtggacggcgtgttccagaggcgcggggcgccgccgctgcagctgccgcgcgtgtgcacacttcacggttcccgcagcacaaagcatcaacgatacacgttcactgccctgtccagcgagaagagagagaagcaggaggcgtctgacgtctccagtgcaagggacagtacagaccacacaatcatcgaccacctgaacccactcaacacttcacaacacacacatacggaccacaatcatacaccacatgaacccaaccacacaccccgcaacaaaccagagactacacactcataaccctcacccacccacg

SEQ ID NO: 566678 - DNA, 682 bp, Homo sapiens
tcattcgttttatggggacatttattacaggaacttccgggtcaattttcctttcgcacagacaccaaggtgcccaccccttgtccacgcccccttcctcccagggtggggtggccgtggtggggggcgctcaataattaccttctgtggaaacgagttccggtgcagtggcttgagacttcccagccaatgtgaccgtggcccggccatttttctttatgcgtggttatttttttccgtgcatagggtttggccgtgcacagcttgataggactctgtgtcatgggagtgcgtgccacgtgaaaaacgtgattcaaaagccatatgcgtgctcagtggtttcctaagtactctcacacctttaaagtgggggatagggaggggaaggtctcacaaaaggcagtgggcttctgcgtggttccgggccaaggcgagcaagggaggatccagaaaaactgggccccaaggggctctgaattctcggaggagctaggtgggagccacaggcccggaccaccaggtttcgggatttcttcaggatgacgtgggaggctgtcactcgaagtagaggacggagatggcattgagctgcgttgggcgcacagcagggctggggccaccggttccgggtggatgaagtggaccagcgtctgcacaatggcgtggatagggggcgtcatgg

SEQ ID NO: 566679 - DNA, 300 bp, Homo sapiens
attgaaaaaccctccgacatatcaaacctatgggatacagcaaaagcagtaccaagagggaaattcgtagcttaagtgcctacatcaaaaaagaagaaagacctcaaataaacaacttaatgatgcctcttaaagaactagaaaagcaagagcaaaccaaacccaaaatagttagaagaaagaagaattaatgagattcatagcgaaaataagatgtatacacgacccagaaagagctcagaaggacagaaggtacggggataatagcacaaaaacaaccccgaaaatgaggtctcaccg

SEQ ID NO: 566680 - DNA, 242 bp, Homo sapiens
ctcaatcagtcactgaccagtagctggcaatgtactgaagtattcacaatctggcagacaggaaggtacccgtcaaacattaggcccagtaaactcttgtctgaatttcaaaggtacaagcgcttgaatgttaacctcgggagcagacatgttattgcgactgcatactgagtcggacctgtttctcctgcgggataaagagtctaagtccacaaggggcctgggaggttaggtctacctgg

SEQ ID NO: 566681 - DNA, 164 bp, Homo sapiens
actgcatccaagcgccgccgtggctacggcgtaagctgaggatcactttgcctgcatccgaaccgccgtcccatggttcagccgtcagatccaggagcatgagcaggagtctgcgctgcgggagcaggtgagcggggttggatggtcgcggcgttggatgcagt

SEQ ID NO: 566682 - DNA, 213 bp, Homo sapiens
gtcagtctacggcacttgaattgacgggtcgctcgatctgacgggccgcgacaagttaacttgatatataattgatagctaggtccattgtgtcattacggacccgttatattcaagtctgccgttaatcaagctgtattaccctactctcagagcggtcagcacagtgctagctacatgatgggcccctaatcgcccactatagagtgacag

SEQ ID NO: 566683 - DNA, 245 bp, Homo sapiens
ttacatgatgatactatttgagcccatccaatgattcccttcgattccattcgatgaggattccattcgattcaattcattggtgattctattcaattcaattctttgattccattccattccattcgacaatgattccattcgatttctttcgatgattccactcgattccacttgacattgattccattcgattccattcaatgattccatttgattccagtggatgatgattgccatcgatt

SEQ ID NO: 566684 - DNA, 556 bp, Homo sapiens
  misc_feature (551)..(551): n is a, c, g, or t
  misc_feature (553)..(553): n is a, c, g, or t
tgagatggagtttcgctctttttgcccaggctggagtgcagtggcatgatcttggctcaccgcagcctctgcctcctgggttcaagcggttctcctgcctcggcctcctgagtagctgggattacaggcatgcaccaccaccccggctaattttgtgtttttggtggagacagggtttctccatgttggtcgggctggtcttgaactcccgacctcaggtgatccacccgcctcagcctcccagggtgctgggattgcaggcgtgagccaccgcacccagcttttttttttttttttaaagcttccacatatgagtgggaatgtgcatgtttatgttcctggcttatttcacttaaataatgtcctccatttccatccatgttgcctcaggtgataggatttcattctgttctttgaatagtattcctttgtgtgtataaaccacattttctttatccatttatctgttgttggacatctaggttgattccatattttggctattgtgaatagtgctccagtctgggacagaacgagactttgtcccaaangntgg

SEQ ID NO: 566685 - DNA, 282 bp, Homo sapiens
acccggttgggggggggggggggatttttgggttcccaaaacccccaaaagccttggggttttgaatggggaaaatttcccgaggggggaaaaatccttatcccaccgggcccgttcccgtcccctaaaattgggggtggggccccccccccgggttttaaagaatttgtccacctttaaaccgctgggggttgggaaagcctttgttttttggtggggtttttccatttcccttaaggccccccctacctttttaaaaaaaaggggtttttttaaacccca

SEQ ID NO: 566686 - DNA, 360 bp, Homo sapiens
cctttcactcctcaaaagttaacctatagttaccgtatacccagccattcctcccccaggtctatagcctagataaatgaaaacacttgtccacacaaaatgtcacctcagttttcacagcaatcatcattcattatagccaaaaagtgaaagtaacccaggtgtccctctgtggattaatgggttaacaaaacattgtctgtccgtacaccagaacgttattctgccatgggaaggagtgaagtgtggatacttactacgacatggatcaaccttgataatcatgctatgttcaagaagctgattgcagtctaccacattctgtttgattcctttttatgtaacatacctactataggc

SEQ ID NO: 566687 - DNA, 117 bp, Homo sapiens
  misc_feature (3)..(3): n is a, c, g, or t
  misc_feature (5)..(5): n is a, c, g, or t
cgntngatcttgagatggagtgagtttggagtctacccagtagaggcggcactgaggagatctagggtgatgccattgggccactgagtgttttcatgtcaccagcgagtagatgtc

SEQ ID NO: 566688 - DNA, 566 bp, Homo sapiens
cgcttatggaaggtcccgctgctttcctctaattgaatagcttcttgaacctagcccatgtttctgatcccaaaataggtgttgatgggtttgatggggagagaaacattcaggctgttgtcccttcctgcttactttcatgcctggtgcaggtttgtatgtatttaaatagacacttagctgataggtcggaagagagggaaagacccttcagcaggcttcctgtgcagacagcttcagcctgttccaggacgggcaatcgccatacattgtgcactcagtctgtttcctccaaccccatcctagaaactctgtcttgcactcagagcagaagcaactatgctatccattgtggtatcaacctgccgggttggtcagttcaatgaatttatatggtgtatttatcaaaacagcataatacaaggcaggaacttacattgtacataatttatttctactgtgaaaaagagattgatgtacttagcactttgtttgctaagagaaataaatattttttcttgttatctggttttcttaatatatattaaactatttctggagcagca

SEQ ID NO: 566689 - DNA, 121 bp, Homo sapiens
tgacactctcatctccatgatgacttacttaggaattcaactttcccctggggcccaggctatgactccagccaggcagcattaatagaaaatctacccccaccatcctccatggtgctga

SEQ ID NO: 566690 - DNA, 386 bp, Homo sapiens
gcttggtatatgcattaagatcatgctcgaaattcattctcgtgctgcagctcacagttctgtcatgactacccgccacatctttgttgctcagagacagatttgtggctacgtacaatcacttttttgctgtcaatcttgtggtgccctataattgtgtactgcagtgcatcaatgacagacgatagatgtagtaaggcgatgagcagcgatatatgtctggttaaaaagttcagcattgggattcagtgtaatagcacatgatgtaaagtagacttcacaggtaacactgcccatggcaggtatagtaatatggcatatggtacataattccctaaaatctgaaagacatagcacgagatgtctaagcacacataggactggca

SEQ ID NO: 566691 - DNA, 306 bp, Homo sapiens
tgccacaacagaatattcaccatgacaactggcccacaccccagagactgattctgatctcccatgaattatgaaagaccatatatctgtgacaccaattatttgcatacaggttgcaacgccggtattctcaggaaatatgattgtccacacccaagcaagaatgccctcaaataacattccaagattgtaggtactttgcctaccatctgtctgaagtgaagaagtggttgagaattttgattggggaccaggaaatcacttgtatactgttcgccaataaattcctacccagtgttgtctgta

SEQ ID NO: 566692 - DNA, 1422 bp, Homo sapiens
gcttatttatttatttaatttatttgagacagggtgtatgtagctctgtcacccaggttggagtgcagtggcgggatattctctcactgcagcctctgcctcccaagatcaagcgatcctcttgcctcagcctcctgggtagctgggaccacaggcaaataccatcacgcctggctttttcttcttcttcttcttttatttttgtttatttgtccaattatttagtagagaggatggggatttcacacaaatttggcccaggcgctgggtcctcaaaatctcctggaggctcaatgtggatccgatcgcggccttcacaaccgtggcgcaaaagtggctggggattaacagggctataaacaccgcagtttatttcctttaacaagggccctgtttgtgggtgtatattttagacagactgtgtagtaataaattaagtagcatttgtatttatattgtgaaaatgatagagagaattagtatattgtatatatagtattttatcttatgagtgttgaggagagaatctcgcgggtcttacaaagaagtagatgtaatttagtattataataacgcgcaaagagaaagtcgtgtaaaaagagattagagggaagcgccactatcaaagaagagtaatcacgaggtaagatgcgaacagggggcgctactaccagagaacaggagcgccacacaaaaattttgaggcaacaaggggggaaccactaatagggggagtgaccactacaaacacactgtgtgtgctaatacgacagcagcaacttaagagggtaaaagcagacagagagacatcagaacaaaaaatacatagtcccccacaaatataataattcagccagaatatacacagcaacattttgtgtagcagacccgtgtgactataattatcaaccataaggagggggaagcatccggtatattcaaagggggaacaaaacaaataataagtggtgagaaatctctcttcagacagaagggcaactacaccgtgttgcaattaactccataaacatggagggggggtgcaagcggggcattaagtacgagacacacaactgcagtggaatttaaaaaccagttgtatcaaattaggcgcgagacgagggaataatcaacaaaaactaggggggagcacaatcagcgaaagcaccactgaggggggagaaaatcgacagtgaacaagtgcagtgagggggaaacagctagtcacaaacaacgattagcgaggggcttatcgacgagcagaggtgcgccaccgatttgtgtgatgacaacacaagacgatagtgtgccaaacccatagcatcgatcaacaaatgactgatgccacaggacggcaacctcacaacacgctcccggggctgacagagagaaacatagtatcaagtggggaagacaacgggt

SEQ ID NO: 566693 - DNA, 260 bp, Homo sapiens
tttgggaggccgaagcgggaggatcgcttgaacctacaagttcgagaccaggctgggcaacatagtggaaccccctctgtacaaaaaaaaaataacaaaaattagctggtgtagtggcatgtgcctatagtcccaactactcgggaggctgaagcagcggaagggttgcttgagcctggggagatcaaggctacagtgagccatggtcataccactggcactccatccagagttgacacagttgagatcctcttttcagg

SEQ ID NO: 566694 - DNA, 180 bp, Homo sapiens
catagtaactgtcattatctgtggtaatatctagcaaggggctgtatctattatgaattggcatgtggattactggttttggaacactcatgaatgctagggagacctgttttacccgcctgcaatactgtacgttccctatctgtaatagttcacatcagtcagatccagcagtactca

SEQ ID NO: 566695 - DNA, 103 bp, Homo sapiens
aggaccgtttagtggttgtgggtagagaagtttggcagaaggtaaggtaggataggaggtagcaccaaaaaaggaagggagagacagaataagtgatatgatt

SEQ ID NO: 566696 - DNA, 241 bp, Homo sapiens
ctaatctaccccatcgattcacggtatcgtcaccagctgggacgacttggcagacaacagtctgggcaccacagccttctacaatgcgctgcgtgttgctccctatgatcaccccgtgctgctatctgatggcccctctgaacccctaggccaaccgctagaatattacccggatcatgtgtgagaccttcaacagccgccatccatgctccgttgctatccagtgcctgtgctatcccat

SEQ ID NO: 566697 - DNA, 1690 bp, Homo sapiens
ggaattccggtgctgtggatgccggctgggtcgctgcggggcacattcctgcagaagatttggaaaaaatccgtcaaaacgccacttttgacgttgaccgcattgcagagattgagttatcaacgcgccatgatgttgtggcatttacccgtaacgtgtcagaatcacttggcgaagaacgtaagtggattcactatggcttaacgtcaaccgatgttgttgatacagcgcaagcattacgtttgcgtcaagccaacgatattattaaacaagatttgcaagaatggcgcgacgccattaaagatttggccttgaagtataaagacactgtcatgatgggacgcacacacggtgtacatgccgaaccaaccacttttggcttgaagatggcacgcttccatgcgtcagcaacacgcgcgattgaacgttttgatcgggtggctgctgaagtcgaaaccggtaagttatctggtgccgtaggcacgtttgccaatgtgccaccttatgtcgaagccgtggccatgaaggaattgggcttgacgccacaaccaattgggtcacaagtgttaccacgtgatttgcatgctgattacgtgcaaacgattgcgttgattgggacacaaatggaagaattggcaacggaaattcgctcattgcaacgctcagaaattcatgaagttgaagaaggctttgctaaaggacaaaagggttcttcagcaatgccacacaagcgtaacccaattggtaatgaaaatattactggtttggcacgtgtcttgcgtggctatgccgtaacagcacttgaagatgtgacattgtggcatgaacgcgatatttcacattcttcagccgaacgcattattttgcctgatgcaacgacaacattggattacatgttgaatcgtcaaacaggtattttgaagaatttgggtgtcttccctgaaaaaatgcgtcacaatatggatcgcacttacggtttgatttattcacaacgtttgttgttgagcttaattgatgccggcttgtcacgtgaacaagcctatgatacggtgcaaccattgacagcacgttcatgggatgaacaattgatgttccgtgacttggttgatgcggatccaacaatcactgcccatttgactaaagcacaaattgatgacgcgtttgattatcactatcacttgcgtcatgttgatgaaatttttaagagagtaggtttggcatgacatcactaattaaccatccagcaattaagacagttttagcaacggaaacagatattcaagcacaagtgcaacgtgtggcgaatgaacttaccagtaaatttgcgcataatgacaagcggccagtttttattgcagtcctcaagggtggggtgatttttgccacagatttactccggaaaatgccattggatgttgactttgactttgtcgatgtcaaaagttattcaggtgctgcttcaactggccaagttaaagtggtccatgacgtgagcatggatttaacaggacgtgatgtcgtgatcgtcgatgaaattattgattctggtcggacgatgcaatggttgcaaaactattttgaactcaaaggggccgcaagtgtgacgacggtagccttagctgataaaaaggccgctcgggtggttgactttgacgttgattactttggtcttgatgtgcccgatgaattc

SEQ ID NO: 566698 - DNA, 415 bp, Homo sapiens
  misc_feature (15)..(15): n is a, c, g, or t
  misc_feature (42)..(42): n is a, c, g, or t
  misc_feature (94)..(94): n is a, c, g, or t
  misc_feature (136)..(136): n is a, c, g, or t
cgccgccgacacggntgcgagaagacacagaagggactgaantacagtgcaacgtgaggtatctcaattttcgcattctgtctgcatgcagaanttaagaatattattctactgtttaaaaagtaggatatggcgnccgggtgcggtactcacgcctgtaatcccagcatttgggaggctgaggcgggcggatcacgaggtcagaaagatcgagaccatcctggccaacatggtgaaaccccgttcctactaaaaatacaaaaattagctgggtgtggtggcgcatgcctgtagtcccagttaatcgggaggctgaggcaggagaatcacttgaaccccggggggcagaggttgcagtgagtcaagatcgcaccactgcactccagcccagcgactgagccaggactcttgtctc

SEQ ID NO: 566699 - DNA, 254 bp, Homo sapiens
tgtgaagtaaagcctgagtcatccacaggaacagagaacatttactagccttgatggcagggggggccaaacccaactggaaacagatccctgtggtgggcgacccgctgctgttcccccagctccaaccccaaaccccttcacacaaatcttggaaaagagcgggcatgacaggcagctcattggcaggcctggacctttgactcccatattggtatcccatttttctagaagccaccctgtgagagacacgc

SEQ ID NO: 566700 - DNA, 103 bp, Homo sapiens
gttaacttctgctctcagtggtctggggacattcaacatgcagcaaactcagaacttcagggcaacagactgggtgctcattcttggctctgcaccaggggag

SEQ ID NO: 566701 - DNA, 1389 bp, Homo sapiens
tgggtgtcttcagcacaaagctgctgcttttacttcagcccacttctgacatttttacataccgagcctgagactgtgtgattatctcaacatcacaactcacctctcgacctggacgactaaactacatcaaacacgtgcttcttactacgctccatcgactctctggctgacgacaccagcctaacttggcaacaactggctgctctgacacggaccttcctcacttctcttgggaggccttctccgttccagacagctccgtgggcctgactgtggcctgctaccgccatggtctcactcttgtagaccccccaaaacagacactataatttaactggactaccctggggcaaacaacagcttcaacacagcgccagcacctggcacatgggaatgtggctcctatctcaacgtaaccgggccactatctacaccggcggtaacaaaccgtacactgtgtgtgctttcttcagctggcatcacgagttaccaactctggttcctcctctacggccccccgttccacaggttaccactacctaacgccaccaacgagctttaatggaaagtggaccaacagtgtcccccaccttaaaaccattttcccgtcgtgtcaatattcgttgacacttcatatctcgtcgcgtgttacccaattcggctacaccttacgttcgcgaacaacccttgggctccacttacagaggtgaccaccctccctgcgggcacaaggaaattagtttggggggggcacctggaccaaaccttcctgtcaaaaggccctatccttcaaacccctgtgtgccctgggcacggcaacggggaccaacggggcccaaacaccttggaacccgaccacaaacaaacaagcacaaaagtctccttcgcaacctaacaccgcaatggcaccactgggggcaaacccactgggaacctccctatacgggccccccggacggcgctcaacaggggctgggagctccccaagaagtccaagccaccgccaccagccactttacacaccaaaacgcccactacaaaggccgaggccacctaagggatcaacacaaggccccgggccaacataaatgagcctatgcgagagaccaaagcgtggtcaccactcccatgggcaccctgggggccaacgggcacgtcgcacaacaacagcccctcctatttcgcaaagatcgacacgggggcacgttccgaagacaaccaccaatcaagggacctgctggtaacctcaccacacgtgggattacacacacagatacgcgcccctcaaatgccgtcacatgcgcacactggaacaccgcaccacagcagccacggcgccacctcatcaccccacggccaactccgcgggtctgacaccacatacat

SEQ ID NO: 566702 - DNA, 461 bp, Homo sapiens
atacaatgcaaccataaaaaggaattagatcgtgacatggatggagctggaggccattatccttagcaatactaacgcaggaacagaaaaccaaatactgcatgttctcacttataagtgggagcaaaatgatgagaatcaatgagcacaaagaggggaacaacagacactggagcctacttgagggtggagggtgggaggaaggggagaatcagaaaaaataactattggcttagtacctgggtgatgaaataatctgtacatcaaacctctgtgacacgagtttacctatattacaaacctgcacatgtatacctgagcctaagataaaagttttaaaaacaacgagtcccttaataaaatctctaattttctagatccgaagatgcactttcttcctttttcacgtattaatagtaaatgcaaggtggggtcttgaagtgaataaaaacaagtcctct

SEQ ID NO: 566703 - DNA, 1265 bp, Homo sapiens
  misc_feature (1265)..(1265): n is a, c, g, or t
gactcgtggagttgtgatacgccgacggactccggagaccgcactaataccacgggactcgacctatgaaggccatggattctaggtccccgttggggcgtgtgctattgtgcgtgccgagggggctttggttgaccgtggtggtcagtggatggccgtaggcggagcttctgagcgcgggtgaccgcagtgttcgacggtcgggagggcttttagtaggtcgttggacgacgaggaggtggaggcgtgagtgaggcgcgtggagcgaggaggaagaggtggtggaggcttccattactggtggcaacctgggtgtccgtggtcaggggagagaaataatgaggagaaccagtcgagggaagatatgtgatgcgtggagccagcatcggcgatgcagggattgtcttccatttgtccgaggtaaaggatagatgccactggtcacctaataacctggttccctgggtgaatcaggtttatgcgcagagaaggagagtctcgattgtcggacaggagatgacaacatttgagtaccgatcctggaacccctatccgttccaaggctagcagcgagaaatcctgggtggagtggaccagatccacatcaaaaccggggtctaaggttctctacctctggggcgtgcttcgtgacacaaggtctcccatgtctctgacatcgttggtccggatggtctagtctatgcagtcgagttctcccaccgctcttggccgtgaccctcattaagcttgggccaagaatgaggacccaacatcattccttgtgaatcgacgattgctcgagtacccatacaaattccgggatgctcaatcgcaggctggctgtgagccaaggtagaagtgagcaaggagaacaaaccggatagtggcccttgaaagtgccacacaagcttacggggataatggaacggaacactttgggggactcccagtcacgtgccaacgtgctataacgtcccgggcacaacagacggggccaagaatagaccacccaagcgaataccagatgaccaggaaaaaaatatagcgagagagagatgaacagcacgacagataacgagacaccacatcgggcgcggggagtagaacatcccccgaggagaaagaaaaagacgtcacgaacaaacataccatcactagaaggaagtaaataataagcgaacaacaggcgaacaactacaaaacgacataggatgcagaatgtaaaagacaacaatcgtagtcaccataatacactttatatatan

SEQ ID NO: 566704 - DNA, 176 bp, Homo sapiens
ccacatgagaccacctgcccccagctcagttattgttaagcatgtctagccgctcccatttccaagccctccctagcatcccagagtgtcccttggaccaggacccaacattttctagggatgcaggatccccgccactggggtctggatcctcgccaaattccgcagcgggacga

SEQ ID NO: 566705 - DNA, 472 bp, Homo sapiens
tagttgatgacctaataatacgagattagccacgggccgtaccgcggctcacttatgccttgcctaaaacgctacgaatatgctttatccatggggcggatacaattgcggaatttttaaattttattcggcggcggccgataaatttaccgccgggaatgcggcgggaagcggctactgcggcgggcgtctggcatttgacggctacgccataacggctgctacctacgcgggtcgcgctgtcgcgggcggcactaatgcggcctggagcggcgccgtggtggtaatgcaggggacctgcggcgcgggtacgtttgtggggaccggctaggagggcgcggttcgcgcctgtgggacctacttgggtaccggtcaaactcgcgcggccgaggctgtgaacggcggcactccggcggtgggcggattgggcgtttactacgtcgcgtacggctacgtaggaaacaatacgcgg

SEQ ID NO: 566706 - DNA, 402 bp, Homo sapiens
cgtcataacatgcccaaaagagtaactatggggatatccatactatggagacactcatgagtcaggaaatagagtttcactgggcacaggtgctcaggcctgtaatctcagcacttggggaggccgaggcggggggatcacatgaggtcaggagtacacgaccagccgggccaacatggcgaaaccctgtctccaccaaaaatacaaaaattagtcggtgtggtggtgaatgtctgtagtctcagctgcttgggaggctgaggcatgagaatggcgtgaacttccttgagcctgggaggtggaggctgcagtgagctgatattgcaccactgcactcaagcctgggcgacagagcgagactccatttcaaaagaacgtttattaaatgactatatgaaacat

SEQ ID NO: 566707 - DNA, 1501 bp, Homo sapiens
aacctgcacgcgcccacgcgcccccacaccgcctctgcgcctgcacgccccctgcgccactctcccccacccctgcgcctgccacgccgcctgcgcgcccctctcccctgcccctccctctccagcccccctccctgcacccacacgccctgcccgctcgcacgcctctgcactacaccgcctcccacacgcctctccctctctgcacgcgcaccaacgccctgcacgcgcactgcacgcctccacgcacctgcacgccgcccgcgcacgcgcacacgcacacgcacgcgcacacgcaaccacgcctgcacgcgcacacctggccaccgccccgcacgcgcacacgccacgcgcactgcgcccctaccacgcccagccctgcacgcgcacgcgcccacgacacgcacacctgcacgcgcacacgcactgcacgcgcactgcacccaccccgcacgcgacacgcgccctcgcacaccgcacgcgcaccgcactgcaaaacgcacacgcacaacgcacacgcacacgcagcatctagcacctagcgacttgaccccaccgcgcgcactgcgcacacgcgccacaacacgcacgcgcacgccccctgcggccactccttgcaaccaagctgcgctatccacaaccacgcccgcgactgcgtctggcgcccccctggaactacccgcaacgcgcgcaaacggcaacgcctctgcatctctggctagcccccaaaaccgcccacgcgaaagcaccctccctccgccccctgcttagctgcgtctaacttcctgaacgccgcccctgtggccacacacggccctctttagcaaccactgcgttccccttactgcaactccaaccaaacaccccacgcacgcgcactgcaaaacggctacgcaaaccctaccccaccgcccaactcaacaacgcaaactggcctgggcctggcccaaaagggctcaacccccatcttggcaacttgcgcgcccagagctcaaaccgcgcggcgcccctcacacacctccctcacaagcaggcccacttgcgcggaaccaaccctttcctaactacacgcagcaaaaccaaagcaaacccgtgtccccaccctggaagcgcaaaccagcaactgcactctctccaggccccccctcttccccctgtaaccacttttcaacgcggctcggcctgaaaccttccttccaaccttgtgaaccgaaccccactgctagactttccacctgggcttcactttcgtccccctgccgtgcactggggcccccttcttggggcacacctgcccgtggccctcgtagccacgccccccggccagcacgcgctccggcctgcgcatccctccccctctccccaccccccaccgcttctcgcccccccccgccccgactgccaccacctgcggcggacacccccccccgcgcactcggctccatccccctcgctctgccacaaccacccacgcgccactccccccccccctcgccccccc

SEQ ID NO: 566708 - DNA, 177 bp, Homo sapiens
cctggtgcggcggcacctgctgcgcactgagctgtgcgccctgcttggcgcctgtgaccgcagggaccgccgtgtccaacgactcggacatcttggcgcagatgacatccaccaggcgctcaaaggtctgcttgacgttggccattcaacgcctccgagccattcaacgcctccggg

SEQ ID NO: 566709 - DNA, 555 bp, Homo sapiens
agaggtggaattggggcccggcacttccctcctcgtccctgggctggcccttgcaccccaccctagcaactacctgtgtatgagcactgggctcatgccaacgatgctgtcccatcgtcacaccatgctgctgtgcctcctggcctggcacccaacaactgccatacttgtgcctctgcagctgtgctgtgcacccccctgcttccaccttaagctgccttggccataccctagctgacaactacccactacccagtgctaggaacgatgctactaccacaatgccatgtgccctacacatgcatgtggtgaactgcaacttgtgatgtgtgtacttaacacatagccccatgtgacctcacgaatacccctggctactaccctaactactatagcgtaatatttgccaccatgtgacccaccgcggtaacttgaaaactggaaacccaaatgacaaaaggatcgggcaccggaaacgccacacacgcccaaaactggccaccccaaaccctttgcgcccttgccacaacaaacaatggcccttcgcacggcctg

SEQ ID NO: 566710 - DNA, 334 bp, Homo sapiens
tgttccctcaacccatttgggtaaaattacggttctaattagaaactgttttaaggaggggttgggctcggtggctcacgcctgtaatcccagactttgagaggccaaggcggtcccgaagtcagtagttttataccagccaagccaacatggtgaaaccccgtctttacaagaaatacaaaaattagccgggtgggacacgcctgtaatcccagctactcaagaggttgaggcaggagaatagcttgaacccgggaggcagaggttgcagtgaactgagatcactccgctgcactccagcctgggtgacagagcgaggctccgtctcaaaaaa

SEQ ID NO: 566711 - DNA, 1144 bp, Homo sapiens
  misc_feature (320)..(320): n is a, c, g, or t
ggcgtcgagcgggagcagaggaggcgagggaggagggccagagaggcagttggaagatggcggacgaggccggcccatcgcccttcatgacccggcggtctcccctcgtcggtcggcgggggctcggatcaatggtgaggctcggtcgtcagtctcctccgccggggagctcgcttccgcaaggagcgccgcgggagagatgtgtccctggtgcatcggatgctggagccctgggtcgtagtcccggtgtggagctggtcgcctagatgcggtgaggtgcctggacggtctggccctatgtgggactagacccgagagtngtcgagtctgagctggacaggactgccttgtagggcgtgagaagagcgtgagggtccagatgagcggtcggactgggcagtgcgggtgcagcacacgcaggcccagagctggatcgtgcgcgcggctgggggaaaggaggacaaatggtgcctgggaccttgtcagcggtccgcaattctcgaggagtccacgcagtcgtggtcacgatcggaatcttgtatcgaaccgagtgatcgagcgatcgaactgaaggggcgacggacggagggacacgaagtgcgggaggagagcgctccgtctgattgtcgtgcagtaccccggcaaggaactaagagggtcctcttgcgtcgatatactgcgctggcaatagggaaacagtattagtactaggttaaaaattgggtgtgtatcccactgtacgccatgggttggaccaaggggtcgcacttgtagggaggaatgtggactacaaggaagacgcttgcgatccattgtcaaaaagtcctgccttatctcgaagcattctgcgcgcctttccggagagggggcccgaacgaggtatgttaaggaatcgccgccgttaggttaccataatttctggaaatccaaaagtcaacatcccattccttatcggtagcatgtgtggggcccccatgaagttccctccgggataaccaaaagtttggttttaaacagggacttgtccactaaaggggctgggggaacaaattagagtgaccacatccccatcctttgaagggcctggcacttggagtagtgaagcgaccttggtagggcacagaagtgggtacaggttcaactg

SEQ ID NO: 566712 - DNA, 463 bp, Homo sapiens
  misc_feature (354)..(354): n is a, c, g, or t
  misc_feature (370)..(371): n is a, c, g, or t
  misc_feature (421)..(421): n is a, c, g, or t
tttgggtccagggtgggctcttccccttcccacatcagggacccggggatggatgtcggaagggtcaccagcctccagcctttggaggatggagcttgggtctgcagggctttgcagccacacagcgaggtcagtccggggccagccgcgccattcatggtaatggtggcctcgccccattccatgtcatccatgtcacatgaggacgtgcagtctttccttgttccttttccttagtgggaattttgcctggggagaacctccacttgaataattgaaatttttttgcattgcctgttgggatttcctttacggacaatggggggaacgcggtgttttccccacctttttgtngggtaagaaagcagtnntgtttttgaggaaggcgagaaggcaaagccagggggcaggggctttgttnttggggaagctttccgttgaaaagccgttttcgacgttttag

SEQ ID NO: 566713 - DNA, 260 bp, Homo sapiens
tccagtacccgagcatgcttgaatggctgtcagggtcgacgtgtattcagctacatgggtctgcaatgtcctccctggtgacaagtatccggtcgagacgttgagcaaccagtgctgagctaccaaatatctgttaagctgggagcctgggtcgacgctgtattcaactactgcggctgcatgcctctcctgtacagagttctcgtcgacgacgtgagcaccagtgctgacctccagaatatcgttgagctaggagccgt

SEQ ID NO: 566714 - DNA, 156 bp, Homo sapiens
atgcggagggtctattgcagcaggcaggcatcaagaagacaaaagccagagtaggacgtggtgtgcggccgggtagagcaatatacactatgtacagactctgcgaatcagtcctgctcgtgcggtgcagctgtcctcagccagcgtccagtgcgc

SEQ ID NO: 566715 - DNA, 126 bp, Homo sapiens
ccttcatctactctaccatctttgcaggcacactcatcacagcgctaggctcgcacttgatttttttacctgaggtagggccttggaaattaaacatgctagcttttatttcagttcttaccaaaa

SEQ ID NO: 566716 - DNA, 136 bp, Homo sapiens
gtggaaagacctgcctcctacatcgtctacagcaaggatcagttcccggagctctacgtccctaactgtctttagagaactatatatgcggacattgacggtggacggcaagcagggtggagctaggctctgtggg

SEQ ID NO: 566717 - DNA, 669 bp, Homo sapiens
ccgtctgtcgacgggcatagtgcagatgacatcttcgctgtccactctcaatcagctagtggttcacaaccctagcgtaggacagctccatcatgcgcaagctcacgtggtaatcaactatatcgtttcaagaagagaggtcagctccttagcacaataggctcgacgtgcagataccatgttaacttacttccaagtgcactgcattcaacatcacgcacgtgacacatggacgcgaagacgccgacaggcgctatcgccatctgattgcaatattccactgtaagcagaaacacgtgtactcgttcacaacttctccacacagcgccctcttgccttgcgatcgtccccggctaatctatcacactgaggggacacgcatcaacactctcattttactcgaggcgcagcactagatcatgttgcctaattctaaagttaaggataacacttacaacgtaaaagagcctgcatttttgcgaatttcttgattacccgaggtacgcttaagcatcagaatgtcattaaaagcacgacgttgactacccaaaagctgataaccggaaaacggcggttaccacaagcacaaaaccaggagatctagtcgcaacgtacgtcgagggagtacaccctaagataaacaccaccaagttggttggggccattacc

SEQ ID NO: 566718 - DNA, 555 bp, Homo sapiens
cataagcttttaaattgcctttgatggaactgaagcaggatgtttccctgacccctttgtgggacttgtgacgggtgcctcgtttattcagcctgccactctcaactccttgcaggagcgagcatgcaagcaaatgaggcaggaactggagtgcactgtgctggaatcggcactgcagcacggtaggatcaaacttcactcactgggacctgctgcagtcccctgcttgtgggaggaagcatgcaggtgaatcagtgcaggagccaaagtgagtgcttttggccaccggcaggagcaaactctgtgtgggccccacagcagcatctaggtgggggagcctgcgacccccatagccccagagggcatgttacagtgttcttttaactctgccttccatggatggcttaagtgtcaacagctcagtgaggcctctgcctttttgtgtgaggcagctgccctccaccagcaagggcagagggccagtgtgacagtcttttgtatctgctcttctggcttccaagctcttgtctttgttcaggaaaagtgaggtcacat

SEQ ID NO: 566719 - DNA, 135 bp, Homo sapiens
  misc_feature (19)..(20): n is a, c, g, or t
cctgatttctagatggtgnnaaggggattgttgctgactggaggtgtgcacgcttgcggttctgcttttctatcatgccctgggccagttccaactgtgctgcgcgctgacgttcaaaggcagaataatttccgg

SEQ ID NO: 566720 - DNA, 1014 bp, Homo sapiens
  misc_feature (759)..(759): n is a, c, g, or t
cctggtcttcaacgagggctgatggcgttcccgaccgattcccttatccaggcttttagataacgcttatgctccgtgctccatacgtactgcagtcagctaggtcctttagacactctacctaagatgtttagaacgaagccttataattccaacaggaagcagtaaggtattcgattcactagcgaggatactcgctacagaattctctccctgcgtgattgtcctcagcagttctaattcctgacagcgctcctaacagggtagagaaggcacacacagaacaatccgaaagctagaagtctgcttccgttattactccactgactgtctgcatcacagttctgtggcatggtagcctcagtgcagttctcatcaagggtagctgtctttcggccaaatcagccttggttgtacaggacgcctcttgactggctaatcagtcatacttaccttccttaaatggtagccctagaaggacaggccatcctagaactgccttattgagggcaggctatggaacgacttggtagctctccacaggatctggtgctagactctgtcaagtctatgactctagcaggcaaaagttacgaacgattaacccgtcgaacacgaaaaagactaaactgctacatagcgtcaaagggaaacttatctgagggcgtgacttcatagcttggcattccaagggcaagggacctgtgtgagccaatggttccgaagaccagttcccttggcgccctcgatgccaaggtnctcgggctctgctggccaaggacatgtgttggggaatttaggcttgcccggggatgggagttccctgttgagccccttctccaagtgggcccttaattgtgccgtgtaaagttttcgcccctcgggatggctgaaaagcgttgttctactcagcggtatgtagcatcaagttaacttcctgacttcatggtgcctatggttcctacacattttaggcgaaggcagggggggcgtgacaaggcacaagagtctctc

SEQ ID NO: 566721 - DNA, 931 bp, Homo sapiens
  misc_feature (75)..(75): n is a, c, g, or t
ttcgtcgcgccatattagagtgtttgtttggtctgtcttccccgcgcggtagaacactactcctgggtgggggtntttttaataaggcggactcctcctccttttgtactaccactagacgccacggagtgtgtttgtcctggttccgcgctgggcctcccccccgcacagggtggtgttggtaacgttcgtgtggagcacgcccgtcgttctttttagacaagattgcggcggtatacataacatagacgaggacataatgtagcacccgccccctcgttgtggttgtcctccgctcgccgcccgaccccgtgtgggtcgcactcctcctgccgcgcgcacaaaatatacattgtgtggtgtagcataggagtgttgttgtatctccttctaataacaagtaaccaccctactcgtgcgctccgccgcctcctctaatcaacatccacaatgtgttttctcccacacctcctctcttcttcttctaataatctcctctcgcatccacaccccagcccgcgcgccacacaatagaaggtgcgtaagattagattgctcttctccaccaccacacaacctcttgtttttctgtcttaagaaccaataacaagaacttttgatgaggagccacccctctatttaatacgaaccacactcctcctcctcttggggaacatcaccacactccctgttgttgtgacaccccactcctcttttttttcttttttttcaggaagaacaagggaagtaaccacccgcaagaatcatgttgtgtttcttttttttgtcttccctactgttatcaccccccctatcttctttgatcttaccccccccccctatcttttttttttttaccccccccccccccccgttttttccttttctccaacaattttttttttcgggcgggggaaaaaaatctttttta

SEQ ID NO: 566722 - DNA, 104 bp, Homo sapiens
attacacccttatgtctgggcatctatctgcttggtccatagtgtgtcattatgtttcttttttcgcatggtttggcgtgctcatttcgttgagaagcttgggt

SEQ ID NO: 566723 - DNA, 1243 bp, Homo sapiens
  misc_feature (575)..(575): n is a, c, g, or t
ctcgagaaagtgaagttgcctggatggatatcggttcgagtaccgttcagggcgatatggcaggcggtcaatgtggttcatgtaactcgtgtccttgttcacgtacgaccctcgaggacgagggcgcggatcactgacgtgtatcatcgtcatctaatcgggaaaacattgaacacgatccgagcgtatgatcggtcctgctctgcgaagtagtatgcactcacgggctctcaagtactggtggaatggtctctagccgcgttgagtggacaccgagtaatacaatgactggacgcggagcccaggtacgtaactctgacctagaagtgagacatcatccagtcttatttccgataacgagtcgaggaacgtgaatcttcatactgagcacattgatcttgcaaagatcgcaaggcataagcggtcattcatgaacaaagtgcaccaacggggtcctcaatggagataccgttaaaggctttaacctagattttcaatttggggcgccgttcacatgaatagtcctagtgctaattaagggttctgcgctactcgggaccttggcgtagttgatnttggcaacgcaaggtgggaggattcaataggggagtttgcctctagggcaaatgcaaccgtgcccaattttcttgactaaagtttctagacttttggaacggatcgtataactaggcgaggacactagatgacagcgtctcgggtattctactggcatcatggagcattcttcctccttgaatggaccgtaaaatagtgtataggtcgaccatgacacacctttaaaggggaaacctatgaccaagatattgctccttgagccgagagctccatggggattatagccatggtgccatcacaatcagagctttggaaaatggagtatcgctacaaattgaagggtgtgacacgggtattatagcgcatacaggcaatccatggaaaaatgcatcagggcagggaagttcagatcgcgcttacctaacgtagtacattccatcatttccaaatatatgttacctcccccattaccgacgagtggtatccatgaacaaacaatagggagtgcattactatcgacccgattaagggcaaagtcgctttaagtggaacatccctgtcaggcaaaccttactgcatatagatagccaggaactccggaggaacaaccggtgggcgtatacactataacgaatcatgggcaccaagcgtgtgtaatgggtaaaaa

SEQ ID NO: 566724 - DNA, 1101 bp, Homo sapiens
gtgcgccccagtcgacgctgagctcctctgctactcagagttgcaacctcagcctctgctatggctcccagcagcacccctgtgccctgcgctgcccgcactcctgtgatccatgctctgtgtggctctgtatcccagtgacctgtgcaattgcccagacatctgtgtccccactcaaaagtcatccatgcccctggaggatgtgctccgtgctggtgacatgcacgcacctcctgatgaccatgcccaagttgtaggggcatagagaccccgtatgcctaaaaatggagtttgctcctgcctgggaacaaccggaaggtgtattgcaactgagcaatgtgcaagaagatagccaaccactgtgctattcaaactgccctgatgggcagtcaacagctaaaaccttacctcaccgtgtactggactccagaacgggtggaactggcaccacctcccctcttggcagcacaatgggcaagaaccttaccctacgctgccacggtggagggaggggcaccccgggccaaactcaacgtggtgctgctccgtggggagaaggagcatgcacacgggagccagctgtagcgggagccagcgcatgagagtcacaacgcacggcgcagcatcacgaccagatcaccatgggagccaagtaacccgctgccgcacgagcaccggaaccatgcaaggcaccaaaggagcaggcacgtgcacaagcagcacgacgggcccaccctacccggccgcgaaaccactgcacaagcaggagagtaccacaagagcaatgacaaggcacggggagcaagaggcagacacaccaaggagcccgagggacgcgacactggaccgagcggtcccaaagaaagggaagcaccagggcccagcacacggagccccaaggagaacacaacgagcaagaaggaacacaaccccaggccagcccaagacaggtacgaagcccaagaccaacgagacaagcccgacacagagccagacccgccacggccccgacccaggagcaccgcgacgcaaagcagacagccgcgcgaccgcaccagaggaggaggcggaagcacgccggccacaacggcgagcggcgag

SEQ ID NO: 566725 - DNA, 278 bp, Homo sapiens
tgtgaggggcggcagaggttctcaatacagaattatcttatgagctaatttgaatgggtaaacctcagaggtctaggttccatgcctcttgctttatgactgctcagccagccctgcttttatcgatctttacatggacattctatctgatcgtttcttttgtaaggggagttctgcttagtgttttacatataccacaacacgtacttgtacacttctacttttagagaaatgaattcctgtttgcctgatttcatacctcaatttcatcgcctatt

SEQ ID NO: 566726 - DNA, 319 bp, Homo sapiens
  misc_feature (264)..(264): n is a, c, g, or t
  misc_feature (275)..(275): n is a, c, g, or t
tttcttaaaatgcgatcattttatacacattacccttcaacctgtctttttcacttagaaaaacatcatggacagctcctgtgggtcagtagataagcatattctttttaatagctgctgagacttttacttctgaagtgtaaattcgcactgggtataaagcagggcctaaaacaaaaagttccctgcccttttagagcctccccattctgatgggaggggaggccgacaacacgcaggacaggtgtagggacatgtcagagngtgatccagtnctcttgaaggggaaaccatggggcagtcccaggggtaggaaagc

SEQ ID NO: 566727 - DNA, 298 bp, Homo sapiens
  misc_feature (103)..(103): n is a, c, g, or t
cgaggttgcagtgaaccgagatcgtgccattgcactctatcctaggcgacaagagcgaaactccatctcaaaaaaaaccaaaaaactgtatgttcttaatctntaccacagatgtatgcaggtggggctcaataatttttttttttttttagatggagtcttggctctgttgcccaggctggagtacagtggcacgatctcagctcactgcactctccacctcctgggttcaagcagttctcttatctcagcctcccgagtagctgggattacaggcacaggccaccacaactggcta

SEQ ID NO: 566728 - DNA, 120 bp, Homo sapiens
tttccccctgcccccattttattgggtagcttaaaggggaacagtgccatgttccccacaaatgttcctgtttccttgcatgggcataggggcccctcctttatgactgattaaaccatg

SEQ ID NO: 566729 - DNA, 377 bp, Homo sapiens
gtaggctggtgcctgatgctctgcgtgccatgatccactgcctcctcccaggctgctgcagatgagctggaatctctccctctcctgtgggagcagctctaccccttactgtctgctaccaggtctggcctcgctatatggacatcttagcccttcaattcgccgagatggggaccattcctgctgcagccaatatggccactgtgggctggcccccagctgggatatggatggccctcaacgcaagccatggccatgggtccctccccagaggcgaaattgtaaaaaagatccatttggctagcaccaaggccacctcttcctatttggcacggtgaggtcactgggtgggtcttgcagtctggatacgcctgccc

SEQ ID NO: 566730 - DNA, 1131 bp, Homo sapiens
  misc_feature (423)..(423): n is a, c, g, or t
  misc_feature (796)..(796): n is a, c, g, or t
gaagcggcggaccgtgactcctggccgtgaccatggacccgtctggagacccctatcaaggatggcatttctctaccagacagcatgtcacagtatggcaagaagtgctggcgagaaggtgtggtgctctgcatgtagtgcaggaggcccagtcagtgcgtggctcggcatggagagctgtcgaggtccgcgtgatggtgggctgggagcatgcgggtgacatggtcgtgtcgggcctggtcggcgaggggagcgacgggtcatccgcactggctgactgtgtgtccgtgcgtgccggctgacggcgagagctgccctccgggacgccggttgccattcctgctcaccaccaccgagcgcaagccattatattggcctgtctcaggcaccgccaggcctggatgggggcccaatctgcgcacnttggcccttcccggggtacacggcggtgggacctccctcacgggatcgcgacgagagtggtgcacacgtcgtccccataggaagggagtctgggttcgcccgattggagtgaagaagctacgaatctagctcgctgcctggacaggatggtgcagcagaagtttctcccgatggcgtgagttgcacgaagcgatatggaggaccagacgaaccgggtagcttgccctggatgggggcgccactgggcaccatgacttgcggttgtcatgagtgcgcgcgagaatccgtcctacttcccgaggcgtgcaaggggtaggcgtcccaaagaggaaccagtgcgcaagggacaccgtacgttaacacattgcttggnctcccttaccacgactttacgcgtgtgcagaccgaggatctccgggttttccgaaccctaggggtggcgagtaggataccgtctcggattctggagggccccgggcccggttctcacttggccacagcttccgtagggctgggggggcggccgtgactttgatggccgtttcctaggggaaccccttgcgattgtattgcacccgtatgccacctatggttgcacgggggcctttggttgagagcgcagcgggggccccattcagggcctggtccgagcgtggtatagcggtcgctcgccatattatatcttagatcgaccaagggtgggcgccg

SEQ ID NO: 566731 - DNA, 232 bp, Homo sapiens
ggtcttgctgtgttgcctaggctggtcttgaactcctaccctcagtggatcctcctgcctcggcctcccgaagtgctgggattactggcatgaatcactgtgcctggccaataattcattttaaaactttttttttttttttggaaataggattgggttttgttcccaaacctggagggcaggggtgtaatctcggttaactgacccctaaatagccggggccccgacctca

SEQ ID NO: 566732 - DNA, 499 bp, Homo sapiens
  misc_feature (2)..(2): n is a, c, g, or t
  misc_feature (5)..(5): n is a, c, g, or t
  misc_feature (164)..(164): n is a, c, g, or t
  misc_feature (202)..(202): n is a, c, g, or t
  misc_feature (208)..(208): n is a, c, g, or t
  misc_feature (266)..(266): n is a, c, g, or t
  misc_feature (293)..(293): n is a, c, g, or t
  misc_feature (393)..(393): n is a, c, g, or t
  misc_feature (439)..(439): n is a, c, g, or t
  misc_feature (451)..(451): n is a, c, g, or t
gnttncgctcaagctgtaccagcggcagcagcacagacagggccttcgcccggtccccaggcctgttcctccggttgagggctctgtggcgcccgatctgtactgcatgtgtggccgtatctacaaggacatgttcttcagctcgggtttccaggatgctgggnaccgggagcaggcctatcactggtatcgcaaggctttngacgtngagcccagccttcactcaggcatcaatgcagctgtgctcctcattgctgccgggaagnactttgaggattccaaagagctccggntaataggcatgaagctgggctgcctgctggcccgcaaaggctgcgtggaggaagatgcagtattacttgggattgtggggtttctaccctggggagcccnaggatcctcgccaaatgaccccaccccagggtgggtgcttggctgnaaggagcaaggnttgttattaagctcaaatgccccccaatattgggtaccctgggtggtt

SEQ ID NO: 566733 - DNA, 947 bp, Homo sapiens
gctcgcatctgctatagtggaggccggagcagggaacaaggttgaacagtctaccctcccttgagacagtggaacgtactcccaaccatggagcctccgataggaccatataccgagtcttcttgccgtatacatctcggtagcaggtgtctcctctatgctaaggggccagttacagagtttcatcacagacaagtgatcaggatcttaatagcccgctgctcgataggcgccaataccaaagaaggccctcgtcttgcagtacttgatcctgtacgcataatcaccaggcgagcccttgacattgccgtcctattctctcacgctagtcacttaggctagcgtgggcacatctcacattgtaacgtaacgtaagcaagtacgcggcaagccttccaacaacctacgcattcgttcagacctctcagcgcggagaacgcgagggacgacaccctagtgtcattattaactccaatcgacgcttatttctggatttgtctcacgggtcaactcacgtgaagagttaccattattgcttgtgatcactctaccaaagagcgtctcggaagtaatcgtcctcgttacttgtaaccattaactagcgtcccggagacgcaacagaccaaggagagccagtttgggggattgaaccatttagggctcatgggtcctcgagcatcatgaatcactcgagcttctggggctatacccttacgaggtacagtcgaatgctgaaagccaacctagccgacttagtaagtattgaccacggttcagcgaatattacggaacggtttaggaaacacccatccgaacgcgatagttgtcgcagcctctgcgactaaaccattaactcactccgttgtactgcccgcaaacggtggcggcacacaagtatgttttcagggtgaacctcggaacaactcgtcccaacggcagagccacag

SEQ ID NO: 566734 - DNA, 419 bp, Homo sapiens
tgaagagttcttctgttgcactgtaggagaggttgccttaaaaccagagtatttgattcaccactccacgtgcttatctttccaccttctatagtcttgtttgtgacctgtctctccagtatagtacagggaaatagatcgcccatcgatctctggtccctgcttttcttcaaaggttttctctgcatcagcttctgtcttaaattcaatataagcaatccctttacttttcccatccttgctgactaatctgatctccgcagcatcttcaaacacttctttcaattcatcctgagagaactttgtaagggagatttttagccaaaagtgttctcgcatctcgctctttcttactgtcttttccttttggtttctctagtttaatttcattgccaaagactttcaaaccagtgagttcc

SEQ ID NO: 566735 - DNA, 653 bp, Homo sapiens
ctttgcgatgaaattgccctccaaaggtttaccacctgtccctgagaagatgaacccatccgggtgctgtctctctttgatggaatatctacaggcctcctggtgctgaaggacttggggattcaggtggaccgctacattgcctcggaagtgtgtgaggactccattacggtgggcatggtgcggcaccaaggggaagatcatgtacgtcaggaacatacgcagcgtcacacagaatcatatccaggagtggggaccattcgatctggtgattgggggcaatccctgcgaatacctctccatcgtaaaccctgctcgcaagggtctctaagagggcactggccggctcttctaagagttctaccgcctcctgaatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctaattctggggtaaccttcccggtatgaacaggccgttggcatccactgtgaatgataagctggagctgaagagtgtctggagcatgcaagataccaatttagcaaatgaggacatta

SEQ ID NO: 566736 - DNA, 461 bp, Homo sapiens
  misc_feature (17)..(17): n is a, c, g, or t
  misc_feature (61)..(61): n is a, c, g, or t
  misc_feature (77)..(77): n is a, c, g, or t
  misc_feature (168)..(168): n is a, c, g, or t
  misc_feature (386)..(386): n is a, c, g, or t
  misc_feature (461)..(461): n is a, c, g, or t
ggccgcggtgcgcctgngcggccgttgaaaaatggcgactgtggcagagttgaaggctgtnttaaaggacaccttgnaaaaaaagggggtattagggcatttaaaagcaaggatccgagctgaagttttcaatgccctagatgatgaccgtgaaccccgaccatcatngtctcatgccttctaattaatgaattaattcgagagtatttagaattcaacaaatataagtatacagcatctgtcctcatagcagaatctggtcaaccctattccttggacagacatttctcatccatgaactaatgctttgaagaatcaaaggataatacatacctctttatagggatttagcccattctgcgtggaactaaggatggcatccagangcatttctgaaaggcctcactcagcctcagacccagtctggcagacaacctagtagggccatggaccgagtttcn

SEQ ID NO: 566737 - DNA, 733 bp, Homo sapiens
agtgtgagcagtgacatggtccaagacaaggaaggcagttgggctgtgggaatggggagcccagtgaaagtgcctccagagctggcctggagagtcacctgccgaggtgatgagtgacgcgccagcccggggtgaacgcgccagctgctttctgctgtgccccaagctgctgcatgtgcccacgcagcctgctgcctgatgcctgacactgctgtcctctcccctcgctgcacatgggctctgctgatgtgaccctggctgtggctgatgctcctgtgcttgcatggaactggcttgcatgaagcaaccacttacctccccccgtgtgagctgtgagcccctcccgatgattccagtgtgcctggctctccctccagcatctgtggccaagattggacaatcagtgtgcttgggctacaaggacctggctgccatccccaaggacaatggccatcctggacatcgagcggccctgacctcatgatctacgagcctcacttcacttattccctcctggaacacgtggagctgcctcgcagcctgcgagctgctcgctgtcacccaaatccacatcaccagcccaacatcccagaggtgtggcggacagcggtcgcctggactcatctctcaggcctcaggccacaaagcattggaaccacggacagactgacacatacaacacctgaactaccgcagatcagctctcaaaagctccatatagagaaatcagagg

SEQ ID NO: 566738 - DNA, 552 bp, Homo sapiens
  misc_feature (194)..(195): n is a, c, g, or t
aaagctctccaaaaagtttgtttctttccgcaaagggaataggcccgggccctttttaagaacttgaaccgcgccaacagtcccccccttttctttgccaaaagtcaaggcttatataaaaggccgatttccattgtaaagccggccctcggttgtaaggagccagatccctctcccggggccttgggacaagnnactttttaattggccccggcccggttggttttttataaattccttaaaaacccccccgggggtgaaggggtaaaaaggaggccccccgttccttttccggtattttttgggggggccaccccctatttccccccggttttaatggtcctttttttatgaaatccaaaaccggagcccaagggtggggccaacccaaaattgtggggccttttttttaaaaaaaaggtaaaaggccatttttccccgggccggttttccttttacccggaaaaaaaaacccgtttgtttttttttggggggggaacaaaaagggtcgccccaacaagggttccgggaaaaaaatttttttttttttta

SEQ ID NO: 566739 - DNA, 127 bp, Homo sapiens
tgtgggtgaaggggtgttcctcttattcaagccatgcaccctactcgtggctggtaaaatcacgggcatgtgttggagatggataattcagaacttcttcatatgctcgagtctccagagcgacact

SEQ ID NO: 566740 - DNA, 843 bp, Homo sapiens
gctcgcactctgttcttccgtcgctccgcgcgtcgcgtttctctgccggtgagcgccccgtcccggggcctgagctggacgtcgcaggcctgtgccccccgagccctggctggccccgtttcaagctgcctgatggcctcgtcgctgccttccccggtgatcgagaaggcgtgggtcgcaatgggaagaagagatcgacgcgctgtgtcattgacaatggctccggcatgtgcaaagctggtttggctggggacgacgctccccgatccgctgtttccttccagtcgtcgggcgccccagacgacctatgggcgtcatgtgtgtggcagtgggccagaaggactcctacagtggtgcgacgattgcctcagcatgcaatgcgtggccatcgtgacccgtgaagtaccccattgagctatggcatcgtcgaccaactgtggactgacatggacgaagatctggcgaccacaccttctacaacgagctgccgcgtggccccggaggagcacccagtgctgctgaccgaggacccacctgtaaccccaaggccaacagagcagaagatgactcagacttatgttctgagaccttcaattatccacgtggcatgtacgtggccatccagggcgctgctgtccctctacgcctcttgggcgcaccactggcattgtcatggactctggagacggggtcagcaacactggtgcccatctacgagggctacgcctcgccaggccatactgcgtctgggacctggctggccgggacctgaccgattacctcatgacgattcgtcactgaacagaggctacaggttcaccaactacgtgcgcagcgggcaaa

SEQ ID NO: 566741 - DNA, 128 bp, Homo sapiens
tgtagctgttctagaggtccctgatagcctcgggagggggtatgagcaacatggcatgtataacaagcagtgcaagtatgaacaacagtgcaggtatgaacaacagtgcaggtatgaacaacagtgca

SEQ ID NO: 566742 - DNA, 913 bp, Homo sapiens
  misc_feature (334)..(335): n is a, c, g, or t
  misc_feature (512)..(512): n is a, c, g, or t
  misc_feature (515)..(515): n is a, c, g, or t
  misc_feature (564)..(564): n is a, c, g, or t
ctctctctgtctctctctctctctctctctctctctctctctctcactctatctctgtctctctctctctctctcacactcagtcagggtgctacatcggactaaagactctgacacgaagacaatctctaaagaccatgacaaagaaagcgccttaggcgcataagggccacccagtgagagtactgaggagcggcggacagcaagctgaataaccatagccgagagcagcaaaaacatgttggggtcacaacacgtcacacccaaaattcgtacaaaaatatactaacatactcaatatagagcagtacataagtatagcgcaatggtgcgnnctcattcactgcaacacctacaggacggaaatgagcatgtggtggctgaagccacaacaacagaacgctaccaggcacaagaggaacgcgtatcacgaccacatcgacacacgacgcacgcgaaaactgccgcggatcagggtgtgacccacaggtatagcagacgatgcgcgacangcncaacgcacggcgacacacagagcacaacacaggcacaacagaccgcacngggacacacgaccacaaggacagcgcgcaactacaatgcacacggacagtcacacagcctgagacaaaacggcacaaaagccgccgcgcacaagaaagacacaccacggcgcacgaatggaggatatactgcatagaggcaccgcactcacaggcacttcagaaaagaaagggaggcggcggaatggccaatcacaaacttaaagggggccaaatttccaaaaaatgggagagaggaagtttaaaagaacggggatggatttagaaagaggacaaacacttctaaagcggggttggaagaacaaccacagggcacagggttccaagtggacacagggcgagggcatttt

SEQ ID NO: 566743 - DNA, 1730 bp, Homo sapiens
  misc_feature (1044)..(1044): n is a, c, g, or t
taaagggtctttacagtgaatataggatgatgttttccttagcagtgcctggcataataggcgatcagaagtggaactcatcagacccttgatgaacggtagatctctgaatcgttcatgacgggtaatgaggccccgtaatgtaaggaaggatgtgcgacgtactgcgagctgtaggagagtgagtccgaggataggtaggtcgtggtccacagtatattcaagaggtctgtcgtgactgatcgaatactcagtgtttcacctcgtacttaagagcctaagcgaatcgagcgtatgttctacgagttgggcacgggtgtgctcggcacttggtttgtctcgtattttatagtgcgtggattctctgatgatattacaagagaccagataagataatatacttagaggaatagagagactaggggagaaacacacatccatgctaagctgttcgcggtggagagctttcaggtcagagattttagaggccacacttgcgtgtaacagctgacaaaccattccgccaaccatagggcggttaatataattctacccttccgcaactaagccctcgggcgaactggcggcttaaatgtgaaattactttacttgcggtgggtaaacgattcggattatcctaagagacccttaggggtatacacaggcgtatgcttcaaacacgacttcaagggttcatcttgtgggggcacaacagcactttcaatagagaacaacgcccaccacaccacagtggccactcacacactcgtccgtccataacgcttaactcgaggattaaaccatatgacctacatttttctttggaacacacccccaattatttgaaactttggcacctaaggggtcgcctagaggcaccattcggcttttaatattaaggccctcagggatatgcgattcggctacatcaactttaccttaccaatcactatataaccacctattaaggagaccattacccgcgagtcttaacaacaaccgatttaggagcacccctatacttatggcgacaaattaataganatccgaccgagaaaacccaacataattcggcatagtatttcccacaaccgcaagggcgttgcgcataaggcgtgtccaacaacagtatttccccccatatggggagagtggaatatccccccaaggtggcatggggttcacattaatacaaaaatcatttccgccgacaaagaggatcattcgctcaattatggtagttgcactttcgcgttgtgggccaacgtataaaagcagttcataacgtttagcctaccaacacacatgggggagaactaccagtttcatacatttacttatggagggtctggaaaacagggccttaaggtttaactttacaaaacggttaatcatcgggctgtcataaccacacgtttttacagctcccggattatatattatagcatgggtatacctctgtaccatgtgacactccggttaccacacttgttggctgcagaatcaacgcaaagtgttgggcaagatagtcacaatacaggaatatatatggcccacaaagggcgtggtgtttaatcggtctaccgcaaatcgttattatgacgagatatcgccccgtgccgaacatagtaatcaactccccgtattggtgcaatcacacatgcggactgtagtcatacggtaatatatacatcatgtagtctacatgagagaatcaacactacatacgg

SEQ ID NO: 566744 - DNA, 223 bp, Homo sapiens
ccccccccccccttggggcttttcccggccctcccaaacctggggccccgggggtgttttccacccccgggagggggcaaaggaaattttttgggcgggttggggtgttggggggttttttttttgggggggggggcccccccccaggtatgggggggtttttaagggggggggcccctcccccaaattttttccctttattaagggggcttgatttcttcca

SEQ ID NO: 566745 - DNA, 154 bp, Homo sapiens
gacggcgggagcgggctcctcaggaacctcctacatcgtagtctagctcatgctcatccagctccctggtagcactgaggagagctcaatccctaaagtcgcttgtccaggtcttcctaccccttactgtccccctacctcctcgcaaggcgga

SEQ ID NO: 566746 - DNA, 424 bp, Homo sapiens
aatgttatttttgtccaagcttcaagtgatttggaggaaaatgttctcttcctgattggagaaaagaaactggacatttgacacctattcaaattatactgtaaaattttattttatttttgccttgagtatctgaagacactcaaagcagctctttttcaacccactgaacaagatgttttagctacaccgatacaaaaattacataagataagcatgttgtctacccttgttccgtaagtgttctttgaaagtttgtaatggttttctcctaaataaggcatggtgacacatgcctgtaagcctagccctttggaaatagtccggaatttctatgccaactcaggctacaggagaccccaggtcgaaagaataatttgttgtggatgtatttgaaattatccagccaactccctgttaaaca

SEQ ID NO: 566747 - DNA, 508 bp, Homo sapiens
  misc_feature (109)..(110): n is a, c, g, or t
  misc_feature (114)..(114): n is a, c, g, or t
  misc_feature (116)..(116): n is a, c, g, or t
  misc_feature (150)..(150): n is a, c, g, or t
  misc_feature (159)..(159): n is a, c, g, or t
  misc_feature (164)..(164): n is a, c, g, or t
  misc_feature (204)..(204): n is a, c, g, or t
  misc_feature (495)..(495): n is a, c, g, or t
ttacttctttgtgtggaaagagcatgggtttggattagttagattaaaattcaaattttagcttttctcccttggtagcaaaatgactgaccttgggaaggtgtgcacnncctntntgagcctaaatttctcactccccgaagaaaatantgatgtctnccttncaaacaccaggacatgctgttgaattcaaaagtcagatancaaaatgcataagaagtaagatgccactatgtaaacttatatatgcgtgagtgtagaggaagagatgggtatgcaagaatcgtcaacaaaatgctgatggtggctggttttgggagacatttgctttttcccttttttctttctgtaatgtttgaattttgggctaattactgtattaacagggaatgagaaacatgtttcagtattaaataacaaagttgttgtaactttaaaaaagaaaagaaaagaaacacgcattacctgatataaataagtaaaatgtattaaatntctgctaaacata

SEQ ID NO: 566748 - DNA, 281 bp, Homo sapiens
agcaacgccccccccaggttcaggccccatggaaaaaccccccctagttccattggtggatttggcccctcggcctggccaatcaaagctcccttgtcctggggttcctagtgtttggtttgagatggacccgtgacccaatgagcccccttttttgggggttttccccggagcatcaggaaggtttagctgggtgtttgggaccccggccggggcggggggttccggggggcccttaaacccttttttggagccctggttccccctgtcccttcccctta

SEQ ID NO: 566749 - DNA, 237 bp, Homo sapiens
tatacagtcatgtcataatcttggctcactgcaacgctctgtatccatggcattcgagtgattctcatgcctccgcctccccagtagctgggattacaggtgtgtgccccgtgtctggctaatttttttttttttttttttttttttaggcaccggtttttggctttgtggcccagtgtgaggtgcgcgttttataactctacggctcgcaacacatttgtgaaccccaaactctcc

SEQ ID NO: 566750 - DNA, 449 bp, Homo sapiens
gtccagaagagtctgcagcgtaattctgtgaggagatcctctggagtctagctggagatatgatagcttctgtctgttcgttggttcagaaatatccggtattgatgatattctttcgtcctatccatgagcatggaatgtttttccatttgtttgtgtcttttatttccttgagcagtggtttgtagttctccttgaagaggtccttcacatctcttgtcagttgtattcctaggtattttattctctttgtagcatttgtgaatgggagttcactcatgatttggatattattggtatataagaatgcttgtgattttcgcacattgattttgtatcctgagactttgctgaagttgtttatcagcttaaggagattttgggctgaggtgatggggttttctaagtatacagtcatgccatctgcaaacagagacaatttgacttct

SEQ ID NO: 566751 - DNA, 289 bp, Homo sapiens
ttttgttttcccccccacaaaactggactttgatttttgataggcgacctactgccttggagatcccagcctgagctccccaggtccctccaaggacccgagaggaacatcttactgcttctcttcataaattgagaggaaggaggcacaaaaacaaaaaaagaaacaaacaaacaaaaacacagaacaatatggaccagcccccttttaatttcattatattgatcagcctccctgtgataaaaacacaggacttgtatttagtttgtatacatttgtgaagtgcagc

SEQ ID NO: 566752 - DNA, 207 bp, Homo sapiens
ggtcgcccaggcggccggccggccggccggcccagcttcttctttcctcgcacagccaggcggccccatgctcgagtcccgcgtcgccatggccgccggttcccgagttgtcttcagcagcaggaggagagaccccagcaagcgtcaggtctctatcttttggcctgaatctttgatccctcgcttaaaagtttacatacctcatat

SEQ ID NO: 566753 - DNA, 101 bp, Homo sapiens
  misc_feature (14)..(14): n is a, c, g, or t
agtattatttactnggtcatctgggaaccttaatgtgatttattttgacaattactgtggcacatgtttaatctgcagctcctggcgactactgtgcttat

SEQ ID NO: 566754 - DNA, 893 bp, Homo sapiens
  misc_feature (122)..(122): n is a, c, g, or t
  misc_feature (207)..(207): n is a, c, g, or t
  misc_feature (243)..(243): n is a, c, g, or t
  misc_feature (451)..(451): n is a, c, g, or t
  misc_feature (499)..(499): n is a, c, g, or t
  misc_feature (668)..(668): n is a, c, g, or t
  misc_feature (690)..(690): n is a, c, g, or t
  misc_feature (760)..(760): n is a, c, g, or t
  misc_feature (870)..(870): n is a, c, g, or t
tcttggtggcctggatcttgtggctgcaatcggttccaaacagcagttaggtcagcagtccgctcagccgaggcagctctgttcatggcgttctcgaagctcttggagcaagccggagcagnggcctcttccagaccctgcaggtgctcaccttcatcctcccctgcctcatgataccttcccagatgctcctggagaaattctcanccgccatcccaggccaccgatgctggacacacatgntggacaatggctctgcggtttccacaaacatgaccccaaagcccttctgacatctccatccgccacgccccaacagggcccaccagtgcgcgcttccgcagcacagtggcagctctggacccatgcacggcacagctgagcgagtgacacggagcgtgtgtggacggctgggtctatgacgcagcgtcttcacctccaccatcgtggncaagtgggactggtgtgcagctccaagggcttgaagccctaagcagtncatctcatgtcggatctgtggctcttatctgggctctctctacgtttggagaacgatgctgagtgtgtgctgcagtggcgtgcgggacagaccatctcgccacatcgtcatctactgcggctgcggtcgtgcgctttggatgcagcatcttctgagtcactgacactgntgatggagtggacaaagacaanaaggagggcggtcacaatgacggtggtgggatgtgccttcagcgcaggccacgcagcgctgggcggcctngcttgctgcgatgagatctcactgacatatgctcttgcatctcctatatctgtgctgcagatcgcagtgctgatataaagcaacagacaacactcagactagaagtgcanataatgcacaagagcaaactaca

SEQ ID NO: 566755 - DNA, 175 bp, Homo sapiens
gaaacacctgtggttcttcctccggctggtggcaggttccagatgcgttctgttccgggggcaggtttagggggttgggccaagacttgttaagggtttggagaaccttttccttaacctcagtgttttttctgtgtgctctcctcacatgtgcgatctctgtgtgggactctga

SEQ ID NO: 566756 - DNA, 118 bp, Homo sapiens
cttcttgtaccactctatcagcgttcattatacatgtccacaggagagacctatcgactggtgtttctggaagatcattcctcttcgagtttcttctttgacataaacctccacctcc

SEQ ID NO: 566757 - DNA, 1355 bp, Homo sapiens
  misc_feature (439)..(439): n is a, c, g, or t
ggacgcgtcattgcagccggcgagagctcagctccgaccccgccgcgccccgcgcttcccaggaggttcatctgctccttccctgactgcagcgccaattacagcaaaagcctggaaggctttgacgcgcacctgtgcaagcacacgggggaagagaccattgtgtttgtgacctatgaagggtgtggcaagggccttcatcagggactaccatctgagccgccacattctgactcacacagggagaaaagccgtttgttggtgcagccaatggctgtgatcaaaatttcacacaaaatcaaacttgaagaaccttttggacccgcaacttgaaattcacaaaaccatatatatgcagtttggacagagtgtaagaagaccttaagaaacatcagcagctgaaaatccatcagtgccagcataccaatgatcctctatncagtgtacccaggagggatgtgggaaccacttggcatcacccagcaagctgaaacgaatgcaaggccccacgaggctatgtatgtcacaagggattgtccgttgggtggcacaaactggcggacttctgaactgttgtgagaacccataaggggacttcctatgtgaagtatgcgggaaaattaacgcaagattactagaccatgagaacttgcccaagggttgtgctgtcacagggggtgggacctcaccggtgttccacatctcctccgaagccctgtgtacggggacactaaacagtgtgtgataacaccaccctttggtctgatgttaatgagtggagttcgttgtgtttacactctgagtgtgacagaatgctagtagagtatacgaggacagtggtgagtgcatgagtactaccagtcgaacgtacagtgaagcatgcgagctcacagatgtgtggcgacgcgcggcggcgtgggcgtgtgtagcacatgacgagagccacgagtacgatgaaggagtgagtatactgcacacgaaaggagagagcgcgcgcaaggtgcgccagcgcaacgatgagcgaggagcatccggacgagatgacgaccgacagaggaccaacggtgggcgcaaggagaacaggagtgcgtctagccgtagccgacgacgagtagcgcagatcggggaccgagtgcaggagcgcgtcgcaggcgaggctggggggcgcctgagtgagcgctgcgcgtggggagaggagtaaggtgacgtgtgagcggcggctgcggcggtggtgagaagacacccgaagcgcacaaacaaacacgaacagaggcaacgctacacacaaaagagaaaagacgagcaagacaaaacaaacgacactgagaaggcagcataggaaagacacagcaaga

SEQ ID NO: 566758 - DNA, 216 bp, Homo sapiens
cccattgatcgatggagtcgcccctgttgcccttgggaccagctggtcctgggtagccagggtctcccttctgtccaactatccctggaggtcccgaatttccccttcagcctctgatgcctttgggtcctgttggtccatttagcccaaggtcacctggggtaccctttggtcctgggtatccagggaatcctctttctcctttttggctctgcg

SEQ ID NO: 566759 - DNA, 1308 bp, Homo sapiens
  misc_feature (137)..(137): n is a, c, g, or t
  misc_feature (588)..(588): n is a, c, g, or t
gccctccctctcaatttttctccagacaccaggagttgttcaccacaagggcttctttgtttgcaaccatgttgtgtgacgccttgtgaacccccgtcaaagggggaataatctttgtgcccacagaaaaagggganttcccccccttttgttgtgaaaagaaaaatcctcccccccctgttaggtggggcaaaactctccctacgggaagccttcccacggcctcccacaaaatttttcaacgggaaccacgcaccaatttgctccccacaaagccggagtggttgggaatgttttttcccccaaagcccctggatccctttcaaccgggcttggccccatgtgcgggtggaagcgcttatctttctatggcccaaatattgtaagagagtgttgtgccttgtccccacacggatccctctgccacaggagtgcgcactgaaaggaaattggtgctccacgagtcccccaagaggttcgcctggacccctctctctctgaaggcgtgcccccaccctcgtgggacacaatgtacccgcccccttgcgcgccacaagcgccaaacagccacagggagagtctcccacnctgagggtatccccgcgagggacccacgggtcgccacagtcccctccaaccctcgtgtgagaagttggagatggcccgtctatagaagaggacaccccacatgagaggtccccctcgggagaacgcgccacagagatggcgctgagaaaatgtgagagagagagagaactctttgtcccgctctgagaagagctgtgctataatctatccacacgagcacactatattggcccgcctcccgccacgcgatatgtagagagatctcactgagaatatatgagaagagagaggagaatattgtggcctctggtcaccacctttctgggtgagaatatccacacagagacacttgtctctcacacatgtgtttaagagtgggccctctgaccactctgagagagtttgccacccctcaccacggagaagctctgcctcggagaaggccgagaggaggaagccacggagttttcttctggcctctcttccacaaactcttttcctctccctcgagaacctcgagagggagaactatattctggagttcacctcccttctggttgagtacccacactccacaaaggacacactttctgagttataagaccggttgaaaactaagaagatggaccacggttattcacaccgaaaacttttcacgcactcaccgatgaccttgaataaaaattgcacaccctccgtgcccccatatattacccgcca

SEQ ID NO: 566760 - DNA, 220 bp, Homo sapiens
aggagaggatacggatacggagctgtaactgctcctggtgatccaggcaacgggcactttcgtctggtctgggctgtctgcacaccaaattttcctccaaacccttgcacatagtctttctgggactcgtgcttctccgttctgccttgatactcaaagccaacggcgctcttatccacttggtccttgtcgataccgtatgggcgcgtaagggccagca

SEQ ID NO: 566761 - DNA, 137 bp, Homo sapiens
tatcggcatcaggtcactttgctggggagcttacaaaccctccacacggagtaccccattttcgagtgaagatcaacctccggaagtgaaagaaacggcaggctacagtagaatcccgaatcaagtggcatcaatta

SEQ ID NO: 566762 - DNA, 716 bp, Homo sapiens
gggaatgccccaactatatctaggggatggacccccataattacccccatactccttacactattcctcatcacccaactaaaaatattaaacacaaactaccacctacctccctcgccaaagcccataaaaataaaaaattataacaaaccctgagaaccaaaatgaacgaaaatttgttcggtggattcattgcccccacaatcctaggcctacccgccgcagtactgatcattctatttccccctttattgatccccacctccaaatatctcatcaacaaccgactaatcaccacccaacaatgactaatcaaactaacctcaaaacaaatgatagccatacacaacactaaaggacgaacctgacctctaatactagtatccttaatcattgttattgccacagctaaccttcttggactcctggctcactcatttacaccaaccactcaactatctataaacctagccatggccactgcctttatgagcgggcgcaataattataggcttgcgctctaggactaaaaatgccctatcccactgttaccacatggttcacctacaccctttattcccttactaggtattattgataacatcagcccactcattcaccatatgccctgggccttccgcctatccggtaacatctcgtgtgagcccctactattgcaccttattggaactcccacactatacgtcatactaaat

SEQ ID NO: 566763 - DNA, 392 bp, Homo sapiens
  misc_feature (11)..(11): n is a, c, g, or t
  misc_feature (42)..(43): n is a, c, g, or t
  misc_feature (45)..(45): n is a, c, g, or t
accatcctccncacgcagttctctagcagctcaagcattctnncngtccagcatccttactcccatgaggtttgcaccggactcctgcacctattccagtcaggccgtcatcctgtgtctctctggccagcggggaagcccagtggcgttgcgtgggtgttggcccttgagattttttttcacatctttcgtctttctgttgatgagtcttgttctcatcaacttgttggaattccctgcaccctttgctgtgtccaccacagtggctgtccttccagctcaattcatactattttgattaacagaaattctgaacttcactgaacttcagtggtcctttaccatcctcccctcctctcccctcccgtcccctctccccttcccccgtagag

SEQ ID NO: 566764 - DNA, 392 bp, Homo sapiens
agggtacagacgatttacatgcgtagctgactagtcacatacacgtatgatgagattggggacaattattaatttacttttagtgtttactactctgactttcttaacgcatgtaagctatgatgaacataactttacgatcatggcaaaaagatttttaaaaacaaatccatttcctgagctctgagagagaaggtactccaacactcttgctgtaacaaaagctaaaaatgctgtaccaactatagaaaacgtttctaaatcagctgctcagctggtaaacacgaaaagaaattaggcacccaaggagatcagtaagccaagcactaaagtaagcttctgcctacagggcctttgccgaatatgtctgagccacacagactcctcctgac

SEQ ID NO: 566765 - DNA, 958 bp, Homo sapiens
  misc_feature (135)..(135): n is a, c, g, or t
ctgagtcagcgtctctaagaatggtgttctggtcctgacgggaccgggaggatgattgagtgctgagttgacctgactagcattgcgtgaagtgactgagcgcaggaactcggcgagtgggtgacagcctgactngctagaaacagtgtggacgtggtgacactcagtgtgtgccttgccgacgtcacacgtcaaccacacgttcattgcgacttgtgttcacgatctgcaggacctattgaagtcagtaggatggcgtagctgtgcgagtgagagtgacaactctaggtgaagccctgagcacttatgtgtaccactcgcgacgagtcacctgtctcccgaatggcgagtattctcactacatctacacgaagcaagtctctcaatgttcctcatctaacgctatgtagtagtctcgtgaactttgtgaacaacacaatgattaattcaacgcaattgcgtggcctcacatggaagtgagcgaggcggcaagagatcaaatcacgacagagaacatatcgcggggacgggcgtggactgatcaaagctgcttgggtgtcatcgttgccgcccctccagtatgtggatccatcgaactggtgccatctgtgaggccttgcgtctcattttgatccatacggtggatgtgacaaaaacctagagacttgtggcctccaatggttagcatgtgtggtcatccacatggggcaaagtagtctgaccaaaagctatcacaaggacgaatgtggcgtggacctgggtccagttcgttccacatggttggcgtgggtggtgggcccatcggcctgatacgcggcccggcctttcgtggcttcggtgggtggctcgtgtggagttgttgggcgttttcacataccaaggccggtgggcttgctggggcagagggaaatccccgcgagaatcagggtgggttcatcaaaggggggtgaacaatccc

SEQ ID NO: 566766 - DNA, 139 bp, Homo sapiens
gatttccgactagagctgtacctgccagacagtcgcccatagtcatttcgaccgatcgtaatacgggctcttgtgtctgaaaaccccccgcggaagctcccgcggtactacaagaacatcggtctgggcttcaagacac

SEQ ID NO: 566767 - DNA, 1275 bp, Homo sapiens
tgtggggtttttattttttttttgtggtctctcccactctatgtgtgtggagtagagggctctctagaaaagaaaaaaaaaaaaaaaaaaaaaacaaaaaaagaaaacaaagagagggggagacgcaaagagatgcgtacgcggaggggcgccgcaccctcgaggcaacacccaagaggcggaccgaagaggggcgccaccaagagaagagagagccaataataaacaagcagcacgagcggcgagcggacgagacgagagatacaaaacaggagagggaggacggggaacaaacgaggggaaagcggaggagaaaaagagaagaaggaggaccaccacaagcagagggagaggagtggaaacaacaacgtggagaggacaacaaacaaccacgaagaaaagatacaagagcgaacaggagagggaaaaacaaacaccccgaaaaaaaggagagaacagaaggggcgaaaaacaaaaagaggtagaagaagacgggaggccggaaaggagagaagaggagacaaaagggagagacatagcacacacctaagccaaagaaaaaaatgcacacacccagcggagacagaaaagaagacaaaaaaaaagagaaaaagaagacgacggagaaaggacaaaaagcgtaagagaaacggcggaaaaaacagagggggaaagagagggagaggggagagagaagagaagcagaggaagaagaagaagaaaggaggcagaggaagaggggggaaaagagagagggaggagagagaagaaaaaggaagagaaaaaagaacgcagcgaacaaaaaaaaagagaagatagaaggaaaaagaaacgacagaaggaggaaaaaaagaaaaaagagagacaagaaaaaaaagaagaagagaaagaggagacgaagaagaaagcaaacaaagagaaaagaaaaggaacaagagaaggagggagaacaacagaagaaaacagacaagaagaggaggaaagagagaaggaaaagagaagaggaggagaagcgcgagcgcagagggaagaggaagagagaagaggaaagaggaggaaaaaggaggaaggagaaggagggggaaggaagaggggggtaagaggggagagaggagagggaggaagagagaaaggacaaacaagcaagaggagagacaacaggaaaggggcgggaggggagggagaggagggagcaggggaagcgagaggagaggaggagggggggggacagaggggaaggaagaggagaagaaggaaaagggagagaagaggaag

SEQ ID NO: 566768 - DNA, 555 bp, Homo sapiens
  misc_feature (14)..(14): n is a, c, g, or t
  misc_feature (251)..(251): n is a, c, g, or t
  misc_feature (291)..(291): n is a, c, g, or t
  misc_feature (317)..(317): n is a, c, g, or t
  misc_feature (336)..(336): n is a, c, g, or t
acctcccgtttaancaacctcagcagctactcccagcctctgcgtcctcgggagggccgggctgcgtcgggaccgggactcgtacccgacgaccacatcactactccacacgcgccgccttcgcggtggcacccggcagctgcattgggcgcgcgctccaccttaaggagaacgcaaccgtccgagccagccggacgcacgcgcggtgtcccatcaaatggaagaccaagacgcataaagtggaccacgcntgcggaacggctggcgcaccaagtgcggaacggaactgancgcatccgcctggaggacaaggtganacgctcaaggcgagaaccngggctgtcgagtaccgccggcttctccgggagcaggtggcccactcaaacagaaggtcatgacccacgtatcaacggctgttcacgtgctgcttggggtcaagggacacgcgttctgaacgtcccatgccctttacggacacacctcgcttggacggctggcacacgcttcccactgggtctaggagcaagcgtgggcagcaccctggaactagggcgc

SEQ ID NO: 566769 - DNA, 192 bp, Homo sapiens
tacaaaatgggagagaaacccaggcgccctgcctcctgtcttttaaggttctggagctaacacatttcagggggcccggaaactgaggaggcgggggtggttaacctatggaaaaaaggatgccctagttgggggatgaggcccaggtctgaaaatctgctcttgggtttatggcccaggcctggcctttag

SEQ ID NO: 566770 - DNA, 167 bp, Homo sapiens
taccggggctgggacgacgactacggacgaccgtacggacctgtctgtgattacggaccggactcacgaccgacaacgacggtggcgtcttggtacttgtggttactgtgcacgggaggtctttactactctgactacactttgtctggtgactgacacactttgac

SEQ ID NO: 566771 - DNA, 313 bp, Homo sapiens
caggtgtctgtcagggttggggacttaaagccttttctggctgctgggtgaaaagctgctgagaaggggatagcgttcacctaggagctaggatgtcgcgctaaaccagattggccttaatcagccctcctccttcctcaagatgccctacaggggagacatatgatacaacggaaaacatgaaatgacatacgaaggagtccaacctcttgtgattgtcctgctagaatctcacccccggaaaccccacagatactttcttggcaactgtgaatgacgtctatagaggactgccgactccccatgtccagct

SEQ ID NO: 566772 - DNA, 230 bp, Homo sapiens
  misc_feature (76)..(76): n is a, c, g, or t
ttttccccgggaacccctttgccccttgggcccttttgggggccccttttgacccagtttggccaaaaaacccggntgggccggggccggaatttccggggttttgtggccccccggggcccccccgggggcccttttttttggggttcccccttggcccaacctgggcccaaatcccttttttttttttttttttgggggggatttttcttttttttccccccccctta

SEQ ID NO: 566773 - DNA, 292 bp, Homo sapiens
atgaagggctcgtatgacatgatgctactgagaccaccatcatcattagctggagaaccatgactgagacgatcactggattccaagttgatagccgatccagacaaatgccagactccaatccagagaaccatcaagccagatgtacagaagctaacaccatacacaggtttacaaccaggcaatgactacatgatctacctgtacaacattgaatgacaagtgctcggagaacccctgtgttcatcgacgcctaccaatgccaatttgatgcaacatccaacctgagtat

SEQ ID NO: 566774 - DNA, 259 bp, Homo sapiens
ccccccttttgggcccccggggggggccccctttttttttttccccccccccccccccccggttttggggggggtttttttaaaaaaaaaaaatttaaaccccccccaatttgtcccttttggggcccggggtttaagggggggtttttttcccccccctttttttttttcccctgggcggtttccccccccccccggtttgggccccgaaatttgggaaaaaacccccccccttttttttattttcccccggtgggga

SEQ ID NO: 566775 - DNA, 109 bp, Homo sapiens
gcctccccccccccccatccccggtttttgtgttgggtttgccagggtcaggaaaaggggcctgtccctggtttttttttgaccgggaaaaaaaagcccctgaaggaga

SEQ ID NO: 566776 - DNA, 841 bp, Homo sapiens
ctagttctagatcgcgagcggcgccctttttttttatttttccacttgttttctttttattgggtgtgggatccaggacaagggcaggggggaactcgaagcgggggctttcccttagtcttctcgattattcccccgaggccccttggcgccttctgtggaatgtgttcccaacaaggggcaggggtttcggggggctctcagccttctttctgtggggcaggccttcagccctgtgggttatgtgtaacaagtctctgtggcctttgaaattgtcgcctttgtggccttgtgaacctttccgaacaagggtgctaggaaattgggtctccgactttcaaagaggggcagaaggcaaacaagggcccactttccaagcgtgggggcccctcgggagggccacgaggaagaaccgaggcacccctcgggtgttgaaaaaggcaggggaagaaagaagggaagaagtgaactcagaaaagctcgtgggcgacaagaagaggggcgccctcacgtgagaggggtaagaaaccaaaggcttctatctccctttgtgggggtgtgccccaaagcccaaacccctgtgtgggacagccgtgcccacttttgtgccccgtgggtgccccatcccgagcccctgtggaacccccgcggggtgactctccaagccgactgtgtctccccaacggaggggcgtgctgagagtcttccacaaagggactacaagaggcaccccaacactatatatcccctagggagatctacatcaggcagaaagtagaccgtggcgtgtcgcccaacccttttacaacatcccacaggggttctcagggctaggaaacgg

SEQ ID NO: 566777 - DNA, 475 bp, Homo sapiens
aattcttttccccagcaatggaagaaccctggggaaggaatgcaattcctgggggtaggtctatagatggccgctctgggaagtgttggtcttatgccggttgagataaggattgaaatacgccctggtgtcctgcaagtaccctcaggcttacttaggattgggaaattccagccgggtaaattctagtcagagtggttctctgttctcaaaccctgtttcctgtgaagatgtttatcaagacaatgtgtgcacagcaggacatagaccctcatcagtaattctaattttgcctttgccttgtgatctttactgccctttgaagcatgtgatccttgtgacctactccctgttcgtacaccctctcctcttttaaaatccctaataaaaacttgctggttttgctgctcggggtcaccatcatagtcctaccactatgtgatgacagccccagaggcccagctgtaaaatttca

SEQ ID NO: 566778 - DNA, 751 bp, Homo sapiens
  misc_feature (289)..(289): n is a, c, g, or t
  misc_feature (376)..(376): n is a, c, g, or t
  misc_feature (408)..(408): n is a, c, g, or t
  misc_feature (422)..(422): n is a, c, g, or t
  misc_feature (447)..(447): n is a, c, g, or t
  misc_feature (452)..(453): n is a, c, g, or t
  misc_feature (532)..(532): n is a, c, g, or t
  misc_feature (570)..(570): n is a, c, g, or t
  misc_feature (574)..(575): n is a, c, g, or t
  misc_feature (587)..(587): n is a, c, g, or t
  misc_feature (601)..(601): n is a, c, g, or t
  misc_feature (610)..(611): n is a, c, g, or t
tggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgtcgttttcccaaagagaactccgtatgttctcttaggttgagtaacccactctgaattctggttacatgtgtttttctctccctccttaaataaagagaggggttaaacatgccctctaaaagtagggtggggtttntttggcaacaaaaaacgggggaaaaacagacataaattcatcagataacctcaagtcacatgagaatcttagtccatttacattgcnttggctagtaaaagccatctatgtatatgtcntacctcatctcctnaaaggcagagtacaaagtaagccangtatnncaggaaggtaacttcattttgtctatttgctgttgattgtaccaagggatggaagaagtaaatatagctcaggtagcantttatactcaggcagatctcagccctctactgagtccnttanncaagcagtttcnttcaaagaagccancaggcgaanngcagggactgccactgcatgtcatatcacactgttataagttgtattatgaatatttatgtttacgttgcacataatagggcgcaagagcacattatctttagaggaagagatgatgtggaaaatcaagtacgtgtagaa

SEQ ID NO: 566779 - DNA, 137 bp, Homo sapiens
ttatcagtactccagcggctaatcagagcatgcctgagcaagtacacaactgagaatgtcatcagagaaatatgggaaagatgcacatgtgggatgaagcggttgtccaatctgaaataagaagctgagctgctgaa

SEQ ID NO: 566780 - DNA, 394 bp, Homo sapiens
agcccgtacggctagcggcattagtgaacggaaccagataacagtgtttttgaaatggccctcaatcacaccttagagctcggcttccaattctgttcatttacgatgagttctcaattacctgacaatcacacaaaacctgtttatatcaacgactaccctagtgaatggaacactgtctataaacaaggacgcttcttcgaaatagaccccgttgtcgcccactgcaaacgcagcgtattgccaatagtgtgggagaagaaggcatttggcgccgcgccgaacctgtgggaattggcccaagcgcatggtgtgcacctgggctggacgcagtcagtgcatgatttccagggggtcttcagcatgctgacccgttcacttaatgccgctagcg

SEQ ID NO: 566781 - DNA, 598 bp, Homo sapiens
  misc_feature (476)..(477): n is a, c, g, or t
cataaagcaaagtgagactttatgctcgactttattaaagtctcaataaattcggcagggtgtggtggcttacgccgataatcccagcactttgggaagccaaggcgggtggatcacgaggtcaggagatcgagaccatcctggctaacacagtgaaaccccgtctctactaaaaatacaaaaaattagccgggtgtgtggtggcagttgcctgtagtctcagctactcgggaggctgaggcaggagaatggcgtgaacctgggaggcggagcttgcagtgagccgagatcgcgccactgcactccagcctgggcaacagagcgagactctctcaaaaaaaaaaaaaaaaaaaaaagactcaataaattcaaaaaagtcgagatcataccaagcattttcttgggtcacagtggaataaaagtagaaatcagtaccaggaagaactctcaaaaccacacaattggccaggcacagnngctcatgcctgtaaccgcagcactttgggaggccaaagtgggaggatcatttgaactcaggagttcaagaccattctgggcaacatagcgagacctcatcgctaaataaaagaaaaaaaaa

SEQ ID NO: 566782 - DNA, 1081 bp, Homo sapiens
ggggctgctgcgtgtgtgctgtcgccggctccgagctgcggccgagcccccgatggaggccgaggccgcggacgctcccccggtgcggggttgagtcggctgctcagctgcttctctttcacccaggactgacacatccctagcaactcggaactaaacgccgggtataacgctgtaatctctgagttctgtggagcagctggatcaaagtccacggcaacgcaaatgcacatccctgagacgtcatacaatctgtgcgcacccgcctcattctccagcagacctggatggctgggtagatctcagctccaccacacacaacccacaggccacacatgcacaccgctgctcctcaccactcccacaggcacccaggccaccagcagacactccgcacaacacacacagccatcacctcccagccaacacccactccacgccccaatcacacggcctgaacaccaccgcaacccagcgcccgcacgcgccacgcccatcagaaagcgcaagtcccaacgcacatactaccggcccacaccacctcaacaacaggaccacgtgccacacgccctggtcccgcccaccgcaaccaccctcccctggagaacgcaatacccccgtgccgacaacgcccacaaccacagggccctaaacgccggcacacgcgcctccagaatcacacacgccaactacgaccacagcacctccatacaaccacctggcgcccccaaacgccaccaggtgacaaagcaccctggcaacatatcccggcggcggaaaggagtgcggtgacctacaactggacgaggcgccaacagcactgcaccatgaaaaccacaagacgccacagccacccacacaacggacgcggaccccccaaccgccccgggaaacctgcaccaacgccagcacccaacgacacccccatcacagtcgcccctacagcggccacccaaacaccaacacccagccgtcacgcttccgtcaacacccaggggcacacggcacagacccggccggaaccctcctcgaccccccggcacggggccaacacaacgacccacggcagcccccccaaaac

SEQ ID NO: 566783 - DNA, 1487 bp, Homo sapiens
tatatggtttggttataatttttttttgtacatctccaaaaaattagacatttaaaattatttacctccgggtgtacacaagaaaaagattatttaagggtttccttatttatttctacattataacaacaacgacaaagcccctttaaaaaaaacaacaaacaaaaaaaacgcctatactctcttctctctattctttgtagaacatatacttgtgtggcacagaaggggagatataccggggtatccttttctcacaaaatagcaccaaaatgtgctctctgtgaagggggcgtgtgtcgccctgtggtaaaaaaaatattcttgggtatttgtgagagaaacattcagctcttttgggcaaagaggggtgggggcaaagacacagaacaatatataaggggcgtttatacagaaattgtagaacgagaggagagaggtactcaaagcctctctaatattgtgggccgcgggataataccctataaaaaacaccactgtgatatagagggctatctcaaccaacacctgtgtgtgaggcgcacaagaggatataagaggcatgaagagagtgtggtgatgggtgatgggaggatgtgtctccccacactgtgcccccaacactacccccggggagtatccagaaaagtaaaagagagaatatatgaggacaacaagggcgaacatatcgcaaacactacacacgtatgccggggcaaataactctcccgagtgtgtgtgagagggagctatgacgccactcaacacagaaaaagaggccattagttataaaacccatctctttcagagtgggagaacttatggagagttagcaaactctggaggacacaagaggggaattttaccccacgtgcccaaagagtattaaaaaaacccccaagcccatctttttgtcaaaacatatcctcacccggggagaacacccttgatggagacgcaccaatagtgagccccaaattgagagaggccacctagacggacaacatcttattaaaaaaccctccaaaagggtaaaaaaaaggagatcacccaaaaaaaaaacttatgtatgagcaagagggacaacaacccacccatcataaaaaaaagaagagcaggagcaaccacgaggagccacacatagagagagagcgaccccaaaaacacgaaaacgagacgctgcggacgaaaggggccaccaccaaaacccccctatatgacacagttgatcagctagaacctccgtaacaagagcagacctacatgcggggaaaaagacagcgatctaaccacacaagaacaacgggatctcgcccaacacacaaacacaacatggagtggcaaaacacgcattgtgtgccgaacaaaacaaaaagaggagctcaataagacgaggcgtactatgatgaccgacaaatcataaaagacaactactgtaatcactatctctttcttcctctccacctgtctcgtgcgtccgcagcacc

SEQ ID NO: 566784 - DNA, 398 bp, Homo sapiens
agctatcgcgtcacgtgtacaccacaccaccgcacaggggacacatggggcatatataccacctacgagtacacacactgtctctgtgactccattgagcacatcactcactcactctgcgccaagggattccaggcccgacgctctttctacttctggctttgcaatgcactggacgtctattggcctgtgcagtgggagtatgggcgccttaacctggactatagctggggctctaagaggaagagactccagattggagcaactcgggccgtgccggactcggaagacccacgggtctttacacttacgggcctgcgacagcggagctttccacctgagggcattaacaactcttgtgcccgcgggggagtgactgtggcacccactggagccac

SEQ ID NO: 566785 - DNA, 275 bp, Homo sapiens
ccggcctcttctatactaggcggtacctagtggctgctgtctagttttgctccatttttttcagctacttatccagtttctcaccctataactatattgctgctaccatcttctctccaggaggatcgtaaggtttgggacgggcagacccggcagagaacacctcgagcatgggaggctcctatttggagagcccctggtacaggggctgtgctgaggagaccccagataggactctgggctcatacagatgccactatcattatctgaagggg

SEQ ID NO: 566786 - DNA, 423 bp, Homo sapiens
  misc_feature (96)..(96): n is a, c, g, or t
aagagtgagttttatgctaatgaggcctgtaacgcttccggggcccattggaggaaaaagcccagatcatttggtacccagagacagggccctatnttgacctccttattccccctgggtgtcggggttccctgcatgccttggtgggcagtcctattatttggggaggggagcccagggctcattccatggctcaggtggatgcttggaaacaatccaaaacttttttccccaaacacttgggtgggccccgagggggcaatcccatcaaaagtgtaaattttatttgatcatggggcctctttgttggtaatctttcctggaaacatttgccacatttaggggggggatggggattcatttttttgtttttaaaaaataaagttttttcccctcattattaaaatggattttccagtaaga

SEQ ID NO: 566787 - DNA, 1612 bp, Homo sapiens
ggcctgatgtctgcactgaccagacgcctcctaggtgggccagcgagggcggggtcccaggtgcagtggtgatgcgatcaggagagaggccgcgggcggcggcgcgggggatggtgcagatcccgggcccgagggacatcagagcggacggtggattagctcccggtatggcatcagccggagccgggggatgagctccgggttggcatcacccggaccgagggagacttaagctcacggttatcagctactacgactccggagaccggtggggaccgcggccggacgacagccgaagaactgcggcgagtcggggagaggatggcatgggcggttccccggctggctgacgtcacggctggctaagaggacaccggaggccagggcatgtgagcgtggggactgtggatccacggatgcgtcggcgaggcatgacgcaagctgcggcctgggcacaatcgtgcatggtgcgcactggaggcgtctgaggcgcccggaggggcagcccggggctcagcagcggaacgaacggggtgcagaggatggacggagccacacgcgccttctggggctggactcctgggcggggatatccgcgtgatctcagggcacagaatgcggtccgtgaggtctgggaatggcaggaatcgtctgatgagtagcccggaagggcgttcaccggattccaagtaacagggaagcctcccgatggggtgggggtccgccacgagggcgcagcaagtgggcccacgccaatgttcctggttggcccactgaagtgcacgacgcgtaccctggctcccgacggactcagtgccaacgttggcctcgttggggcacaacttgatactaccccggtcatctgcgagtcccacctaatgcttgctcctgtggagaagcgcctccgaacgcgcacggggccggcgcgcagcgccgcccctaaaaaccgagcgggcaccgttgagcaaccaggcgagcatctaagggcaaggggcacaccggtgacgcttaatgagcccattcggcacggggggtacgcgccacggtgagcagggggcaaccgacccctcgtggctacgtcgacttaggagaggcccactaacagacgaagcggactaggaacccacgggagaaaaaacatagacggagtccaggcaccaaatcgagggaccccctcggctcgggacccccaggggcgtataaacgggcactatatccaagtatgcagaaaccccattggggaccctgcgaaacgaggccggggcgcacaggccgcgccagaggatatcccgttgaccacagagcatgtgccccgggcactcatcaccaggaatagggcaacaggcacgagaggagcagtgacacacaactgcgagatcgcctcctgccgaagcacacaccgaacgagcgcaagatcacgagcgcggcaacgacaagacgctcagaagaaccagcacaacgtcgacacgtccgagccaaagcactacagcgagacgcgcatcccagagcagtaataacaccactacaaacatccagcggagtgagctgtcagcacagcagcatagcgccaagtcgacgcagccgcaccagctggacgacgcctcagccagac

SEQ ID NO: 566788 - DNA, 394 bp, Homo sapiens
  misc_feature (81)..(81): n is a, c, g, or t
  misc_feature (313)..(313): n is a, c, g, or t
  misc_feature (345)..(345): n is a, c, g, or t
  misc_feature (378)..(378): n is a, c, g, or t
ggtaaagcctgggctcagtacagcctttcagtaaagaagagaaaccagtggcgaccttaagagatgggtgaatctgggtgnaccatgcacttttccctgctaagactctgggcctagttcaagctgacccaatggcagaggactgcctgaagagtaaaacctgtgtgaaccaatgacctgactgcccagtgttttcccatgtattgcatagggttctaaccagcagggtttgggaacctgtctctaagtaatgcattacttctgtcagaagtgtcttaggggtggttatctagttcagtactccaaattattngggaccttgaggctttaagtaagtatttttcntgaatataatgcttaaggtaagttgcatttccntttaaacttaatagga

SEQ ID NO: 566789 - DNA, 241 bp, Homo sapiens
cctagttttagaagtttcaatagcacgagccactggacccgatgatgctgatcacatcaccggccgcggcggccagggacacacctttgagcacttcatgactgccactagcgtttatgcaggtcttggacttcaagtttgtacatgcggtcggttctcacaaaaacagttggtcagtcgttgagcaagcgcccgtgccgcagcgcttcgcgcccctgctattgaaacttctaaaactagg

SEQ ID NO: 566790 - DNA, 831 bp, Homo sapiens
ggcgaggcgccgcggtcggttctgggactcgtctggcgtccctcagaggcagacgaggcctggagcttgggcacacagacccaggaacagatgagcagggatgtcttgcatccagcaccctggctcgtgcaccctactaccctgtgaggcccaagaaggcgagtgggattacctggacagcgtgtcccttagagtcgctagtcgcgtcaaggttcaatgactgacagcatctggagagattctgtgtcagtttcccccgtctccagcatatgttgcagatcaacgaaggaggccttcactattttactcttcagactcgatcaccatccatggagaagctgccatgccaaaagcacgtgttcagctccgctgcggccaagtcgaatatgtggtcttcagcatcaatcgagcatttctggagggagctgttgcctgttctcagcctgtgatgccgtggcagatctgcatctgtcccattggaccctggggcgaaggacgctgacgggactcattggctggatcccagaaacgcctggaggacacaggctgagggtcctgcacctaccagggcctagcaagctgtacgcgtcttgataggccgtggccacgcactggagtcagacctggaggctggtggacagatttgcttgtgagacactggaatctccgtgcttgggttggcctttttgctcccaagctttggaggaccccacctgggaacaagcccggcaggattctccatgaccagttgtgaacctttgtgaaccgcccggctctgggatacaatcctggggtgaattcccgagaaagggtctccggtaaccgggggtc

SEQ ID NO: 566791 - DNA, 337 bp, Homo sapiens
tgatgctctggtgactgcactcctgactgcgacgtttacgaactgtgtttaggagtgggcttctcggggatttcgcggggtgctgcctgttgggggcccgtgccctcctaattggggggttgtgtggctaggctggagtggtcaacggctcagaccaatcctgcgacgccccacccttctgcggtcctaaataggattatcccgtatcgaaggcctttttggacaggtggtgtgtggtgaccttggtatgtgctttctcgtgttacatcgcgccatcattggtatatggttagtgtgtaggtaagtaagcctagtatgaggagcgttatggagtgca

SEQ ID NO: 566792 - DNA, 204 bp, Homo sapiens
cgctttttcttgccctggctcactctgagagccttgcggtctccccagtcagaccagggctacagtctccagggccgggtcttgcccctcttctccggtggtccacgctggcagctcttggtttcggggctagcttctgcctccctttaggatctgtgtctcccagggatcagctgcttggcttctgctggaggtgcctccctg

SEQ ID NO: 566793 - DNA, 83 bp, Homo sapiens
attgactttggggcaacagggttgatcatttttttgttgggcatttttgccaataaaggttttggatagccggaaaaaaaaaa

SEQ ID NO: 566794 - DNA, 364 bp, Homo sapiens
ctacgaggccacggaataacgagcttaagatggggtggagccttactccactgcgccctaggctacagcgtggttaccttatgggtgttggaggccacacaaagaagtctctgttatcaacacagtgacagtggggagtgggtcatgtcccacgatgatttggaacacaggccagggtcctatgaccctgctggcatgatgggtgcggtccataaggaaatgggcagagggtcaacttgtctcttctttcaccgaaaagactgcgaggtctatagttcacggtcaccctagggctgctgacatctttcatgcccagagtcacatcctgcatttctgtaatgcatattccctatcctgccgagtc

SEQ ID NO: 566795 - DNA, 171 bp, Homo sapiens
tgtgctgctagatgtgcacacacacagagacctcacacacagacctcacacacacagacctcacacaccacacacacatgacctcacatcacacaccatcacagatgaccacacacacatgcgacctcacccacaaaccccctctgatgtgcctcgtagctgtgcaccctg

SEQ ID NO: 566796 - DNA, 331 bp, Homo sapiens
  misc_feature (56)..(56): n is a, c, g, or t
  misc_feature (62)..(62): n is a, c, g, or t
  misc_feature (74)..(74): n is a, c, g, or t
  misc_feature (87)..(87): n is a, c, g, or t
  misc_feature (187)..(187): n is a, c, g, or t
  misc_feature (193)..(193): n is a, c, g, or t
  misc_feature (202)..(202): n is a, c, g, or t
  misc_feature (294)..(294): n is a, c, g, or t
cacccacagaggcggcccctgctggcaggctatgcctgggtgtgggactcttcctncttctnctccagcccctnacggaccccaagntctacggcagccttcccctttgtgtgcttttggagcgggcaggggactcagaggctcccctgtgctcctgacctatgttcctgggatacgctatgaactntgaccngctccccanccctccccaccaaggggttactgcaggggaagggctaggtgggggtccccgagatcttagggaatttttttagggggattttaagccagagntagtttgcgttcccagggaccaaggagaaagaagcat

SEQ ID NO: 566797 - DNA, 154 bp, Homo sapiens
atcccaagcagactgtgctcatacccttctcacctctcccatatctgacacctaattattactcctggatgggtgccctcccacctccctaaccattaccccacaggaatgctgcaccccataggttgctgaagactcccatacttgcgcatgc

SEQ ID NO: 566798 - DNA, 538 bp, Homo sapiens
gcggcgcccttaaaataccctgaaagtaagggaatagactctatccagaaatctatagagcagatagcagaaagtagaaatggttcagaactagggaaaaaaacaagagactcaatggagacagaagaaaatcccaaggttctaataactagcatactgaaaaaataatactaccccataaggtagaagtgaaaaacagaaaaataagaccctgtggagaaatatcgttgtacccactgaaataggactagactagtaaacgatagacaccaaaatgaacctagctatacaagaaatgctcgtcatacagtaaactactggataatacttccagataatgtccttgctttacaaaccaatcataatctagagagtctccttactcattaatacaatgaaatggataggtacgatgtctttgaaaccatgttagtcaaggactggtaaaaatacatataaagattaacactcataaccaatcataacaaatactaattccaactacaaatacatcctttgtataacgcacaaaaaaaaa

SEQ ID NO: 566799 - DNA, 242 bp, Homo sapiens
tcccttggaagatgtgcatggaagaatgtgcccctcagacagtctcagttacagagttgtatgcccagaaccatttactttgttctttgtgagggatttaagagattttttaaggataatttttactgtatttgatttttgccctataagctcactttagaatcctaaggtgggacttcactgtatcacacttggccctcataaatgactacgtgaggtagtatacaacgcacattcttcca

SEQ ID NO: 566800 - DNA, 228 bp, Homo sapiens
cggtaatcacaactaactaataactgcattaagtaaaccgaacaagcatatacccaccacaacgcgcaagtacaactagcagttgcttccttgccttcaagtgagtaatgccatagccagctacgccaacagtgtaacaaccgccataggagtcatatgctagaagccttacagatgcaatcgctacacccccggttataaaggccatcctttccaaatcacaccgac

SEQ ID NO: 566801 - DNA, 135 bp, Homo sapiens
ggtggcggagtgatggtcaggacaggtgagaggtacggcaggaggattgttgagaccaggagttcaaggttgtagtgagctatcattgtgtcactgcactccagcctgtgttcagagtacagatccgtctcgggg

SEQ ID NO: 566802 - DNA, 334 bp, Homo sapiens
gaccctccctctgaaaagtggggctatacaccccctgcctacctgctcacaagtgagaattgaaaccaagtgctgggcctggcacggtggctcacacctgtaatcccagcactttgggaggctaagcaggaggatcacttgaggtcaggagttcgaggccagcctggcaaacatggtgaaatcccatctctaccaaaaatacaaaaatcagccaggtgtggtggcggatgctgtaatcccagttacttgggaggctgaggcaggagaattgcttgaactgggaggcggacattgcagtgagccgagactgtaccatggcactccagccgtcgac

SEQ ID NO: 566803 - DNA, 121 bp, Homo sapiens
acttccctgccttattaaacctggccgggattcgggaatctgcttgacagagactctggccaaaaacgctcatacttcttgccagcttcttgaccgttttttattcttgttgagttttttc

SEQ ID NO: 566804 - DNA, 394 bp, Homo sapiens
  misc_feature (183)..(185): n is a, c, g, or t
  misc_feature (187)..(187): n is a, c, g, or t
  misc_feature (192)..(192): n is a, c, g, or t
  misc_feature (263)..(266): n is a, c, g, or t
  misc_feature (313)..(313): n is a, c, g, or t
  misc_feature (353)..(353): n is a, c, g, or t
ccaggatggtctcaatctcctgacctcgtgatccgcccgcctcagcctcccaaagtgctgggattacaggtgtgagccacctcgcccagccctaacttttttgaagtatttaacttacagaaatgtagctattagaagaataggggtatttctgtcattttttttttttaagatggagtcttnnncngtcancaggctggagtgcagtggcacgatctcggctcactgcaacctccgcctcctgggttaaagcgtttctcctnnnncggcctcccagctactggggaggctgaggtgggaggataacttgagncgggaggcggagattgcagtgagccgaggtcgagccactntaccccagcctgggtgacaaaaatcctgtctctatttttac

SEQ ID NO: 566805 - DNA, 184 bp, Homo sapiens
gatctagagaccccagaggagaagagaacccctttggtaaatttattcctaagagttttattctttttgatgctattttgaatgcagttctactggcacatgctgctgcacgtggctaatattttttgttaattttttggtagagatggagtctcgctgtgttgcccaggctggtctcaaattc

SEQ ID NO: 566806 - DNA, 118 bp, Homo sapiens
ttgcggccgcttgccctgatgccataagttggagggtcctctgctcaaaacatatggtactagggagggagggaaggacgtgggaatgttttcttattggatctgagagatgatacat

SEQ ID NO: 566807 - DNA, 490 bp, Homo sapiens
  misc_feature (164)..(164): n is a, c, g, or t
  misc_feature (175)..(175): n is a, c, g, or t
tggagacgggggtctcaccattgtccaggctcagattttttgggtttggtttggggggtttccaggtccacggtcatctcagcggcaaaacaccaaagtcagaaggaaggttaatctcccaagtttttgggtggttttggtttggtttggtttttggagacagntcttcactctntcacccaggcgggagtgcaggggcacaattttcaactcatggcaacctctgcctccagagtagctgggattacaggcgcatgccaccagtgcccagctaagtgtggtattttaagcagagagggggtctcaccaggtgggccaggctgggtctggaactcgtgacctcatgatccggtcacctcggcctcccaaagggcggggattacgggcatgagccacggaggccgggccagcctatgcattttaaagaaattattcggtatgaggggcggtgctagacatggggcactacagtgaccaaaacagacggaat

SEQ ID NO: 566808 - DNA, 1020 bp, Homo sapiens
tcggcacgaggatttgacgaagaagtaaggtgagttagaggaagaagaagaagaggaggatgaggagtgaggaagaatgaactggaagagtgtggaagacctgtgagtttgtgcacagcaggaggggacggtagaagaagtgtgcacctccagccccaaccctgcctccagctctgcctcccccatgagtctcccccaaaggtgcatgccatgaacccaggaaaaccctgaagccccggtgcttgctttttgtgaatgtttgtggatgtgacgccatgtggactgtgatggatgtgagctgtaggtggcttgacacaagctccacacacatggcccctgaatgctgctcccctcccatgaggacgatggtggaagaagtggaattgtgtgtgaaaagccctgcggaggcaatggaacacccacttcccccaggagcattgtaatgaaagaaagaagcccgtacatgcatccacacaaaaacactgatagaggaaagatggaagacgtgaggatggggaagtgacaaaggtgcaagccacacaacagaagagaaccatgacaggaagaaagagataggagacaagaaggacaagaggacggaaagctctccaggacaaaaggagacaggatgaacaacaggctggacatgacatgtaccagactagcaatcagataggtccccctgtattgaatagaggaagccagcaaccaacgcaaaagagcccatggaaatccctaggccaaatcattctggaaccccagactccattgatatcccagttagaaggttaatgatcctttacaccacaaaagaaaagcaaacacacacaaacaaaaagcaaacatagaaacaaacacaaataaaagcgacaggcgtacaattaacagagtggcataggcaagaagaagaaaacaaagtacatagtcacatactagtaataacaaacaaatctatttcaaaagtaggaagcatagcgcgaccaagacatgaagaaacaaactaaccgctcacaaaaacat

SEQ ID NO: 566809 - DNA, 633 bp, Homo sapiens
  misc_feature (545)..(545): n is a, c, g, or t
  misc_feature (612)..(614): n is a, c, g, or t
  misc_feature (618)..(618): n is a, c, g, or t
cgtcaagcaaatgtggccgtagtgatttgtacttctaagttcaaagagggtcgtttgtcaccgagtgaagccactgatatggctgattcggcgcgctccttcaacgactacctgatagattctcatggtggcagattcgatcgcagtcatgtgaaattgttggaaaatgccggcgctactcgtcaaggaattatgagtgcgctggggcaaaatttcctcggaaacgcagtcggcaaggatgatctcgtagtagtttacctggcgaccagtgcgtttcccacaacggacggaaacacttatctgtgtacttacgattgtgctctcgataatatctacggtacctgcatttctatgcaatcgcttatgagtacgctcaagaaaaatgtccattccgaccgcatcctgcttgttcttcaggcggcgtacagtggtgctgctgaactcgaatctggtgctaaatcattggagcatcgcgccgcccaaagctataatctggacccaaacaaagtgataatgggcaacggttttatcattctctcatcganccaggctaatgaaatcacgtggagcactgcgttttcgaagaatctgacgactgcgttgcggcagaannngcgnacgttttagcgcttg

SEQ ID NO: 566810 - DNA, 335 bp, Homo sapiens
  misc_feature (33)..(33): n is a, c, g, or t
tgcgtcacctgcaccagcatattgaaaagcatncttttgaaagatattaagcaagccgttaggaaacctgagcttaaatttcacgaaaaatcgaaggaagagacatttgataaaatcacctggcattacggtgaggaaactgaataccatggtagacctttcaagatagacgttcaagtagtttgcacacatgaagatgctatggtatttgtcgattacaaaacacatcctgtaggcgcaaattaaaggttgtgtcatagagaatgtgttagtactgaatcctaacctcccaaattcataagtagttttatgtacctttaatgatttacgattag

SEQ ID NO: 566811 - DNA, 225 bp, Homo sapiens
  misc_feature (87)..(87): n is a, c, g, or t
  misc_feature (106)..(106): n is a, c, g, or t
  misc_feature (167)..(167): n is a, c, g, or t
  misc_feature (189)..(189): n is a, c, g, or t
  misc_feature (218)..(218): n is a, c, g, or t
acaactcttatccccagtccaccccaaccctacccagcccagcgtcccccagggcccgctaccccccatacactactcccccacgantgagcacggcagcgttctncccctgacctcaaggagagttgggcagctgtgtgagtcccacatcctgggcagagggcctngtggggccccttgctaggagangggaagaggccccagagctgttcccagangttctgg

SEQ ID NO: 566812 - DNA, 665 bp, Homo sapiens
  misc_feature (86)..(86): n is a, c, g, or t
  misc_feature (132)..(132): n is a, c, g, or t
attcggcacgatgggaagatggcggaggtgggggagataatcgagggctgcgctacccgtgctgcggcggaaccaggacaacgaanatgagtggcccctggcgagatcctgagcgtgaaggacatcagtggncggaagcttttctacgtccattacattgacttcaacaaagcgtctggatgaatgggtgacgcatgagcggctggagctaaagaagatccagttccccagagaaagaggccaagacccccactaagaacggacttagctgggtcccgtcctggctctccagagagagaggtgaaacggaaggtggaggtggtttcaccgagcgatactccagtgcccatgctgagacgagccccggcgtcggttttgtccccagaatgttgagccgcccgtagggcagtggcaacgcccagccgggacggatgcgaaaagtcgaattgtatgggcactgatgaggactcccaggacagggtctgatggaataccgtcagtaccacgcatgactggcagcctggtgtcgtgatcggaagccacgacgacgtcgtcacccggatgaagaacagttgagtgctattgagcgtggggcggcaccgactcaagccgtggtacattctccccagtacccacgaggaactcaccacattgcctgtgctcta

SEQ ID NO: 566813 - DNA, 831 bp, Homo sapiens
  misc_feature (456)..(456): n is a, c, g, or t
gggcatacatgagcaattggagtctcattcagccattcttgaccagaaattaaatggtctcaatgaggaaatgctagagtagaactagaatgtgaaacaataaaacaggagaacactcgactacagaatatcattgacaaccagaagtactcagttgcagacattgagcgaataaatcatgaaagaaatgaatgcagcagactattaataaattaaccaaggacctggaagctgaacaacagaagtggtggaatgaggagttaaaatatgccagaggaaaagaagcgattgaaacacaattaggagagtatatacaaaattggtagagaaaatttaaatcttatcctataagagggtgctgagattcccaggggttgatgacttgtggaaaatgagtttaatcccgaggtggtgccaactgcctgtgtcaaaatacagggctcaagttgtatgtancctcttaaggaactcctgaatgaaatgaagaagaaattaataaagcctaaataaaaaaatgggttgggaggatacttcagaaacacttcgaatgcatgataacagaaaagccagaggacgtggtgcagaacttctggaaagaagaaggttccaaaagcgtgcatgatctttaccaaaaaaacaaaacacaaccgacacaaacaaaaccggtgggcgcgcgcggggcccggaaaacttccacacacctacggtggggggggccccggaggatgaggaagagggccaggcggcacagagaaccgggcagacaggggggtccccaaaaaagcgggggagggagtgcgaacaaccggggggccgggccggctaagggcg

SEQ ID NO: 566814 - DNA, 465 bp, Homo sapiens
tgaacaaaggggagaggagcctggcattgaacaaacctgggaggggtgtgcaatgttaacattccttgtttaaagttaaatccatgctcagttcccattcttaccaggtatgtcataaggaggtagcttaagaacacagattcccccaaaagcacatggtaaggcaaacagggcctccccatcactgctgaaccaggctggaaaggcggcggaattaggaagatattccatgctctgctggaattaactgctacttgacggggtctgggaaaaacacatttttcaatgtcagctgaaatatgtacggcactcgaatggcaactaacctacactccccctctcgccaaaatctttagctctccgagcgaccacatcacccttctaatcgggtggcccttacaactcccccctccaatctaataacctgcctccttagccctatatattctattccttcttcctctt

SEQ ID NO: 566815 - DNA, 714 bp, Homo sapiens
ctggttttgatcgttccctgcgctcgacgctcgttacggtgggggtttatctcgtgtggcagcgctccggactgtcgtccctctgtcgggctgcactcagtctcgtacttcgggcgttgcttggcttctgtgcgttatatctttgctaatttctggtcggcgacgtcgctgtgtattaagtgtctattggtatggacgacggcgttccatcggtttgagttgcggtgtatggatgccctgctctgggtggctgcggggcgttgtgtagtggatctaaatggtggctgtgttgactttagttatgtagtgtatgcttgtgctttgctcagccctttggttctctttggtggtatgctgacttgctcacgcgtcgacgcttcgctcttctgcggcgcgcatacgctgttaggtctgacctacggctcgtcacgcgcctctcacggtgtggactccgggcccacgcccgcgccccgccgccgcgctcgctcccctcgctctcctccactcttagccgcgcccctcgctcttgcggcccgacgggctcgcactcgcatcggcatcgcgtggctatgctctgtggccgccctcgccgcctcctccccccgccccggcttcactacgactgactctactcactctccacgctcttctacgtcttctactgtacacaatacacacgcaccacacatacactaagatacataaaaataacca

SEQ ID NO: 566816 - DNA, 85 bp, Homo sapiens
cattggataagcggatgagggtatatcatggaaaagcgttcctctacccatcagtatttcagtccggaatcgcctcagttgatag

SEQ ID NO: 566817 - DNA, 354 bp, Homo sapiens
acgagctgcatactgactcagatccaagataaaattgactggttttaaagaaaaatacatacacacacacacatacacacacacacggcacacacacgagcctaagtccctttggacactgatatgtgggtcgccacataagtgcaatgtgtttagactcaatactcattctaagatgacttatgccccctataatatagtcctcttgtatactatatacaagaaatggtcccgctgcacagagtatctctaaatgttctcttcctagagttctatgatcacattattttgattatccttggtggtggaaaaaccaacaatacagctcagtgtgtctgtataaactgcttgggg

SEQ ID NO: 566818 - DNA, 457 bp, Homo sapiens
aaaatcttctctctccctcctgtgcctctcacctgttctcccacagggccatcgggaaccaaatgcactggctgttcgttctccaagttccgagtacttgggtctgctcccttcctcatcaacaggcggacagcatctaattgtgtcaaccgatactgcaggctggcagcaacatggagggcagtgttgccattgtaagcctgaagacaaagaaatgaattatcagacatcaggaagggggaaatttcatgaaaggagctcaaaaactttgagagggtgtacagaaggccattccaactctggtgtggttattaaagctttctaaaagtacctttgcattcacaaaagacaggcaactgggcagctccaaaaagaggcgaatgagttccagatttgcttcttcagctgccaaatgcagggctgtgcggccacttttgcgatccttgtcaaaggcaag

SEQ ID NO: 566819 - DNA, 104 bp, Homo sapiens
aatgaatgcactgactccagcctgggagacatgagcacgactctcttacaaaaaaaaagttaattcaccacgaacaagtaagcacacactgggttacgtaagca

SEQ ID NO: 566820 - DNA, 623 bp, Homo sapiens
gatgcttgaggtcactctagacggatccccctcaacgctttatacttctaaacagatctactgttaattgtggaggtgagggactataggcttgatggaaagacattcgtactttctgggtataagctatcgtcatttctgattgaaggagtcagagtgcgtttggcctatacaaatgattaactgctagtctacgtttctatatactacttaggtatagtaaatgatctccgatactaagtacagtaacgtcaggtctcaacatcaattggaggttgagctgtattgcaagctttacagtctctaagaacctgtacgacatatatgggtcaggttcttattatgctcttaagctagaatatacagatcactaaaattaatttcgaagactttcacgataactagtactaaaatattaggacactactataacttactgtatatttatcagtagcattagaaaggtagtcctttgttataccaaatacacctagatctaccataatacaatgtactggcaatgagtaatcccaagagttgagaccgttctggggtcaacctgtaaaaacaaaactttcaacttccacctattttgctgggtggaggtttaaggcgtccgaggg

SEQ ID NO: 566821 - DNA, 449 bp, Homo sapiens
  misc_feature (404)..(404): n is a, c, g, or t
  misc_feature (446)..(446): n is a, c, g, or t
gtgatctgcaagttctgccgctgccctgtctgtgtctgtgaagcaaagtgtccagaaggggcccgcgtggtagcttctgagagcggttaggggaacggggccccacgtcctcccggagggctggagacagaggcaggccgtgcccccagcccagagtagggaggaggctggcaggcggcagctgtggaaaggaggcggagcccccagactcctgagccagcagaggaaggagtgggacagagcccaccccagagggagacaagaccccggggaagagacccctcagggtggccccccagcccctcccaggctcagctttcagcctgcacccccgtctggtccctcagaatgactgaggtttccactctttttctgccaaatctctagactccacgtccccgctntgccacctactctctgtgggatctgaataaagagacttaacntta

SEQ ID NO: 566822 - DNA, 293 bp, Homo sapiens
  misc_feature (208)..(208): n is a, c, g, or t
  misc_feature (277)..(277): n is a, c, g, or t
actctgtcacccaggctggagtgcagtggtgcaatctcagctcactgcaacctccacctccagggttcaagcaattctcctgcctcagcctcccgagtagctgggattacaggcatgtgccaccatgcctggctaatttttgtatttttagtagagacagggtttcaccatgttggccaggatggtctcaacctcctcacctcaagcnatccaccccccttggcctcccaaagtgctgggattacaggtgtttacaagtgtgagccatcacaccggngccagggaagtttctg

SEQ ID NO: 566823 - DNA, 1685 bp, Homo sapiens
actacctttgcctgctgtctctccatagtttagtgatgtgttaacccccatactggcaagattgcgatagcgagagtagacgatcgtttctatcactctgagtgacgcacataagctgcattcgttgatcactcctgtggtccaacttcacgatcgactaacatgaacctattcatggaatctaaatacgactgtcgagtgagttgaatcagtacgaatgatgcaactcagttgcaatcgtctgagtacactagagtcgagactagcatgtggcatgtgtgtacacagacgagtcttccttagtctagaggtaactagtccgtcgcgagattcttcagaaaatgacatatcctcgaaatacgaactcatatgcggatgaatcacgaatgtaatcattcgaatctcgacatttggcgtgtactttcgtactcgtatgaatggagtggaattatgcgcatggaatctccagacgagtttcatcgtgcattactgggaactttgttacctattggaggagttggctcaccacagcaagaccaagcttagtgagtacatctttgagatgccatagagaagatctgtaaggattttccctgagtgggcaacattccgtgctaatccaaagaaagttaggtaggcttgctttgcgattggctctagttagtgccataaccagagccgacgtagtttcgaggtatattcctttcatgcacgaatcgccatggtaggctcatccggaggagaacatttgttcggaacgatcggtcactctcagactcagtacattttgtcgcacctcacgttggggctctttagccgccacctggtagaacggaggtttgggattaggccaacaacggggaggactcaggttacgccgaatggactaaaatgtaagaaaagctctgtgactttgcacaatgctttgcgtgtcacaattgcacttgaagatgaggcaaagatagcagtacgtacttacttgggcgctgagaatcgctttgtaacacgatgtgtagatgctcccggtccacgtttctccacgtgcacacgggcatgagcctttctggggtatatcttgggaacctcctttacccacgccacggagaaggccctcaaggggaattgcccccaaatggtcgtaggtcttgtggccaccagggtcgaatacgaaaatttgcctgggaacaattgcccgatggtttactccaaactgtttgcctcgtgtgaggacatccaactgtgcgggtctgtttctcaacaggcgcgcgccgggtcccggcatgtcgccaatggtggccctggtggaggccccaccctgtctcttgaaacggtctctagaagacggcaaacttctaaccctggcgaattagtttataggagtgtaaacaaacctctttggcccagacccttatctgggcggattttcctacactaaagcgcaacgtataataagttctcttccagtccacaagatatcctgccttattttcttcacaaccaaaccatattataccccccattaactaccgcaggacacacacaacacctctctcatactatctcgacccactcaccatattattacaacaacgcttctatatacaactacaactactacaatcatatataaaacatcccttacacctccctaccttcaccacaagaccacccaattcaataccaaa

SEQ ID NO: 566824 - DNA, 243 bp, Homo sapiens
gggatgaaatcagagatgatgaggagggttactggagcccaggagttccaggctgccatgtgctgtgatcgcaccactgtggtccatcctgggtgacagaacaagaacctgtctcaaacaaacaaacaaacaaacaaaaatagtggagaccctccagtgtgagcctcctcatcatctctgattttcatcccccatgacatcgccagctacgccccctccttcccctcctccctcccctaccct

SEQ ID NO: 566825 - DNA, 274 bp, Homo sapiens
  misc_feature (8)..(8): n is a, c, g, or t
  misc_feature (25)..(25): n is a, c, g, or t
  misc_feature (29)..(32): n is a, c, g, or t
  misc_feature (36)..(36): n is a, c, g, or t
  misc_feature (42)..(42): n is a, c, g, or t
  misc_feature (80)..(80): n is a, c, g, or t
  misc_feature (105)..(105): n is a, c, g, or t
  misc_feature (130)..(130): n is a, c, g, or t
  misc_feature (205)..(205): n is a, c, g, or t
  misc_feature (216)..(216): n is a, c, g, or t
  misc_feature (221)..(221): n is a, c, g, or t
  misc_feature (225)..(225): n is a, c, g, or t
ctttaccnacgcatccgttttgggntatnnnnccgncgagantaatctaccgtttaccgaatagggggatacgtacgtgnttggcacgttaagaaaaattaatanacaaatatcaggtcattcagctttncgtgcacagggtacaatagcaaatcgtcattaaaagttacatgtattggcatatatagttaattagcggttaggntaggtagtagncggtnctanaatacaatcgtccggagtattagtgctcaagaccacgtaagtatcggcc

SEQ ID NO: 566826 - DNA, 219 bp, Homo sapiens
agccgtacccttcgctactgtgtggcataaaaagaaaaacgggaaggattcattgtcctgagaagtttgccaactgcctcattctggggcacgtgtccaacatacaaaaaaaaagaacaccctgaaaaaacccctcaaatggcttccaaaaggcccctcagggtttcttttgggtggacagttaaccaaacagacccttggaaaggtttaaaaacctgc

SEQ ID NO: 566827 - DNA, 177 bp, Homo sapiens
tagcgaaattccttgtcaactaattattgacctgcacgaaaggcgcaatgatctccctactgtctcaacattggactcggtgaaattatggtaccagtgaaaacgctggttacccgcatcaagacgaaaagaccccgtggagctttactataacttcgtattgaaaattggtttagc

SEQ ID NO: 566828 - DNA, 1050 bp, Homo sapiens
  misc_feature (557)..(557): n is a, c, g, or t
  misc_feature (577)..(577): n is a, c, g, or t
  misc_feature (611)..(611): n is a, c, g, or t
tggtcttggtccaaaattttattaagggtcttatagaagagcaacttccaaactccaaaatacagctgccagggagaacccggttatatgcgtggtggggacgtggctgtggggcatgtggcagggcggcctcgtggctttcccaccctttcgtgtccgtgaaagtggggggtgggtgggcagatactcctcatcttggggttcccacaagtgcctcacgtgtggctcaggcgaggggctctctagagggccaatctttaccagtgtggggtctcccaggtgcagcagtgatcttcacctttgatgcccagaaaacccgtgtcgtgagcaacagggtggcgcacagcagtggctcacaggtagttagtataacgagggctcctcccggtgtggtgggcatcaactcagagcgccaatccaacaaaatttttcgagtggaatttatagcccttctgtgctccctcgggagagttttccccagagaagagaccaaaaaaacctctctgcagagcctttttgtggcccccaatctctctccaaagtgatatgaaaccggnagagaaacaaaccatatagnaggagggccctctcgcggaaacgagaaagaggcncccctccctatagagagaagtttggttaagcgccagaagaactctccgtggcgctgtgggggccaaatgtgcggccaccaaagagaacccttcttagtgtgggccacccttttttcccaggccatataaagaggtttcatacagtgtggcccctctctgggtaaaaaggcccaaaacctctctttcgtgaaattaccagcaaagatcaagttcccccgaaaatccggcgcggcccttttcttcaccagagaaaccattcccgggtgctccgggggggctaaaagataatggatttccgggccccgggtgggggtgtaacttcggagaccttgaattcccaagagtagccatttttcagccaaggtcccggagtaaggaaactcattccaggtacagtttagaaaatcgcattcagggaaaaatttcccctctgggagta

SEQ ID NO: 566829 - DNA, 795 bp, Homo sapiens
  misc_feature (20)..(20): n is a, c, g, or t
  misc_feature (27)..(27): n is a, c, g, or t
  misc_feature (29)..(29): n is a, c, g, or t
  misc_feature (36)..(36): n is a, c, g, or t
  misc_feature (75)..(76): n is a, c, g, or t
  misc_feature (79)..(79): n is a, c, g, or t
  misc_feature (94)..(94): n is a, c, g, or t
  misc_feature (106)..(106): n is a, c, g, or t
  misc_feature (122)..(122): n is a, c, g, or t
  misc_feature (126)..(126): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (158)..(158): n is a, c, g, or t
  misc_feature (196)..(196): n is a, c, g, or t
  misc_feature (198)..(198): n is a, c, g, or t
  misc_feature (207)..(207): n is a, c, g, or t
  misc_feature (213)..(213): n is a, c, g, or t
  misc_feature (220)..(220): n is a, c, g, or t
  misc_feature (228)..(228): n is a, c, g, or t
  misc_feature (235)..(235): n is a, c, g, or t
  misc_feature (243)..(244): n is a, c, g, or t
  misc_feature (249)..(249): n is a, c, g, or t
  misc_feature (270)..(270): n is a, c, g, or t
  misc_feature (277)..(277): n is a, c, g, or t
  misc_feature (281)..(281): n is a, c, g, or t
  misc_feature (289)..(289): n is a, c, g, or t
  misc_feature (294)..(294): n is a, c, g, or t
  misc_feature (336)..(336): n is a, c, g, or t
  misc_feature (345)..(345): n is a, c, g, or t
  misc_feature (349)..(349): n is a, c, g, or t
  misc_feature (366)..(366): n is a, c, g, or t
  misc_feature (391)..(391): n is a, c, g, or t
  misc_feature (415)..(415): n is a, c, g, or t
  misc_feature (421)..(421): n is a, c, g, or t
  misc_feature (483)..(483): n is a, c, g, or t
  misc_feature (581)..(581): n is a, c, g, or t
  misc_feature (619)..(619): n is a, c, g, or t
  misc_feature (640)..(640): n is a, c, g, or t
  misc_feature (714)..(714): n is a, c, g, or t
  misc_feature (722)..(722): n is a, c, g, or t
tgaaaaaagtccattttatnaaaaaancnaaaaagncagaccagtgcattgggcttgtaaggggaaaccattccnnccnactgtcacaaagccnggcagaataaancaggggccaaaacatncccntttattcaattnatnaangagagtgtggaatnaaagtagacccttgcatgtcaggaaagccgcaacacancnggtttaagnggagcncaaaggnaagtaatnccacatncaccaacnnccccncttgaccccccaccagtcccngtctgcntttnccaccaancaacnctaagaggccccaaacccaaacagtccccattcaactgtgcncaaaggtanaganatggaagacatcccacnccaacccccacctttggaataaaanaaacctggaacaggaaggggaacnatggcngaaaccaagtgaagatttttaagaagctttgacagaaacattaagaataacacccgaatgcnaatccagaaaaaagcgctactgggggaaaatagtcttagccaatgttctaaaaatgcccaaaaggaagggttggggaattaccctttagacacaagcnctaagaactctggatacaacgggaacttggatggatanagtctgggcctgctgggccanaagttccgagggcggcccggcaagcagcctgttttgcacattgcaactgactggcttaatctacggcaagagtncttcagcnccgtcacagagtactctccaatgtgttatagttatccttaaagctcttcaattcaaggaagtgcttggcacgt

SEQ ID NO: 566830 - DNA, 343 bp, Homo sapiens
ttccatctgttggaggccgaggtggtgaatatttgaggccagtggctttgagatcagctctggccagcatggtgaaaccccttctctgctaaaaattcaaaaaaattggtcatgcgtggtggctggcacctgtagtcccagctactgggaggctgaggcaggagaaatcacttgaacccatgaggtacaggttgcagtgagctgagatcacgccactgcactccagcctgggcgactgagcgatacttaaacaaatatcatacacacagctagataaatactggaacttacgccattgtgcccagcctcatttttttaaggttgtgacccattgttactgtca

SEQ ID NO: 566831 - DNA, 530 bp, Homo sapiens
  misc_feature (23)..(23): n is a, c, g, or t
  misc_feature (27)..(27): n is a, c, g, or t
  misc_feature (53)..(53): n is a, c, g, or t
  misc_feature (76)..(76): n is a, c, g, or t
  misc_feature (88)..(88): n is a, c, g, or t
  misc_feature (93)..(93): n is a, c, g, or t
  misc_feature (485)..(485): n is a, c, g, or t
  misc_feature (510)..(510): n is a, c, g, or t
agaccccgacagaagggtcggantttngacggtatcgataattttttttgggntttttttttgagacggggtttcnctatcttggccnggccntgaactcctggccttgtcatccacctgccttggcctcccaaggtgctgggattataggtgtgagccaccgcgcctggccaatctcattcttttttatggctgcatagtattccatggtgtgtgtatatcacattttctttatccagtctaacactgatgggcatttgggttggttccatgtctttgctattgtaaatagtgctgctcctgtgcacgtgtctttacagtagaatgatttatattcctttgggtatatacccagtaatgggattgctgggtcaaatggtatttctggttctagatccttgaggaatcaccacactgtcttccacaatggctgaactaatttgcattcccaccaacagtgtaaaagcgttcctatttcttcatanccctctccagcatctgttggttccngacttttttaaaacagccat

SEQ ID NO: 566832 - DNA, 1508 bp, Homo sapiens
ggtccgactgggcgctggggcgccgcgccgcacgagcaccagtctagagtccaggtactgatagcttcaaggatggctgaccaggaccctgcggggatcagccccctctcgagcgatagagtggtggcctcatgtgcgacctgggggcgtgtggttaccatcgtctcgttcgatgagctagcaccctgggacggtggtgaatcggttcggctgcagtcgtcatgctggcctctctcagtggccgagcgatgctgagtgcccttcgctctcatgtacgtgttggcagcctcgtcgcttattactcaatattgcccttcctctcttccgaattctcatcatggtggaatgtgtccttccgtgtgattgcgagagtgcgtgtccttgcgagcctcgtggtgccctgtggcccaagatggtgccgcggctgtgaccaactgggtatatcaagtaccgctaacgccgtattcattggataccgagtgggatgcctgtcgagtgaagcactcggtgaggcacgagggccacccagggactccctcttggtagacgcgtctcccccgaacaaacgctgaggtgcattgacattgtggccatgcattactccgtgcactcttatcattctagcgtgccatatgtactcaatcttgagaggccgtcttcctgttgttggtactgagtgccctgaccgtcttgaacgtcttaggtcacccaataggctgggtcttgggtcgtacgccttgggccccggacttggggtgacccggttgacctggttgagtcaggaccccccttgggagccttaattgccgcgaccacccgtcttggctggcgtcactcgctggtgttcggtacccggggacagcctgggttggccctgtggttgctgaacctggcggggtcgcgttgcagggctgtcgcttggcagctcacaactgaatgggcctgttgcatgggggcgcccactgtggcgcttcggagaggatgatagccgtcctttaagggccctggtactcggttcaggtaattaacataggttgagaccaagggatgagacccaacacgagcgcatcagtgcgccagaaggagcaccaaatatccttcttggcgcatggagtcttggacgctagcgggcgacacaatggacagcgaggttggacaacagactgaacataaccccttggcccggtgggtacaaacaacacaaacgcaggggcagtccactgtgagacacattggtgtcttgatagagaataacacccgcctagtttggaccacccaccagtatcgcgattacaaggcttcgacagtatgcgcacaagcaatacataggagtgcccacgaatcaagaagccgcagcctacactaattagcacagcaccacgtcactcagaaagcaacagccacgaaggagcgccccaggacgtcaagcacaccactattgtcattaatacaactagccacacgcttctttctgccgatcgaacacaccagcaggacgcgacgagagt

SEQ ID NO: 566833 - DNA, 225 bp, Homo sapiens
tggtcgacttctgctcttcaagggcttctcctctgagttgtgtttcctcttctggtaaacttcctgggtcatatcctgtgcccatcttgatagaaggggttgggaccttcgtttccgtgctgatttggcggaaattccttggggtggttaaagataccgggttgcttggtcggggtttaggatatttggaaactattcttcgttacacggcagttcacccttgtt

SEQ ID NO: 566834 - DNA, 629 bp, Homo sapiens
  misc_feature (629)..(629): n is a, c, g, or t
gaaaatctgttcaaagagatagtaacagcttcccaaacctagagaactatatcaatattcaaatgcaagaagattgtagaacaccaagtagatttaaaccaaaggtatttaataatcaaactcccaaaagtcaaggatgaagaaaaaattctgaaggcagaaggagaaaagaaacaaataacatataaggagctcccgtatatcttggagcagacttttcagtggaaacattataagccaggagagaggggcatggcatatttaaagaactgaaggttcagaccagcctggccaacatggtgaaaacccatcactagtaaaaatacacaaattagtcgggtgtggtggcacccatctgtgatcccaggtactcaagaaggctgaggatggagatcacttgaacacaaagtggaggttgcagtgagctgagatacgccacttgactcaagcttggtggcagagtgagactttgtctcaaaacatattaatatgattattaaaggaaagtgccaaaattcaacaactaacagaaacttgtgaaaagagctgaaggccccttccaagagaagggtgaggaaacgcttatgaaaccatgagagggggctaacctaacggggagattcggtttn

SEQ ID NO: 566835 - DNA, 459 bp, Homo sapiens
  misc_feature (9)..(9): n is a, c, g, or t
tgagggaanttagtagagtgagaggaatatctttgttttagttggtggtgttatatttgttaaagtatagggaattatttatttaaaatgggtgtatttaaaaaataatttaattgtggtaaaaatatatataatgtgaaatgtaccatcttaattacttttaagtgtataactcagtagggttgagcagctttacagtgctgtgtaaacaatctccagaactttttcttcttgcaaaacaaaccctgtgcccatcaaacgctaactccccagtcgctgacaccactattctttctgtctctgtgatcttgactcctctaggcacctcctatgaatggaatcacgcagtatttgtccttttgtgaccagcttatttcacttggcataatgtcttcgagttcacccctgtgtagcaggtgcgtcgacgcggccgcgaatttagtagtagtaggcggacga

SEQ ID NO: 566836 - DNA, 88 bp, Homo sapiens
ggatttgctggtgcagtacaactaggcttaatagggactcgaattcgagcctcgaattcgaggaattcaagcttctaacgttagaagc

SEQ ID NO: 566837 - DNA, 187 bp, Homo sapiens
tttctgctttataatgttacccagcttagggtattttcttatagtagcctaaacggactaatacaggcagtgatgcatgctatcattatttctctttggagctggctaattcatgatttaatgattttccagttgtgttctgtggtagaacgggtcatttatacaatttaatctgatcacggctcta

SEQ ID NO: 566838 - DNA, 1054 bp, Homo sapiens
gtttccttttgccgccggagttatacaacactaatctttatataggaatccattcgttactgtaaatctttctaaatctctgcaaatggctctaaatgagggtaaatgaaaaagccgaaatgaagagagggttatggggcagcatgcaggtggggccagtcgatcagggctggaccacccagactcctccccagagacctctgttccttccttggtagccagcccccaaccactctgcaggcttctagggcataaacggcccagaacaagaagtgggcacgtgcagagggccaggaggagctggagggtcagggggtgaggggatagcgaaggtaagctagaagctggtgctggcatgtgccacagttcacaccccacccttccctcctaggggaaggagctggcagaagcaagacactgaggctggtcaggaacaagacaactgcacccctatggggggataatggacagtctccatcgagattcatgatgcacacttgggtggacagaccgagaccatggagctggcagaaggccgcagaaagggcagaagcataaacaacatattgagggatacccacaggatgaaagagggactgagatcgctgattcccctagactctgacgagcacagacaagtggccaagacaagcagagtaagccagggagaagctcgttagggcacagagcacactaggttgccgaggcggaaagagaggaagcgcccgggagaaaagaccaaggcagctcatagatgaacatccttcaacagcctgctggtaagaggggaaccgggtagcaggagcagggtagccctagagacgagatggcccacccaagagctcaaaggaaacgcaacctagcgagatcgacggcaagacgcaaacaaacaagggccagagataccccatagtgacaaggtcaagcacacgaccgagaacaacccaagggccaacaagtgcaacagaaaggatcaacaacacaacacgcataccaccacgcaccgtacaccagggccagaaggagaatagaaacaccggagcggccctaccag

SEQ ID NO: 566839 - DNA, 366 bp, Homo sapiens
gtatatacaactctctcagttagactgaacctcacttgacctcagtgacgcaggctgtctatcccaagagaggctgaggctttcttgctcactttgacaaggacagactagctttattcattcgttcactcaacaaacattgattatatgcctattttgtgccaggcacaagtggggcactctggacctacaaagaaaaccaagctattgtccctgccctgaaggatgcttacgtcttatgacagaccagatccatgatgttcgcagggtgtgtccctagagaactctgtgcaaactatcaaacagtaaatgccatttgtgggacacactgcccctgtagcatgcacgtcaagtagaatctaacac

SEQ ID NO: 566840 - DNA, 256 bp, Homo sapiens
gtttccttttgccgccggagttatacaacactaatctttatataggaatccattcgttactgtaaatctttctaaatctctgcaaatggctctaaatgagggtaaatgaaaaagccatttgcagagatttagaaagatttacagtaacgaagtggatcctatatacgattattttatacttttgcagcacaaggaaacttgtaatcgtttgtacagcgttcaagtgaagtaaaaaccatgcctaaggctacaaaaa

SEQ ID NO: 566841 - DNA, 1000 bp, Homo sapiens
  misc_feature (970)..(970): n is a, c, g, or t
gcttagcctcccacgtggctgggactgggggcatgcaccaccgcgcctggctagtttttgtatttttggtggagatggggtttctccatgttggccacggttttctcgggctcctggcctcgggtgatcccccatgcctcagacctcccaaagtgctcccaagagttgcaggcgtgagccactctcacccggcatgatttagataagactttgaagcttagacttattaagggtgatgctgaagacaaacttaagagcttcttggggcttattacgcgactggcaatgacagactatttctggactctgagcaaagcatatggcttacggggacgctaggggacgaatgcctatggctttgacatgtgtaaatactcctttctcccaaagaacagtaacatagttcgaacagtggtaatcacaccaattaacaaactaagttaataagcggaaggctaggaggcacaaaaataggcgcaccgtccactgagagagctccgtagaccattcagttcaaaatgcgtcagttgaaaaatacacaccgttgctcgattaaacaagaggggacactcataacctaggacacaaatgattgcacactggaaaacacagacaacacaattaaacaagtcacaccatatctggctgaaacccgataactgagacacctcgtatatgaccacaatgagtagaaaggagatttcccaaggggacgaaaaagcggaaagcagactgggcaccccaagtaatagaattatgaacgaaagccacaagagaaagatgacgactagggggcgaccaagacgcccgtttattcactgtggaccacatttagtggagaaaccaactattgatcacacgagaggaaagtgcgattcacactagtgaaaacaacaaattgtgatatggtcaggggacaaagagcattacgaccgaaactgtagtgcagattgaataaaacccatccccntaagactgaagaacaggattaaaccgccag

SEQ ID NO: 566842 - DNA, 338 bp, Homo sapiens
aggatgatggggcgagggtcccggcttgacttcacgaagtctcccttccggaccttcagaccgccgcggatggggtcgatggtgttgaacacggaatccgcgggagggagcccagcggcgagagggatgggctcattcagatgagaaatgtccgtgtcatcggactccatctgacggaacggggaggtgtcattgtccattgacggtctcctgccaggcgtgcagatgcccctggatgggcgagggatcggcgttgccgcagttcgcagcgagcagatggaggttgttggcgtaattccgataccgaggatcctcggcggccgcctgatccggaatcg

SEQ ID NO: 566843 - DNA, 434 bp, Homo sapiens
  misc_feature (3)..(3): n is a, c, g, or t
  misc_feature (20)..(20): n is a, c, g, or t
  misc_feature (24)..(24): n is a, c, g, or t
  misc_feature (31)..(31): n is a, c, g, or t
  misc_feature (33)..(33): n is a, c, g, or t
  misc_feature (47)..(47): n is a, c, g, or t
  misc_feature (57)..(58): n is a, c, g, or t
  misc_feature (68)..(68): n is a, c, g, or t
  misc_feature (71)..(71): n is a, c, g, or t
  misc_feature (74)..(74): n is a, c, g, or t
  misc_feature (94)..(94): n is a, c, g, or t
cangacacgcattgtaaaanaagncctgtgntntcggggaggcgagnaggtggcccnngtcctgctgnagncgncgtagtttcaggagaggacnaaagtggaaagtcacctttatagtaggaatggagcgcagatgtaagtggcggcaagctaacgccaaggggaggaagtccatcaggctcagcaatttccctgccgcgagtgggcaaacatctcacacgtgtacacaaatatatttggacacgggtgcttactgcagcattggcggtaaagtggaaggtataacccaaatgcctataaataaataactaaggccgggcatggtggctcacgcctgtaatcccagcactttgggaggcagaagcaaggtggatatctgagtcacggagtttcgtgaccagcctggccacatggtgagaccctctcacagcttg

SEQ ID NO: 566844 - DNA, 1090 bp, Homo sapiens
ttttttgtatttttaatagagacgaggtttcgccatgttagccagggtggtctcgatctcctgaccttgtgatctgcccgcctcggcctcccaaagtgctgggattacaggcgtgacaccgtgcccagcctatactgcagttttaaaaaagttaatggaagggttaaacaatacattagagaatttgcgagctacagagagatctggagaaataatcatgatagcatgagactagcaaacaagacaaagaagacaggctggctgcagtgctcaggcctgtaaccccagcactttgggaggccagtgtgggtggattgtttgagccaagcagttcaagaccagtctgagcaacagagcgaggccccgtctctgcaaaaaaaataagaaaagaagagggaggggtgagaagatctcacattcaactgagttccagaagagaatgaaaaaagaaaatattcaaagagtggatggctagagaattttccagaatgggtttaatttaccagtctaaagactgaagaaatacaacaagtccctagcaggatacagacaaagatacctgtgcctgacacatctgggcaaactgtggcactcaaagcagatgagaaaaccatgaaagaatccaggaggaaaacagatttctcacgaaggaaaggcgattccatggacagctcccttcttagtaggaactgtggaaaccagaagtagctttaaagtgctgggataaaactgtctttcaaggataagagtgaaaacaaagacatactcagacaaaaactgaaaacatttaccacaaacaaactcaccttaagcaggcaaatggccctcgatgtggaaagcaaagctcaggggacagagggtgtactgaagagttggcggtgatgatccctggagggtccccccagggccaagaagggggctgggagccatgcatggtgagactggagtgtgagcttgaggacagcaagaatcagacgaccaccccaggctgccagggtgtggctcagcctatctgcccctcacgctgagctgcacagatgcaaacaccttccaaacacagtcacgaggccttaggaacgtctcagagctt

SEQ ID NO: 566845 - DNA, 959 bp, Homo sapiens
ggctgacaccaagcgattgaagctgctggaagaggagcggcggcttcagggtacagctggaacaaggggatgacgacagctgctgagaggctagcagaaggtgtatgaggaacttgcgtgcgtccactggggtcgtgcagcatgactagtaggaccaaagtcgacgtgcggatccgttggtctggcctggggctttgaccctgaacagtgcagaatcgaaccaaagcagaagttctcagggggctggcgcatgcgtgtctccctggccagggcactgtgcatggagccacactactgctgatgctggatgagccgcaccaaacacatcgtggacctcgaacgctgtctatctggcttaataagtacctccagggctggcgggaagaccttgcttgatcgtctcccatgagcagggcttcttggatgatgtctgcactgatatcatccacctcgatgcccagcggctccatctacttatagggaggcaattatacgattgacgcttcaaagaaggatgtacgcagcgagaacgcggaaagaactgctgaaacaggtatgagaacgcaagagaaaaagctgaaggagctgaaggcaggcgggaagtccagccaagctaggcggaaaaacaaacgaaggaagccctgactcggaagcagcagaaatgccgacggagaaatcaagatgaggaagtcccaggaggcccctgagctcctgaagcgccctaaggagtacactgtgcgcttcactttgccagaacccccatcgaatcagcctccaagtgctgggtctgcatggtggtgaacattcgtgctaccacggacagaaaaccacttctttaagaactgggagtgtggatcgacatggattcaggacttgcgctgcgggcccaatggggggggacaaagtacccagcccggtgagactgtccacacggacacgaccatggcggaatgtgaagc

SEQ ID NO: 566846 - DNA, 110 bp, Homo sapiens
gcagggctttccccatatcttctctcccccacctctatcgagggggtgctgcttttttctccctcctcctcaagttcctttttgggaacggcaacaaccaacaaccttcc

SEQ ID NO: 566847 - DNA, 124 bp, Homo sapiens
ttaccacgcttacagaggaatacgattgatacatcagacattatctgccagttaagattattcttaaaactctggatgccatggcttttaataagtttaatgttcttcacgtggcacatagttg

SEQ ID NO: 566848 - DNA, 112 bp, Homo sapiens
ctgagtactgggccgctcccgctctggtcacaatataccaccacagtgggggcaaatcaccttcctttagggcagggggccagggtggggagccaggacctcaggtgggcag

SEQ ID NO: 566849 - DNA, 695 bp, Homo sapiens
cgcggtggctcacacctgtaatctcagcacttgggaggccgaggcgggcggatcacaaggtcaggagtttgagaccagcctgaccaacatggtgaaaccctgtctctactaaaaatacaaaagttagccgggcatagtagcatgagcctgtaatcccagctactcaagaggctgaggcaggaaaatcgcttgaacccaggaggcagagattgcagtgagccaagattgcaccagtgcactccagctgggcgacagagcgagactccatctcggaaaaaaaaaaaaaaaaaattttggcgggcggtcttccagatgggaattggcgggaaaagaatatttttaatacctggttttcaaaagggggtttgaagatgtggactcatcaatagtggcgggaaaaaatctaacgctcttggaaagtactttaagtggcggggggccatactcttaggtgccaacgtggcggggaaatttttcatcaggtgaatgtggaaggatggtgttgggctgggaaatgtggcatcacggtatcttgcagagaagattatttctggtttatctcagacagtggggaggggtcaagaaagacgtagtttgccaggtcgggggtcatgctgtaatccaaagtgcggggttaaggttgagaatggggcaagtttgggtgactttatgtgaggaaatcggcaaacaggatg

SEQ ID NO: 566850 - DNA, 397 bp, Homo sapiens
  misc_feature (389)..(389): n is a, c, g, or t
aattccctctgggatgctatgagctaatgagtttcttcatgcttatcccatgtgatgttgggaatccagactacagggcaaagtagatactttaactccattttacagataagagtgaggttcagagagatgattgagttagtgaggactgagcctggcctcaaactcgagttgactacaagcacctcttctctgcacagtgttactcatgaaagagacttccctgcaagacctggggccttttacttcaaagggcaaagagacttatttttcctttcatgcctttccatggcccactctttcattctggtttcaggttgccagtctggctggcagtcctctgttcattgggtcggtaacacccggggtcatatttccacacttaaagntggggagg

SEQ ID NO: 566851 - DNA, 990 bp, Homo sapiens
  misc_feature (205)..(205): n is a, c, g, or t
  misc_feature (241)..(241): n is a, c, g, or t
  misc_feature (247)..(247): n is a, c, g, or t
  misc_feature (260)..(260): n is a, c, g, or t
  misc_feature (263)..(263): n is a, c, g, or t
  misc_feature (796)..(796): n is a, c, g, or t
ttccacttgcatagtcatttcggttctgatctgtcaacccagcctgaccgcttctgacgccgggatggcctcggttactagacttttctttttaaggaagtgctgtttttttttgagggttttcaaaacatttgaaaagcatttacttttttgaccacgagccatgagtttcaaaaaaatcgggggtgtgtgggttttggttttngttttagtttttggttgcgtgccttttttttttagnggggtnggccccatgaagnggntgccccactcacttctctgagatcgaacggacggggaatccgctcttggtcggaagctgagcaagcgggggctttttccaactccggtggtgacgttctgagtgtagtggggtaggaccccggcgggtggtggcagcaacggcccgggagccccagccccgtggtccatctgtgcgtgtgcgccccacagtagacgtgcaagacgtccctgaaaggttctggaagatgtttattacatatggtgccttttttacgggaagacgtaagcatactccatcgatgtgtattggcaggggctgaggaatctctggtacgcagatccttgggattacgaagccgatttaaaagaccgtgtgaattgacacaaaaaaaaaaaaaagcgggggacattatgacgggggggggaaaaggaggtattgaatggggcctggcaagttttgcgggacccggtttcttgtgccaaggggggaattcggggggccccatgggggcggataattgccgaaggggtcaccgtagaagtggcgaaacgngaaacgcacgaagacgagcacacaaggcggtaccccttggcacaaagtggcaggcacgatgaccgtagctaacatattaccggagaagacaacagtatctgacgaagacagagaaacgaaacgcaaagcagatcgaagagacaggacaccagagcagaacaacgatcagagaaaacatcggacacaggccgcga

SEQ ID NO: 566852 - DNA, 152 bp, Homo sapiens
gtaagctgttaactgtttttttaaagttgtgtagaggcgggtgcagtggctcatgcctgtaatcccaacgctttgggagaccgaggtgggtggatcacctgaggctggaaaggtcccctatgtatttgcatccgaataaaagccagttttcc

SEQ ID NO: 566853 - DNA, 368 bp, Homo sapiens
  misc_feature (116)..(116): n is a, c, g, or t
  misc_feature (367)..(367): n is a, c, g, or t
ctccccagtccccatcctctctcctctggttttaatctgtgggtggatctttatatgttcctctctctccctctgcacacacacactgattgcatttccctgttgttcctattccntctctatcttcccaaaaaaagtgattgcattcattatctattgctgcgtaacaaattaccccaacatttagcagcttaaaacaaaaacattggtcatttcaacactggttctgagggtggggaatctaggagtagcttagatagttggctctagctcagaatctctcattagagagcagttaacctgtcagcaggggccagagccatctgaaagcttgaccagggctggaggatctgctcccagttgtgtnc

SEQ ID NO: 566854 - DNA, 317 bp, Homo sapiens
ctccttcagcggggcatctgctaattaggtggataaaacagccagcgcacatcaagtgaccattagtacactggtacacggaggccttgggcaggtccaggcacacggtgcagcacagcaccgagtagagccgctcctccagtttcccgctgccggccgccgccgccgccgccgccgcctcggccgcctcggctgcccgcagccgcttcttgggcggcgcgtcggggtcgccggccgcctcctgcagctgtagctgccgggcgcccgccaagcccgcctcgtccgggagcccaggccccgccgcctcgcccagagcc

SEQ ID NO: 566855 - DNA, 171 bp, Homo sapiens
  misc_feature (126)..(126): n is a, c, g, or t
gcgagtagaggaaggctcattgctgctgttgccttggggcgggcagtgacagttggggaaggagtcagctcgggtaggtgaagagaaggaagagtgtagcagtgagtgggagtacaggtgacacgnagtgacaggggtcagctctgtggcatgagcccatccccaggagca

SEQ ID NO: 566856 - DNA, 641 bp, Homo sapiens
ccccatccttccctttttcacggggaaatctaactcttccgtaaaggcagtagtgccgcctacatttgcaatactttcatcaatcccaaactgaataaattggtggcttttttttgaccccctacagaagtttaaatgtgccttttcactgaaacttttttgacaactccactcatggggtcaaaggagcacaagggttctcctgggaagcactgcatcctgactatcagttaatggtgccataacttaacagttttataattacatctttcttaggggccattatcctgcctttaacaccttccctaaactaaaaacgccataaagaaagggatccaagaaattcctcttacagttaaagatcttatgacttgccctccacatagtaagcatgcaaaacctatttgatgaataataataacactgaatggacactctttaggagaaatagtaaaatgaattacagctgcagctttggaaaaagatatagatgctaaggaacctaagtcattaagtcttagtacatcagagtacaattacacaaagttaatgtctcctgctgcctctctttaaggcctgattcccaccctctctgcccctaggaaccactaaagtttctatgtctacaggtgggcacactg

SEQ ID NO: 566857 - DNA, 259 bp, Homo sapiens
tggacgggggtcagggtctcagggtcaagatctaacatgtggacccttgagatctagctatagatacagaaagagataaaatcaatatacaagaatcgatctctatgagtggtctcaataagctcagtgtaacagtgctcaccacgcgtctgtaggtgttataagtggtaacaactgtattttccagcccatccgtccaaattggggtgtctgtttttttttaggctaaaagtggtcagcatgcagaaaagtgcgtgca

SEQ ID NO: 566858 - DNA, 213 bp, Homo sapiens
ccagcccaggaagccccatttgtgcctgccctaaggtggtccaccattttccccctttggttcccttccagttttttccccctttttatcccaatccccaataaaaatgttaacatccctgcttggtagccaaattagcccattaaagttcccctgtaaatgggggctccattatttttgctgccgagactaataaaaatttggttggtttta

SEQ ID NO: 566859 - DNA, 390 bp, Homo sapiens
atctccttatctgtacagtataatctatcttgtaagctcaaagcagattcctcagaccctacctagtgattcacatttgcgacatacagacaatttagtagctgaacatctggggacctgggtgaaatttttttgcgaaaaaacctccacaagtaaaaggaagacagctacaaatagaaaagccatttttgatatttccaaagccagtccttttgctgcatttcttatgagagatgaacatttaaagttctctttttttctcaaagcctaataagggttctggagaagagaaaatacctgactcagcgtaggataagggattacacataaaagccaagattcagacacaagtcttctagatctcaggaaataggccattctggtcctgcg

SEQ ID NO: 566860 - DNA, 166 bp, Homo sapiens
ctggtcacgtaggacagaaggtaacattgcatgactcgctcatggggaggcaatgcctccgctgacaggccccgcgggcgaaggtaccgaaagcacacgtacatcactggatgtcgatattgtcatgaaccatcaactgcaggaaccaagtttcacaaaagcagcc

SEQ ID NO: 566861 - DNA, 456 bp, Homo sapiens
ctatatcaccacaatcaattgtagaacatttttattatcctaaagaaacccagcaccatggagtggccactccccattcccttctcccacccaggccctgacaaccacaaatccacttcctgtctatatggatttgcctgttctggacatttcagataaatggactcacacactatgtagtctttagtgaccactttttcacttagcatcatgttttcaaggctcatgcatgttgtggcatgtactggaactccattcctttatatgaccaaataatataacattgcattggctggatgcggtggctcatgcctgtaatcccagcactttggggggccaaagcaggcagatcgcctgaacccagaagttggagaccagcttgggcaacacaacaagacccgttctacaaataaaataagctgggtggggtggtgggcacctgtggacccaactact

SEQ ID NO: 566862 - DNA, 266 bp, Homo sapiens
tgaacttttacagtgactccaggttcaatgattacatccagcaattccattctttatttactgaacaatactgctggctgataaaaccgaagtgttaagtcactgacacaaataaccatgtttgaggactgtaaatctaccagacagtcactgagaatcaaacacagctgatcacatcacacaactctagagaaactttgtggatgcggacacttcctatcagggttcagaagggtttcattaatatcttaagacaagtatatcat

SEQ ID NO: 566863 - DNA, 167 bp, Homo sapiens
ccatctaaaggatccccggccgctaccgacgcccagtactacggggagattggcatccggacccccccccagtgctttacaatcgtcttcgacacgggctcctccaagctgtgggttcccttcattcactggaaactgctggacatcgcttgctggatccaccacaa

SEQ ID NO: 566864 - DNA, 117 bp, Homo sapiens
taaacagtattccattgtatggatataccatatttcggttatccattcatttgttgatgggcattttggttccttcccccgttggttgggacaaatgatgttgttatgaacactagt

SEQ ID NO: 566865 - DNA, 975 bp, Homo sapiens
gactctcaggaacttacattacttcaacgtggtattatggtgattggccattgctagggcagtctggcaccatcctgtcagcctgtcagtattgcgtttagcatcttgattgcactcatcgcaggcaagtctctcaggcaacaactcaggcacatcctcatcgcactgctgcatgcgtgcagtaggcagcatatcttgcatggtggtgcatcgcatagccgcaacaggtttcacatcccagggcacgtatcacacagacagcagcatcgtcaccttcgcagcagtcccagcgaagatccccgccccagcaaagcaaggctgcagcccaacaaccacttgcagccccagcaggcagccatggtgtccatagtcggcatgtgccgcagaaaccccctcaggcaatcattcggcacacgcatatgcacagccacacacaggcaaaccacacattcccagtgccccatatactacaccgatgggcaaacatggggtacacacagcgaggaaacaccatgctctgcagcgcgcagccaaagcaaccttgacgaaacccaaggcaagccatcgggaacccccaccagggacaggcacacgccaccacacaaagcagggcatgccatgcagctcttcccttcattgggcgcaactggactgtacagaattggatcaggcatttttaggacgacacccctgggccaaaccctggcacagttcttcctcccatgcacagcacaaaaccggagccaataagttttacccacgggtcgggcacagcaggacgagttctctccacacaggcacttggtaaatccaagggattattggaacagcaggaatggatggttatagcaggccaagggaacaaatcgcagcattaccaagttggaaacccaagtaagttaggaaagcatgcaaaagaattgggaccaatgattacaagattggatgttaaacataccgaaggtattatggagg

SEQ ID NO: 566866 - DNA, 675 bp, Homo sapiens
tgcatgctgcaggtcgatctgggatcccccagttcttttcccctcaataaataaaaataataaaaatatgtgtaggggaagctctcaaaccacgttcttcctctactctcacaccaccacaacaatcatcaacacagaacacatctgtgaccaaaagtgtgggggtttttcacctctgcaccaagcagtggacaccagctcggtgttctccaattcaggttgggggctcagtcttcaagactgcctgcacacccctggacaccagttgcatgtctggggccctggatctcatgacccactgtcttcatgttggtgttcccacgatcccctctttgggtttggttaatttgctggagcatctcacagaactcagggaaacactgaaatttattggtttattctgaagaatcttacaaaggatatagatgaagggatgcatagagcaaggtatgggggaagaggtgtggagcttctatacccttcttggggcaccaccatccaggaacctccaggtgttcagctatccagaagttctctgaacccagtcctcttgggcttttgtggaagcttcatgatgtcaggatgccttctctcagggtatagggcagtcccctctctggggagggtgttaagaaccgcaatcagaaaggtggggacagattttagtcctttctt

SEQ ID NO: 566867 - DNA, 186 bp, Homo sapiens
tacctgaagtgaagggtaaagaatcgtggtggtgtgggatacaggagaagggcaagggagctcataaatagggcccagcctggctctgggttcaaaggtggaggctccaggatggcacagtgctgtgagtagctagtgcagctgagtgatgtagtactctgtattggctctggcccttgatcgagt

SEQ ID NO: 566868 - DNA, 121 bp, Homo sapiens
tttcatttcattgtggagcagcaactctttacagtgactactcttggataccagtgccatggaaggactgggaggaacttactaataactcgcttcacgaactgaaataacggcgtgacag

SEQ ID NO: 566869 - DNA, 455 bp, Homo sapiens
gcaaggtggttgtgggtaggtgatagggaaaaggtaaacagatgtattagccactggctttgtgtgggcagctgtgttgaatcagcctgctgctgagtcacagggagtaactgcagctggctaagggtgggttctaagcatggagaggagaggaaaaggggtcctgcaatgtcccccagcagcctgtcattgtgtgtgaaactcctagcctgagagccccacctctggtcagcactagtgttgggagacttctgggagggattgtgactttcagctgggtaactggtgtctggctgaggccatcttgagcgcagtgaggaaggatctccagcctgagtgtgccgtgggccccccgaatacataggggagccctgcaaagcagttttgaaatgagtagtacatctcacgaagaaagtctgcaagaggtcgaggtgcatgagaaagatctggccctg

SEQ ID NO: 566870 - DNA, 315 bp, Homo sapiens
tgagagtcagtcagggaagggagacatggtggagatggccacacggtttgggtccaccctgcagctagacctggaaaaggggaaggagagtctgttggagaagaggctggtggcataggaggaagaggacgaataggaggtggaagaggatggccccatcatctgctctgaggactattacagtgagctgtagatagatatcacagaacacctgactaagaaggaaattcatatatgagaaaatccatttggactcgtcctccttataggaggagctgcctggagagaaggacctatgcccacgtggtataagat

SEQ ID NO: 566871 - DNA, 218 bp, Homo sapiens
tgacgctggcagaagcttcactgggcagtcagtgaaaaaggcaagaacaagaattcaggttcttatcaggatctttaggcctcactgacagttttgttttatgagacaggctctcactctagtcacccagcactgagagtgtggtaggcgcacatctcgcgctgacgtgcatacctctagcctccagtgctcaacgctagcctccacaacgctctaca

SEQ ID NO: 566872 - DNA, 1007 bp, Homo sapiens
  misc_feature (314)..(314): n is a, c, g, or t
  misc_feature (356)..(357): n is a, c, g, or t
  misc_feature (476)..(476): n is a, c, g, or t
aacgtaatataagcgcgagaaactgaaggagaagaagctgacacccatcacctatccgccaggttctacccatgccaaaggagattggtgcttgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaanggggggagcctttcgcactctcaagtgccaacttttggggtnncagatttaatttttcccattaaaaccatttttggacccaattcagttaattttaagggtttgggtggggtcctaaagtgtaagagttcagactcacatttctattaaaattttagcccntaaaagtgacaagccttccttaaagccttatttttcaaaagcgccccccccatttctgggttcagattaagagttggccaaaataccttcgtgaactacacggcattggtgggttgccgagaaacaccgagcacggaacttgggcaaagaccttcgtcttggaaaagacggtaagctcctggcagttaaggaggtggcagacactggctctccttatgtagttctcagaatgcgtaaagcagaacagcctcccgaatgaagcgtggccatggaactcaccagtgagtttagcagcacgtgtccccgacataactatggtcctggtaagggagtggagcgtacgcagctcagctctctgggatcacgctgggggattcatagcggagtttcctggaccagcttaggcgggagattgggacagaactgctattccctcaactgaagaatcggtaacctgtggctgtccggggggcgtgtgtgtgacccacggccagaccgtttgcgccaaatcccagggcattacccactggc

SEQ ID NO: 566873 - DNA, 897 bp, Homo sapiens
  misc_feature (897)..(897): n is a, c, g, or t
tgcacctgccaccatgcccagctaattttttttttgcagtagagacagggtctcaccatgtagccaggatgttcttgatctgacctcgtgatccgccgacctcggctcccaaagtgctggaattacaggcgtgagcattggcttggccaaaaatgagcttttttaaaaaaacttcagtatttcctaccactgtgatgaggtataatgctcgggaattatcagaaggcttatggcagaattccgaataggggaacctaaatcatgtgccatataaagtttacttaacaaaaagttatatccctattcctcaaattgaagtgtctttcaataaaataagattttatcatttattgtcggcaactttttgatgtctcattctttaaactttaaaaaagcccttaatattttaacaaaaaatttctggatcagaggcccagttgaaaaagaggtcaaaaaaacaaggttctactttccatcagtgctataaaggtggcagcaaatgtaatctgggtgaatggtcttaattactcattaaccacggtcagaaagacatataggtgctatttgggaaaacttttatacctagggtggggttcctcaatgggctattacaacccccagtgggtcatgtttggcactttttctactgaacatacaaccgcacgtggccacgttgtgcggaaaggcaaagattgagtttggttccaaagcgcttgctatgttatttatactctctcctccattatcttcattttaagggagggtggtccagaggatcaaaaaggttattcccgccgctttaacttttcaaaaacagtggctttgttaaccacagacccccacaacgttgtgcaccgctccacgggacaaccccaggggttaccacaaagcgcacgn

SEQ ID NO: 566874 - DNA, 279 bp, Homo sapiens
  misc_feature (188)..(188): n is a, c, g, or t
  misc_feature (214)..(214): n is a, c, g, or t
tgaacatcgggaacacaatgacatatcacctcacactcaggatagctattatcaaaaaaaaacaaaacacagcaaatgtgtcaaggtggtggagaaatcaatacccttccatactgcttatgcgaatgcaaaatagttgcagcgtgctcgggttaaacagttagtggaatgttctcacaaaaaactanaaattagaactacaatataatccagncatcccattggtacgatatttatctagaaagaatggaaatcaaaatatcaaaaacatattaggat

SEQ ID NO: 566875 - DNA, 668 bp, Homo sapiens
  misc_feature (71)..(71): n is a, c, g, or t
  misc_feature (107)..(107): n is a, c, g, or t
acctgatggggtgagcttctactacgaatgaaactctgtcctcccgcaagtacaggcatcgctgtgtgagnacggcacggcaagcgcctgctgtgagtgggtctccnaagactaggcctcaggacgtggggggagccatccccgccgccctcacagtacccaccaggcagcggagacatgtgcaattagagtattgtgaggtgtcctttctttacaaaataatggggtcttgggcatttcacatcactccatctttactgagactttcagaatcacacaggccctttccgtggatttcatttggggcaaagaaacaacgtagttttgtttttgttttcagcctatggaatgatttccttttgtctgtcttgttcaagttcagacgtagctactctggcatctgcacatttccgtgtcacagcagccgcataatgaattttatccacctccatttcagcatgtggctcgcgtggacaggtgactggagcgctgtggcggcatggatcctttagaacccagggacatacgctcagtgccgaggaaggaatgcacgggactcaccgagctgcagttaactgttctctttctggctattttgtgttgcttgtttctaggtgttgactttgtccgtgccaaaattttccactctgagtaaatcaaggctcagt

SEQ ID NO: 566876 - DNA, 1076 bp, Homo sapiens
  misc_feature (383)..(383): n is a, c, g, or t
  misc_feature (425)..(426): n is a, c, g, or t
  misc_feature (545)..(545): n is a, c, g, or t
cacgtagtgcgggggcaccggtttttccctctgagccactgtgtgtgttacctgcccgctgtgctcctcgcgctctatatggaggacgaccccctattatgtgggggcccgcttctgtctggccaacagaaacgggggggggcgctcgctgattgttgtttgtcgccccagcggggaggattattattatgcgggcccccccccttttttttttttttttttttttttttttttttttttttttttttttttttttttttttttttttttttttttttgctgttgtaaatgtctcagcccctcgttcttggtcctgtcccttggaacctttgtacgctttgctcaaaaaaaaacaaaaaaaaaaaacaaaaaaaaaaaacaanggggggagcctttcgcactctcaagtgccaacttttggggtnncagatttaatttttcccattaaaaccatttttggacccaattcagttaattttaagggtttgggtggggtcctaaagtgtaagagttcagactcacatttctattaaaattttagcccntaaaagtgacaagccttccttaaagccttatttttcaaaagcgccccccccatttctgggttcagattaagagttggccaaaataccttcgtgaactacacggcattggtgggttgccgagaaacaccgagcacggaacttgggcaaagaccttcgtcttggaaaagacggtaagctcctggcagttaaggaggtggcagacactggctctccttatgtagttctcagaatgcgtaaagcagaacagcctcccgaatgaagcgtggccatggaactcaccagtgagtttagcagcacgtgtccccgacataactatggtcctggtaagggagtggagcgtacgcagctcagctctctgggatcacgctgggggattcatagcggagtttcctggaccagcttaggcgggagattgggacagaactgctattccctcaactgaagaatcggtaacctgtggctgtccggggggcgtgtgtgtgacccacggccagaccgtttgcgccaaatcccagggcattacccactggc

SEQ ID NO: 566877 - DNA, 340 bp, Homo sapiens
  misc_feature (30)..(30): n is a, c, g, or t
  misc_feature (38)..(38): n is a, c, g, or t
  misc_feature (59)..(59): n is a, c, g, or t
  misc_feature (139)..(139): n is a, c, g, or t
  misc_feature (148)..(148): n is a, c, g, or t
  misc_feature (262)..(262): n is a, c, g, or t
atcaggcgaagacgtggggcccggcatgtnggaggggngcactaccttccaggaagtgntatccagaagctctctgaacccagtccttttgggttttgatggagacctcattctataggcatgatgggttaaaccatangctattggngatcaactccacctggggctctccaccctccctggaaattggggttgaggctttgccattctcagtctgactaaaagaatttacccaaacggaactttaaaacagatgagcatnactggaatcttaattagatgattggattatttggagccacaccttgatattcctaacccgagcaacctggtccaagga

SEQ ID NO: 566878 - DNA, 169 bp, Homo sapiens
tctaggcaataatactcacatagctggggcgcgccagactttggaacctattggaaaagaaacacaacacaacaatgttacgaaggggaagaattatagtttataatctagaagtctatggttgtgctagagcatgagccatggccgtgagccatgggcatgttccatg

SEQ ID NO: 566879 - DNA, 250 bp, Homo sapiens
acatgatacaaccgagcgcggacccgcaacattcgtgtcatatatatgcgcatttttgtgcttatgcacccccaggagtgtatcgtgtgtgccagtgtgagtgccgttgtttaaatttgtatcccgaaactcaggtgtatccacatgttcatggtatacctcggccggtcctagacctagtatcagactctgctgctcctcactggcataaaggcagaccctgaactgggcatggggacacgaatgttca

SEQ ID NO: 566880 - DNA, 514 bp, Homo sapiens
  misc_feature (24)..(24): n is a, c, g, or t
  misc_feature (345)..(345): n is a, c, g, or t
  misc_feature (418)..(418): n is a, c, g, or t
  misc_feature (481)..(481): n is a, c, g, or t
  misc_feature (495)..(495): n is a, c, g, or t
  misc_feature (506)..(506): n is a, c, g, or t
aggatttgaaggcctcagaacacntgaatgagaaatcagtgagagaggtagcaggtaagcaaggaagcagattgaagaccctagatgtttatgatactgctgtgctaatgccttgatgagtgagaccagcagaaataagtgaaagcaggagaagccatgagataatatatctgaagtctgatttaattgatgtgaaatatatcactgacaaagtaactaaaggtcctccccctggaaccaacctgggatccattccttgagatgcaactggtcttccgcattaacagtgaagatgatcacactgagcagagactagtttgagaatggatatctgagtttcatatnagtgtaggaaggcaagaactttgagaatggtataaaggagagaacaggcatcacaaaccatgaagtagaaggnagcaagggaatattttctggcttaaaaggatttgaaggcctcagaacactgaatgagaaatcngtgagagacggtancaggtaagccnggaagcgg

SEQ ID NO: 566881 - DNA, 325 bp, Homo sapiens
  misc_feature (52)..(53): n is a, c, g, or t
  misc_feature (56)..(56): n is a, c, g, or t
  misc_feature (60)..(60): n is a, c, g, or t
  misc_feature (62)..(62): n is a, c, g, or t
  misc_feature (64)..(64): n is a, c, g, or t
  misc_feature (71)..(71): n is a, c, g, or t
  misc_feature (75)..(76): n is a, c, g, or t
  misc_feature (78)..(78): n is a, c, g, or t
  misc_feature (88)..(88): n is a, c, g, or t
  misc_feature (91)..(92): n is a, c, g, or t
  misc_feature (96)..(96): n is a, c, g, or t
  misc_feature (195)..(196): n is a, c, g, or t
  misc_feature (243)..(243): n is a, c, g, or t
cagcagtgaatgctgaagtggggatctgggaagcacatcacaacatacattnncanaacnangntaggagnagcnnangtgaacaagnttnntttnttctatggttggtggcttcaacgaagtcagaattatggcctggatgagtacggtgagaattccttttctttacttccagcccactacacaaagttccannacactctgatgctgcagtctagcttgagggattctagcagggaaatngctaaagggtcccttctaggatctggttatcttcctgccttcaatgagcctgtcttctttgtacactccattctatggttgt

SEQ ID NO: 566882 - DNA, 1263 bp, Homo sapiens
gtgttgtacgagcgtgagtgaggagagcgacgggagggatctgacgtactatcttcgttttgtgatcctgagttctcgcgttcttgtgccgtgttcatagtaccatgtgtctgctcttccttgtgtttctcgtgtcgcttactgtctgtgcctcactcttttgtgttcgctttgtctgcctattgactcttatttttctcggttctttggatggtcttgtctgtctttctgatttcctagagttgtggacttattcctgtgtgtttcttctttattgtcccctacgtactatctggttgatccctccccgcaggcaacacgggcattggctgccacagagtctgtggtgaacgccggtggagaatttctggaatgccgtgcgggaccacttttcgtgcgtccaagtccaagtcacaagctaatctgtccccggtttaccactttggttctaatagtagatggtgagctacgtgttagtctcgattggctattgccctgggcctgggggaaacctcacccaacgcccagcttccagataggcctccagctgagcagacgggccccgatcccgccagaacggccattgcgttccagccaaaagtacaccgccgacacgcacacctccaacctgggacatcccatcgctgggcctcgcaacggaggaacctgcagaatttggattctgaggctagtcgggaggcctcggtagccaggcagaacaggatatctgccaaagggtgtctgatgtggggtggggctggcatcctcccaggaaggttctaggtgggaccccgtcttcatgggggcgcggggtgtcgttttcatcttccctggtttcctagaactcacttcctttgacggcgtgtgttggtcccatctctcagaccaggctcactgaggcagacggagttgactcagaggctcacatgggcacccccacttggcttcgtgtgagcagctgcccagccccaggcctgcacgctcggcgcgtggtccagcatgaaggcgtttgccatctgcgaaggatagcacggtaccctgccacacgagagcaggcctggtgccgcctacaccaactgggaataaactggaagctgggtctccatctgttgcgtatgtgttctattgtttgaagttcccaggaatatttagaggcgttcacgctgatgtgtttagggatcttctctgtgggggaaaaggaagaggagggtcttgttctcccatctgtttattctttgggctctgggatacaggcgactactt

SEQ ID NO: 566883 - DNA, 147 bp, Homo sapiens
tacggacccaccaacatactcgtggatgattcgctgcaaaaatagaatacgagtgtagcttttccatgtaagttctggctgggtaacatgagtgaatcattcgtaaacaagttccatgcactggatttatatggagatgttaacagg

SEQ ID NO: 566884 - DNA, 114 bp, Homo sapiens
gtgattgctgagggctgactcctagaggatccctgtccttgattgtacgtgctagtcagaaacagtgccagtttttccacaaagagcggatggaggtgtagtgagaatcaccag

SEQ ID NO: 566885 - DNA, 3708 bp, Homo sapiens
gcggtgcgggccgggcgggtgcattcaggccaaggcggggccgccgggatgctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcagcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctcatatgaaaagcacaaggggccaaggtcagggagcaagaggtgtgcacaccaaaactattggagaattgcgtggaaatcttcagattcttcactggtgagacaatgaaacaacagagacagtgaaagttttaatacctaagtcattcccccagtgcatactgtagcgtcaagtttttgcttctggctacctgtttgaaggggagagagggaaaatcaagtggtattttccagcactttgtatgattttggatgagctgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagtctccaaagagaacgccctcatgctcagcacatatttgcatggaagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggagggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatccggtctttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaagggtcactactgcatttataggaccttctggtggttctgctgttacgtttgaagtctgacaatccttgagaatctttgcatgcagaggaggtaagaggtattggattttcacagagggaagaacacagcgcagaatgaaggcgcaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatggggtccccaaaatgggtaacctagacttcagagagaatgagcagagagcaaaggagaaatctgggctgtccttccattttcattctgttatctcaggtgagctggtagaggggagacattagaaaaaaatgaaacaacaaaacaattactaatgaggtacgctgaggcctgggagtctcttgagctccacgacttcaaaattaaaatgagccatgagtcaaaccactgcaatccagcctgggcaacgagcaagacccagtctctactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaagggttacacatttcactgtgatgtatattgtgttgcaaaaaaaaaaaagtgtctttgtttaaaattacttggtttgtgaatccatcttgctttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttactaaaaaaaacaggacaaaaacacacaaaaattgggggggcgcctgggccagagaaaaggtttttctaacaccctttggtgggggtcgcggcgggccccaagaagttaaacgcgtcgaccacttgtccatacaggcgtggctcccacaggagaagctctggtgtactaggagacacagggggctggggttctcaccacaaaaaaaaaaccggccggggcgggacaacgcggagcgtttcggaacaaaccaccaagaagggagtaccagggaaggacacacaaaccggggcgaccataccacacggggacgcccaaggcgagcgacgaaaataccaacttacgcccgccggccggcgtggcaggacagcagcagcagcgacagaacacagcagacgacaacgacagtgaagacaacgaacaagagagagg

SEQ ID NO: 566886 - DNA, 202 bp, Homo sapiens
gttctcaacaagggcagatatggtgctaggagctgaagatattgtgtgtgttgtgctgctgtggaaggttgtatattgttgagcaatgggatgaagctgtggtactgccaggggacagatgctgtgtcagtatgaacctgggctgcgtgtggaagtgttgtatgattgttgagcaagtggatgaggctgtgtgtacgtgcca

SEQ ID NO: 566887 - DNA, 1500 bp, Homo sapiens
cttcatatgtaatacccatcataatcgtgaggctttggcaacctgactagcttccccataataatcggctgcccccgactatggcgtttcccctgcataaacaagcatacagcttctgactcttaccccacctcgtctcctactcctgctcgcactctgctatagtggaggccggagcaggaacaggcacgaacccgctctacccatccctatagacagggaaacctactcaccaccgctggaagcctcacgtacgcaccctaacccaatcatatcatccatcaacaccctagcccaggctactcctccactctactcatatcagaggcgacgcagctcaacacccttccactcaaccacaacaacttactcacactactaaaacaccaccacatgaccccaccacagcccaacaaaaccacccaagcgccccccctcgttccagcaacctgcactcgcggaccgtaagtccaccacgccgccgcaccccatacccttatccatccactaactaccatccatccaccccagacaccccatcaggccgctcgccatagcgacccaatacgaacataaacatcacctcacacgtaacacccagccacccccgggcaacacgcacctgccaagaccgagcccccacgcctactcgtctacgaaatcaccacgacccgggaccgggcacaggcaacgaaccccccccaccttaccctacctacgccaacacccaccaccacaactccacctaggcactccccctcacccgagcacccagcccacaatggcacaccgcaccacatcactcgccttcacactccccctaccccaaagagaaccccgcgcgcaaccctaccaacaccttcccacacaatcaaacaggcccacgccctcacactcaccatccccggcgcacacccactaacaagaaaccacccaaccctggggcccataccatactagcgcaaacatgggccaccatcgcacgccccacacagacactactccacaccacctgcgcaccctccaccacacacgaagcataccacaacacaacgcagacacccacacaccacagacacatctacaaccaagcacacacgcgcacaccaccacaccatctccacacaacacccaaacacaattacacttctcacacctaccatacacactccccaccttacctacatctccgcgcacaactccccaacaccagggcacgacaccaaccacacacccaacccacagacaccacgcactcaacccacatccgacccccgcacaccccgcccaccccacacccacccctcacaccctcccccgccacagccaactccgaacccccaccaccgcaacatacaaaccccaccacccacgcatcgccccccaccacgcgccgcccctcgccctgcccaaccacgacacacacagccagcaacagcctcaacgcccaaacaccaccccgctcctcacacccacccactgccagacaccgcccacaga

SEQ ID NO: 566888 - DNA, 281 bp, Homo sapiens
aaacagtgatcacacaggagagcggcctcaccagtgtggtgagtgtgggaagggcttcagatgagagctcgaaccttcacattcaccggtgcatccacaccaggagagcaagcttaccaatgctatgagtgtgggcagggtttcagccagagctcggattttcgcatccatctcagagtcccacctggcagagcaagccctctcactgtggcaagtgtgggaagggatttcagcccacagtccaaactcctcatcccaccagagagtacacacttgggttc

SEQ ID NO: 566889 - DNA, 526 bp, Homo sapiens
ggcccaagcctggccattgttccgccgagggaggacagctggggcctggcgctggcgccgagacgccagctatagcggccgacgaatggagacactccctcccgactcccgggtctcctggacggcggaggaagatgaggctgacagcggggaaccatgggagaaccccatatccgacacatcaccacgaggattgacagagagacgaattcccacgagaaatcctggcacgtaggagacgggaacgacaaaaatgacgacaacagagaacaaatgaacgagataaaccagagaaccgagaacacatatcccaattcggcaataatacaccatacgcacattattttcgccacatatcggatcattccagagagacaccacggggcagaatcaataccattggaaaagtatcaccattcattgaaggggtaaacgggaaacagaaatggcattgcaaaggggaagacttggaggcagatggtaacaggagagacatagaggacccaaggaaaaagaccccgcaaga

SEQ ID NO: 566890 - DNA, 251 bp, Homo sapiens
gatgtatccccctttaacgtgctagatagtacccgatcgagccgctcttcgttggtgatcatgaatcacacgtgttcaaattttcctcactcctatcaatatgagtcctagcctccccgaccattagatgctcaaggaggagcatcgatggatgtctgtgctcgcgtggcgccccacaaccctgctccccgacgtccaccgtgatccacatccgcagcgagacctccgtgccccaccatgtcgtcaggtcc

SEQ ID NO: 566891 - DNA, 137 bp, Homo sapiens
ctctacaggatcccctcgaagatggctggttggcggaagaatcaagcaacgagatgaacacactgcagcagaaggctgaatgagcagcagagtgtgcttcagcggtattgccgcccccaagatgaatggccagtgga

SEQ ID NO: 566892 - DNA, 1043 bp, Homo sapiens
gcactcattagtgccgcaggtgcgcagacatgtcgggactcaagagagtctccggcctcgagccgtccgtggaggtagacgtaggggacctacgagcagttccgtcatcaggcagagggcagactgattctcgaagttccacaggacgaggcaaaggaccgtgggacaagaggtttatggaacatgtgtttcagcgcgacgtcaaggaccgtggtccagagggtgactatgtccatggcatacggacgtttgggtgagagacagactatggcagctcgattcagtcagtcttcgtccgaaggggtttcagactgggtgcaacttagcagagcaagagacatcccagaggttacgacatgaagcgagaagaaggcactggcaggacagcatgcctgcagatcgggaggtccatgtgtgtggagatttcacttaagacattcgtgagggagattccatggagctggaacatatggtgtctggaacatgaatgaaaagtgtgataaagaaatcaaggtttcctacacggtgtacaagagactgtcatggctgctgaagtcccgcattacgtagctaataaactaggagtggaacgaggctataggctcgtccaggaaaaaagggcatgaatatgtaatatcatacaggatatatgcggagaagtacagtgagatggacataagaagacaggattccagaccaggacggcactaggcaccactggggcacccctgatggggcaccaaacaagcctatactggtgccttaacagaataaactagagacaatccatgtataacagggcaaatggaaaggaccccccaacgtaacacgggagaatacataataggagacagatgaagggacgcgacccaaaaccaggcaccacagcccaaggaacccaggacaaaaacaacacagagaaagacagacaagcaagaaaaaaaacacatgggaaaaagcgacaaaagataacacacgaaacacacaacacaaaacaaaagacagcacaaaacaagagaatccaaacaaacacaggcaagaac

SEQ ID NO: 566893 - DNA, 468 bp, Homo sapiens
ccttcttccacttccaacacttggcaaattctgagggcctctgacagaggttaggtgtataggcactgttatcgccaatgtaactggctcctcttggtgattacagttttcttatgttgaattttggataactttatttttttgtctgcagaggaaaaaaaaaaaacactaagtgattgcagccaggcacagtggctcatgcctgtaatcccagcactttgggaggccaaagcaggtggatcatctgaggtcaggagttcgagaccaacctgacaaacacggggaaacccagtctctactaacaatacaaaaattagcttggggtggtaccacgcgcctgtaattccagctactcaggagggtgagacaggagaatcgcttgaacctgggaggcggaggttgcagtgagccgagattatgccactgcactccagcctgggcgacagtgagactcccgtctcaggaaaa

SEQ ID NO: 566894 - DNA, 190 bp, Homo sapiens
  misc_feature (37)..(37): n is a, c, g, or t
  misc_feature (39)..(39): n is a, c, g, or t
aaagggcagggcaagggtggcaaagggacagggcggngncgggccgtcatacgcgagcctcatgaaagaaagatccttggcactgctgggatgctctgagtacgggtgcataggtcagaagatgaaggaagggccaaggagcagcggcacctgcacaataaagagcacttcagagccaagcagaaggagg

SEQ ID NO: 566895 - DNA, 530 bp, Homo sapiens
tgaccaggtggggttgcaccggtatgtcccctactgttcattacctcgctcgcagggtgcctgcccctatggaccttcaatcagccaacatctcaccttcacagtcaccagaatgtccttcaatcatgtcgcttactggtataaacaagatcctaggatttaaaaatctgatgtgtgcccagaactgagccaagcaagattataagacaagtcatgaccacaggaaggaactttccatctggcaactgtgtgaccttgacggtcagccttcgcttcctcctttttcttctggtccctacaaagcacccaatggcaccacatacaggcaatttctgttgggcaaccctaggagaagcagcttcccttgtgtaatgcagatgatacttcctaatttcttcttccctactcagaaatcacaatggaaggcaagtgggcacacggggtatcagaatcctcatctgagcagagtctcaccaaagtgcatatgtaggtgctctggggaaagttagtccttggctagatatgtcaga

SEQ ID NO: 566896 - DNA, 415 bp, Homo sapiens
  misc_feature (146)..(146): n is a, c, g, or t
gacgctcggtttccccagccccgttaggggggtttttgttcgtttttcggggcaaacccccgggtgatggggcctcttgggggcccgggggggtggcccttaacctacttttttttttggttccccccggggcaaaggttgggccngggggccccccccccccccccccaaaaaaaaaaaggggccccaaaaggcccccgcgggggttttccccccccctttcccaaaaaaaggggtcccgggttctccctttttgggggggaaggaaaaaccctttcctccccggggggggccctgggcccccccccccggccccggttttcttttttaaggggttttggggcccccccccggggggggttttttttggggggccaaaggtttgccccccaaaattaaattccggggggcccca

SEQ ID NO: 566897 - DNA, 163 bp, Homo sapiens
catagagcctctcctgtgtggtctgcctctgatctgcagactgctcttagcccctgtgctttgtgccaggctggaggagggcagtccccctattgtgtgccaagccaacgcctcaggaatcaggaggccagcctggtaccaaaatggagtacccagtgacctg

SEQ ID NO: 566898 - DNA, 410 bp, Homo sapiens
  misc_feature (12)..(12): n is a, c, g, or t
  misc_feature (46)..(46): n is a, c, g, or t
  misc_feature (131)..(131): n is a, c, g, or t
  misc_feature (143)..(143): n is a, c, g, or t
  misc_feature (153)..(153): n is a, c, g, or t
  misc_feature (172)..(172): n is a, c, g, or t
  misc_feature (187)..(188): n is a, c, g, or t
  misc_feature (230)..(230): n is a, c, g, or t
  misc_feature (274)..(274): n is a, c, g, or t
  misc_feature (371)..(371): n is a, c, g, or t
  misc_feature (400)..(400): n is a, c, g, or t
cgagagttgaantggttagaacccagatgcattatgaaatggcctntgaaatgaattgttctgcaaaatccctagaaaagtgatgctgaggaggacagcagatatggccatctgtttaaagtatgttgtantcagttataaantgattgttantctacacataattatgaantcagaatttaaaaannggggaaaagccatttatttagcaagtttttagcttataagtncctgcagctgagctgtcttaactgatcctggttttgtgattganaatatttcatgctctgtagtgagagagattccgaaactctgttgctagttatctgcagcaaataattattatgctgatgttgctattgcagtttaanattctcttgttgcatcttagtagaaatgnaaataaccac

SEQ ID NO: 566899 - DNA, 344 bp, Homo sapiens
gggaccgaggatcccgcagttcgtcccatcagctggatactttcattctgccaaaaggctcaaagatcccacgaagcatatcttcagttatgtggaagtgtaatgagcccacataaagcctcataggtccagcacttcccttatgtaaagtgtttgccatgtgctgcagctctagtttttttctgcctcgtgatgccttgtactatgatgtggcacgcctcaaaactcgtgggccagttaatccgtatagctacgaggcacgtgagctaacatcgacgcaactccacataatgcaattccgttgggaacgtcttgaatttctgtccggatgggagcaagatgcg

SEQ ID NO: 566900 - DNA, 908 bp, Homo sapiens
gcattcgtatctctccacatcctctctgtacttacagtccccaatggcccccataaagccagagcccaagaaggatgatagccaaggtagcccactaaggtcagactccagttcccgcaactccccctgagcctgagcgccctaaggaggtcgagtttgattgcttccacagagtcaaaattggagttcactacactgaacacgacttgaatgagcttcgaagggtaagccattcaatgctgtacgagcctgcaacgatcccagagatgtgagtatgataggatcatccgtactgggcacgtgtggtgcgatgtcctgacgggtcgatgtggcctaggaacccgcacacagggcaagaatagtgcgtccagatgtcctgcgcggaaagcctaatgacatgagaagaagctcagagtaccacaggaatgattggacgttatgaacacttttccatgccgtatgcatcctaggtcgacatttcacaagaaacagagggacgagcaggctagcgctatgaaggacctatcgtggtaggggagcttgcgggctctatcgacaagagaggaggaattggccactggtcgatggagttggctcgtagcgtgtcgcacacctggttgctgggcccgacagctagggctgcagaggagctttgacatgatagcacggaatgcttggaagcaaagtttagagtaggcatgcgagccacagaagggaagctctcaattggactagcgatgtcaagcttaattgcacaggcagtttttgggtgaaaggcaccattcagtgttaccagagcttaaaaccctcggatgggccccatggaaggacactagtgtgacagggcttgtgtgcaaggtggactgtcgtcatcttgcgcaatgatgtgcatgcgttgaacaacccag

SEQ ID NO: 566901 - DNA, 290 bp, Homo sapiens
  misc_feature (108)..(108): n is a, c, g, or t
  misc_feature (146)..(146): n is a, c, g, or t
  misc_feature (238)..(238): n is a, c, g, or t
  misc_feature (260)..(260): n is a, c, g, or t
ggtggctgcttttgaaaggaggtgggggaggatggcggtgatggcctcctggtgtgtggtggtctctgcatgaggaccagtcatcgttggttaccaactatcaccagngggtctaggtacggagtccttcagagaggaggtctctnggggtcccgtgctctggtctctgacgttgagtcctcgtacatcgtggtagtggtgaagagtaacagtcttcataggttcacagtcattatcntgtgctctgaggcggagctcangagccagaaggacccctgtagagcaggacc

SEQ ID NO: 566902 - DNA, 315 bp, Homo sapiens
  misc_feature (12)..(12): n is a, c, g, or t
  misc_feature (20)..(20): n is a, c, g, or t
  misc_feature (30)..(30): n is a, c, g, or t
  misc_feature (36)..(36): n is a, c, g, or t
tcattgcacgcncgaattcncggccgctcntacacnacgagggagcacatggcttacactgtaatcccaacacgggaggccaaggcaggtagatcacctgatgtcaggagttcaagaccagcttggccaacttggcaaagccccgtctctactaaaagtacaaaaattatctgggcctggtggcgggcacctgtagttccagctactcaggaggctgaggcaggagaattgcttgaacccaggaggcagaggttgcagtgagtcgagatcacctcgctgcactccaggctgggtaacagagtgagactctgtcgc

SEQ ID NO: 566903 - DNA, 278 bp, Homo sapiens
tgtgcctctgggcgtatctccgtcttgacgcttcgtcgccgtagtcggtgtactcgtaggttcagtaccacttggtggccacttgctttgatggtccgggcgggctcgttgacctcgtctgttatgtaaaggatgcgtcaggatgggagggcgatgaggactaggctgctggcgggcaggctagttcagacggtttctctttcctgagcgtctgagatgttagtattagttcgtttggttgtgagtgtcaggcaccgggcatacgccccaggttagca

SEQ ID NO: 566904 - DNA, 180 bp, Homo sapiens
acgtcatttagaaaatgctcacagaccggcggctacagaccttaatgagagccgccgtgcagacgtgcttgccttcctaagctctggcttcactgacttggcatagattgtgtcccggattgagccccccacgagctatgtctcttttggctgtctgacggaaggagtcagattgtctga

SEQ ID NO: 566905 - DNA, 285 bp, Homo sapiens
atgcaggcgtaggctctatctggtccaccaaactgagcttgcggaataataatcagcgatcacccttataacgttctatgccaggcactattctaagacctgaatccaaaccttaccctttgaacagaactgtcctggccgggcgcggtaggtgtatcattagaggtcaggcgtccgagaccagcctggccaacatggtgaccgctagtctctactcaacatacacaaactacgccaggcatgatcgcggaaacctagtggtcacagctggttaagggctgctgt

SEQ ID NO: 566906 - DNA, 168 bp, Homo sapiens
gaaaaccataatcccaaaattaatggccatcattggtaatcataatggcaagctccccaaaagctctaaggcctctcacgccaaagccttcatagtactccattccacagcccagcacagagtttctgaagagttgcctctgcaaagctcaacaaggggccagggctg

SEQ ID NO: 566907 - DNA, 374 bp, Homo sapiens
agtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccaaaaaaaa

SEQ ID NO: 566908 - DNA, 111 bp, Homo sapiens
gtggaatgcagatcttcgtgaagaccctgactggtagagcatcaccctcgaagtggagccgaggtgacaccattgagaatgtcaaggcaaagatccaagacaatggagggc

SEQ ID NO: 566909 - DNA, 159 bp, Homo sapiens
  misc_feature (12)..(12): n is a, c, g, or t
ccaggtccaggngtctggtcctatttcctcctgtggcccggagttgatgtgtagggcgggatacccagctcctgcacctcgggcacatcgggcagcacatagcagcatatggtgaggattcatctcggtctgcctttaccttcatcccaccagtcacac

SEQ ID NO: 566910 - DNA, 140 bp, Homo sapiens
cagtactacgtgtgataaggtaaaacagatcgctaaacagacagtcaaacaccacacgtcctgcctcattaccaggagctgcccaacaggcaatgtgggctcagaaagtggaacgcggatgtgggggactcactgtctgg

SEQ ID NO: 566911 - DNA, 547 bp, Homo sapiens
taaattaataacggaaagtttggtgtgaagctacagatatctaaccaaaaaatttctgatcccttatacggggatatataatatggaggctttggtagtgcagtgaaaactggaatttatgcctttgggtaaacatgataggtataaatggtcttataaacatccgggagtatgtatacgcttaatggactgaaatttatggggacctgattacaatgaggggattcaaatcgtggtcaaccgtcaagttcagtcaaataatttcacctacgggaatatacggcccaagccagtaagggttaatattggcattccgggctttaatttcctcctcccatccataagtatatactggaaagtcacttctggtagcctatgatgggagtctctggaagtccctaggaagaggcaactacaaactactagtatccggattcagatgtagtcatcccagaaccttctctttatgagtccccggtagtacaatctccaaactggatgggcttgggtgtccggaaattccggcaaaagcttcacaagttgtctc

SEQ ID NO: 566912 - DNA, 173 bp, Homo sapiens
  misc_feature (36)..(36): n is a, c, g, or t
  misc_feature (125)..(125): n is a, c, g, or t
  misc_feature (145)..(145): n is a, c, g, or t
tataattatcgctgtgaggatacgatgcgaatgcgnccctggatacactgacgctcatgccgaagcgtgggagcaacggatagatacctgtagtcacgcctaacgatttactagtgtcgggactnatttcttggtacgcactaancgtgagtagaccgctgggagtcggtcgc

SEQ ID NO: 566913 - DNA, 116 bp, Homo sapiens
gtagattctggggcactcaattagtacctggtggagttgaatagtgagaaaatctgctcatcacagaagaaggaacggggatgatttcctaagttcccattttccacaaagcagaa

SEQ ID NO: 566914 - DNA, 913 bp, Homo sapiens
gccggctctgtggtgcggagttgcgccggacttcccagcttggccagtggctccgcaggctgccggcgtccacccctcagagttcattttggattcaaggttggctctcaacaggtgccagctggcactggtcatcctaaaggtacttctgtggaagagatacatggtggtgtccactgtggtaccagtgatgacacaagaaatcccaggatctacctggacgggcctgcgagggttgaagtatggtgcaacgcgaatagccttacagggactggctggcttcgagctagggcatcgcgagacctaggcctcctggcactggcctgggtagagaccaggggcgagacaccggtgtgatccgccgcagttggaacccgtgtgagcaggtgcctgaccagggcccaggccatcgccaaccgagcttccatctcatggaaccctccaggggagaagccgggagaggctggcggactgtcagatcacaccccaggctgcatgaagtcacgcacaggcgagttctccctggatgtcgcatccatgcttactgataagcgtgccgtggctgtgggactggctgaactgggctgcctggggagagtgcctgggcctggagtggctggacctatcaggcaacgctgctcgacactcacctgggcccgcatggcctccttgcgccagcatagtcgcgtgcatcaaatgtctcgaacgaatcggctggacgggtctggagccacttggcacaccagttgagaactgtgcagcagtctcaatgccgacaggcgacctagtgggacaccccgggccagctgcagagtctgagctgggctaccgaggcctgggagttactgcggctcggagaccgctttggacccggatcagacagccgctctgtgccagaacctacctaatgggc

SEQ ID NO: 566915 - DNA, 1616 bp, Homo sapiens
gctcgagtttttttttattatttattttagttgagaccaaccggggcaacatggttgaaaccctgtctctactaaaccataaaaaaaatcagccaggtgtgtgggcatggagaggctctggtagggcttgagctttgcaaagaggatctcaacatgtgccttgtggcataaagattttacataccattccgctccttggaaagaggaaaaagaaaaaaaaaaaaaaaaaacccaaggcgcaactctatatgtgtgtcgggagtgtgcgacggaacaaagagaggtataaggaacaggcgcacaagtgtggcccatctacacagtgtatactcctgatcgcaccccaaatattatctgtgtgtctaacaaaggtggaacaacatctctgtcgcacggagataccccctataatgaggaggggagaagagcacagacgctctacacgcatgtctccccagaacaaaagagacccgcgagtataacaccccggtgcgctcatatgccaaggacacagcgcgcgacacaaaacacaagagccaaagaaagcacgagacaaggcacagacaagaacgacacaacacaaacgaggcagcagacaaggaaacacacccccagcacagcaagacccacacacacaagagaaaacaaaaaacgaacgaaaaaagaaacaccacacacccacagacaaaaagaaaaaagaccacaacaagcacagacgaaacacacggacacagaaaacagaaagaaacagcccaacaacaaaaaaacacaaagaaaaacgaacgaaaaaacacaaaagaaagaaagaacaaagaacaaaaccacgcagagaagaaaaagaacacagaggagaagaagagagaaggaacagaggaaacgacgacgaataaagaaagagagggcagagggaaggggcagcgggcagacagcgaaggggggagagaacgggagcgcgagagcggggagaagaggcagagagaaggaggagacggagaccgaggaacccagaggagaagaaacgagagagagaagaggagagaacgaagaaaaaaaaagcagaggagaggaagagaacggaagagaaggaacgaaagaagaggcgaggaaagaagagagagagagggagagaagggaaacaaagagaaaaggcacaataagaaggagacggagcgacacgaaccgacacgaaggagaaaagcagaggagcacagacacgaccaacagcgacgcaagaacagagggacgagagggaggaagtgagagaagaggagagcaaccgacaacaacaaggagaagagagaggaagtagaggacgggaaggaggcagcaaacaagcaaggagaaagaggagagaaagaggcgcaagagcacaagaagagaaacacagagaacggagcacggaggaagagaaacgcaagaacacggacgaaacgcaccgaaaggagggaagagcgagaggaagggagaggacagggagaagacagagagaaatacggagaaaagggaagagggagaaaagacagagaagaaccaggaagagaagagggaggacgacgagaggcagaagagagcaaaaacgaaacagaacggaaggaaggagagacggcacgaccaag

SEQ ID NO: 566916 - DNA, 207 bp, Homo sapiens
cccccccccccccctttttggggggggtttttcccccccctttttttggggggggggggggggagaacttttggttttaacccggggccccccaaaaccggggggggccccccttttttcccccggggcccccccccttttttttttttttcccccgggggggggggccgggggccccccgggggtttttttcccccccccccccca

SEQ ID NO: 566917 - DNA, 1382 bp, Homo sapiens
ctcccgtctctcagtttgcggccggtccatttatgccgttcccccttgtgttcctgtgcccccttccggttttaggtgacccccctattttgtagcctcctgaggaggtccccacccggtgtttgtcccccacatatgtccagggcgtgttttatatccgctgcgccccgggtgccttttataccgggtcctctaaagggtacccgagtgcccctttggttgtgcccgaattttcgggtcccctggtgtgctaagccccggagatgttgtttcccccgctgggccgtggtgcccaactcgtgatgtgtaaaggggccttttttggcttgttttaatggggatatccaagcgttttacgcagcccgccgatgcgtattcccgccccccagggtgcaagaaggtgccccacaggtacccggggtgtagtgttttcctaccacagagaccgcggccccaaatggggcccaacctcgtgtggggcccacaaaaatcgcccccatgcagtatatgggggataggaaatgtgttttcgcgtgattatgtatgtgataaacacttttgtttagtcccccttctcaaagcccaattaccgtgggcgcccccaggggttcttttacgctgtaatacccccatgggcccccacacattttgttgcgcccccccccacacccacccccgtatttgggctttctctcacggtgtgtcttgtcctctccgacaccactattgtggaccacaacagaccacagaagcttggggtctctgagattggcgcccaaggcacaatttgggtgtgtttttgggatagagaggtgcccccccgaatagcgccctcttagatattgtcttgctccgcgggcacaattttggaaggccccccagggggcaccccacaaaaggacccggggagtaactccccacaccacagaaaggttgtatttccttccccccgatctcgtgtggtgaagtacacgctgtgtggataggcgccacctgtcttctcttgcttgtccccctcccctcttttgaaccctgcacattcccggaaggataactgcccgcctcccgaaggaaggcaagccccgaagggtgcctgtttgaagcccaacacgccactttgggaataatgtgcccttcctccacaggcgtctgcttggaacacagctcctctgcacaggcaccacaccctggactatttcccacggcacacacagctgtgggccccaggagagccacagctcacaggtgctcccctccaccccatggcccaggctgtcccaaaaagcccctggcttttttcacgcctttgctgctgggcctctcctgggactacccctgtggcgtcttacgtgttttctttgctataaataaaccctagttct

SEQ ID NO: 566918 - DNA, 649 bp, Homo sapiens
cctctgtgatcagctgcactccttagcaaaagtatatatggagaatcaactgagaccaatcattatctaggtgtaaagaaagaccagatcccaggaaaatattatcggtgacttcccaagtatgcctggccacaatactcttatcctatagtgacaccccacttaatcagcctctacttcatagagcttattggcgggctggagggtgtcatttccattcttttcctcccggtcagtgaccaccatggcggtcattaacttgatggtggtccacagcgttattctgctgacagtgcccatttcgcttgacctacccttttgggctgcccttctgcaaatatgtgagtaccatgctcaacattcacatgtacctgacgatcctaattctatggcgtgatcctcgcgcccggatcaagacaaagcggactttacagagtgctggcccccgaggttgccagagctggcatgtggaccctgttgattgtactcgcggcccccccgcgtgtttccgggtcgaggaggctgcattaaactcgacagagaggtggttcacccatgggagggagtcacgttgggataagtgggcctgccataggacgcgtgaatatccctggcgttcaagcctacatccgactttaatttgccaccg

SEQ ID NO: 566919 - DNA, 878 bp, Homo sapiens
gcgtacgaagatatcggtctacctctcttaaacttggacaatccggggcgccaacctcacaggaaacaatctgggtccccgaggaccttctccccagttgctgtccccccccgcggcaaccacccaattttgcggctcgactgttcagacaagcctttgccacgtattgttgtggtttacccgcccctctctcctcgccaagtttccgtcgttatcaccccccggcccctcctctgaaaaaattctgaacatggccgcccccttgtggtgccagggcccaccgggggaaacgcccgccccccagtttgtttttcctcttcaacggccccctccctttgacacaaaccctcggggttcttctcgcacatcattaccacgtccttcaccccacatgaaaggagcttgtggggaaacttattctcacaaatccccggcaagacacaaccggagcttctgtcttaaaaagccgaatcattcccccatcccccggagaggggcacgcggtcgacttcccccccctacttcaattttgtgaagaacgagactccccccggtaccaaagttgttcttaaagatataccgcggccccacaattattacttccaagaactatataaatcctgttagaacacaaacatttggccttgcatgaacctcagataatcaccccaaaactccatcaggaaagtgttcatattccccgtcattaatataaagacaacatctggcggtgacctttcgcatatctccctttagaacccttcttttctatgttcttacaccactaccccacccacctgccgaaaaaacttttatcacccctctgtttgttcaccacccccgcccgcagattaagcggaaccccccccaacaaaaca

SEQ ID NO: 566920 - DNA, 375 bp, Homo sapiens
atacctggttgccaccaggaccgtgtggagcagattggcggcatcgcacaggagctcaatgagctggctattatgactcacccagtgtctacgcccgttgacaaaagatctgtgaccagtgggacaaactgggggccctaactcagaaacgaagggaagctctggagcggaccgaggaactgctggagaccattgaacagctgtacttggagtatgccaagcgggatagaaccttcaaaaaatggatggagggggccataggaggaactgcagaaaaccttcattgtgcacaacatagaaagagatccagggactgagcacaggccatgagcagttcaagggcaccctccctgatagccaacaagagagcctggg

SEQ ID NO: 566921 - DNA, 305 bp, Homo sapiens
caatttgacttgaccaaccagattcaatttgacttgaccaaccagattcaatttgacatggccaaccagattcaatttgacttgaccaaccagattcaatttgacttgaccaaccagattcaatttgacttgaccaaccagattcaatttgacttgaccaaccagattcaatttgtcttgaccaaccagattcaatttgacatggccaaccagattcaatttgacttggcctacaaaaacaataacaatgtctaacacaagcagccttcctttggttgtttgatcttgtaattaggacatatggt

SEQ ID NO: 566922 - DNA, 321 bp, Homo sapiens
caggattactacctaaatggctgtcttgctgtattaatacgtgggtaaatctctgtttggggctctcagctctgaaggctgtgagacccctgatttcccacttcacacctctatatttgtgtgtgtgtctttaattcctctggcaccactaggttagggtctctctgaccaagctggtctcagcaacaggcatgcaccaccatgcctagctactgtttttgttttttaggagatgtgatcttgatatgttgcccaggctggtcttgaactcctggcctcaagcgatcctccctcatcactgggattacagccatttaggta

SEQ ID NO: 566923 - DNA, 164 bp, Homo sapiens
cggtctactggtatcccaccctgaactacagtgtacctattctggctgaccacatggcagtacctgtacttgcttgcccccccacaagctgagagagggactgcacccttttctgggctaatgtagcctccaccacatagggattaagagctagactaccaggg

SEQ ID NO: 566924 - DNA, 828 bp, Homo sapiens
  misc_feature (52)..(52): n is a, c, g, or t
  misc_feature (55)..(55): n is a, c, g, or t
  misc_feature (76)..(76): n is a, c, g, or t
  misc_feature (562)..(562): n is a, c, g, or t
  misc_feature (568)..(568): n is a, c, g, or t
  misc_feature (578)..(578): n is a, c, g, or t
  misc_feature (590)..(590): n is a, c, g, or t
  misc_feature (617)..(617): n is a, c, g, or t
acaccccctcatcccacaacacaacacattataaaaaccacacacccacccnctntactggcaggtttctatcaanatatctttaagcccactgattctttccttggccatgtctgatttacaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggtaggacttttgttttctaattgcctaatgtcactcaatctccaaagttttaaatccaaacttttagatttataacttatggacttaaaaatccattcctattagactagtcactttctagtcctttgagataaagtgatgaacaatatgaatatggcttttgctcttatcatatgtatagtctaatgcaacaagaagttattgagaaacgttaacactgaagagtaatatgaaaggaagattgcaggatgctaagtcaacctatacgagagaggtatntatganacaaaaaganatcctttctganaaatattattatatgaaaccttctgtnggccagaataaatagaaatcgggtgggactattctaagcaaagtgagaaaatgagaacattcccagggaagtgtggagcacaggatgttcaagggactgcaaaaaggatgatctcttggtcatcccaataccaactcaattattgatgaaatggcccggaaagagatatacggcaccatatgaaacagtttgttcttatcaaaacaaaata

SEQ ID NO: 566925 - DNA, 222 bp, Homo sapiens
  misc_feature (52)..(52): n is a, c, g, or t
  misc_feature (55)..(55): n is a, c, g, or t
  misc_feature (76)..(76): n is a, c, g, or t
acaccccctcatcccacaacacaacacattataaaaaccacacacccacccnctntactggcaggtttctatcaanatatctttaagcccactgattctttccttggccatgtctgatttacaggtgatagggaatgaagatcttcaccggaattggcctcttgatcttggactttccagcctccagaactgcaagccaaataaacatattgtgtataaatc

SEQ ID NO: 566926 - DNA, 254 bp, Homo sapiens
ggatttttaaagcactcggagtattccctgataaaagtagttgttgttattttcttcctcttttatgagacagggtcttgttctgtcaaccaggctagaatgaaatggcttgatcatgactcgctgaagcctcaacctcccgggcacaactgatcctaccatctcagcctcccttttgactgggactagaggtgcacaacaccacagctggctaattttgaaattctttatagaggcaggttttggccatattg

SEQ ID NO: 566927 - DNA, 541 bp, Homo sapiens
  misc_feature (309)..(309): n is a, c, g, or t
agtaaaggcatccaagatagaatgggatacggaccaatggaagactgagaactacattaatgagagcacagaagcccagagtgaacagaaagagaagtcgcttgagttcacaaaagaacttccaggatatggctataccaaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccatagnaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgcaa

SEQ ID NO: 566928 - DNA, 229 bp, Homo sapiens
  misc_feature (15)..(16): n is a, c, g, or t
  misc_feature (22)..(22): n is a, c, g, or t
  misc_feature (30)..(30): n is a, c, g, or t
  misc_feature (83)..(83): n is a, c, g, or t
aaaaaaaaaaaagannaaaggnagagaganaaagggaaaggttaaagaagataaaaatctataactggcaggtttctatcaanatatctttaagcccactgattctttccttggccatgtctgatttacaggtgatagggaatgaagatcttcaccggaattggcctcttgatcttggactttccagcctccagaactgcaagccaaataaacatattgtgtataaatc

SEQ ID NO: 566929 - DNA, 1001 bp, Homo sapiens
tgcaggtgagagcctccggaagggaggcggctcttgccccgaccctgctcctgcgatcgcccactcgggctgcccgtgcctgtggcctggcagggaagggccgcctgcctgccgcctgcgcgtttgcgagtgcctggctgtgggccgccggttgcccaggaatggcgtagtgggccccccctagactccgagacgtgcctgatgcgggtcgccggcatgtgggacgtgcggctgtgcccttcctttcctccctcccagggttcgcgcccgagctctgcatagccacaccgtccgacaaacttccggactcccagtggacagcccttgccatcaaggaagacagcacaggactgggacccaaccatgaacccttctcagtgacaagcccaaaaaagcaccagtggggattgtactccttaagccctgcataagggcctggtgcacggcacatcctgtcctccaagtaagagccatggttgttaaattgcaggatcaatggagcaaggctctcaagacaagatgagccttggtactaggaggaggcgaaggaatgagtggcacaagagatcccctttaagacattgcttccagaagactgccactgacatgctcaatcattacctgccatgggtatgagcccaattggaacacagacaagactacccagaccatctaagcacagactataagaagaatttataaaaataccaagtttaggctccaaccctgaaccatagtatagtgatcccggtaccaaaagcctaatgaaagtcaagattattagaacaacaatttgcgcatcacttcgaattaacatggaggaagcactcatctggtagcaatactcgcttttatagatatatcaaagactgaaagtgtagatacatcgaactcggtataagaatctaccattacaaaggacgccatcgagtaacaccacagggggtacataggggcccaaactccatgcggcactgatttctaacccattaggcacccat

SEQ ID NO: 566930 - DNA, 119 bp, Homo sapiens
acacagctaggataccacattacgtggcaccatcatcaaagatcactcatttatcagatgccacatacacacagcacacacacagcacacacacagcacacacccacacaccacacaca

SEQ ID NO: 566931 - DNA, 195 bp, Homo sapiens
agttggagctgatactgatcgctccactactccagcctgggcaacaagcagcaaagtccatctcacaaaaaaaaaataaaaacagccattaagggttggtccaccttcttggccaggggaaatacgggaaacaaaattaataaaacggacaatgggggcccaccttttttgaaccccctgggccttttattcggc

SEQ ID NO: 566932 - DNA, 995 bp, Homo sapiens
  misc_feature (14)..(14): n is a, c, g, or t
  misc_feature (51)..(51): n is a, c, g, or t
  misc_feature (75)..(75): n is a, c, g, or t
  misc_feature (302)..(302): n is a, c, g, or t
  misc_feature (873)..(873): n is a, c, g, or t
  misc_feature (898)..(898): n is a, c, g, or t
aaaaagaaaaaagnaaaaaagagaaaaaaaaaaatttgacaaaacaacccncctgtcctgcaggtttctatcaanatatctttaagcccactgattctttccttggccatgtctgatttacaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggagtggcctgtaagtggttncataagaggagaaagatacctgaattcactgtataagtcctctcaccatgtgatgcactgtaccacctgaggactctgcaaaaagttcccacaacccagaagaatcttaccaaatgtggtctatcaacttcacagttctcaccctatataactgtttacagatggagactctgaactttaacttttgacttgtgactgaaacgcgttaagattttagggcaatgaaaattagatgaatatgaaaagcacattagttttgagggactattgtgcaaattgtattgctttaaatattagagcattccaaaatgcatgtttaaaattaattcctccattatggcacgttttgaaaggtgaagtattaaataaattagccgacgccttcgttttctcaagatgtagagctatgcggtcagtctcttttattggaggttaattgaacattcttcgataacttactaggtggtctaggtcagaccgactaagtaacgagtaatagttcactcatgagtgcaatacgctatacactgtaattgcggaacacctggagaaaacttggatcaatatttcntattagttcataactatgtatattnatattgtgggaatttaacaagtacaaccacttataaaatccataattacccaagttaaagtgtcgaacactaaacattgtaacgagagtctccctcg

SEQ ID NO: 566933 - DNA, 1038 bp, Homo sapiens
  misc_feature (52)..(52): n is a, c, g, or t
  misc_feature (55)..(55): n is a, c, g, or t
  misc_feature (76)..(76): n is a, c, g, or t
  misc_feature (772)..(772): n is a, c, g, or t
  misc_feature (778)..(778): n is a, c, g, or t
  misc_feature (788)..(788): n is a, c, g, or t
  misc_feature (800)..(800): n is a, c, g, or t
  misc_feature (827)..(827): n is a, c, g, or t
acaccccctcatcccacaacacaacacattataaaaaccacacacccacccnctntactggcaggtttctatcaanatatctttaagcccactgattctttccttggccatgtctgatttacagcttgttcaattgtggttcacctttattatcctggagctctgttgttgtagtgctgtataatttgacatgccttcagctggggaagaggagccaccttattataactaggtgacgatagcaactcagactctccaatgggtttccattgagaccaaaggggatgatgccttgttaccttagacagtgatgggagttcctgttccccaccaggtgatagggaatgaagatcttcaccggaattggcctcttgatcttggactttccagcctccagaactgcaagccaaataaacatattgtgtataaatcatccaatctgtggtattctgttataacagcaaaaagtgaactgagacagtttattctttaggtaggacttttgttttctaattgcctaatgtcactcaatctccaaagttttaaatccaaacttttagatttataacttatggacttaaaaatccattcctattagactagtcactttctagtcctttgagataaagtgatgaacaatatgaatatggcttttgctcttatcatatgtatagtctaatgcaacaagaagttattgagaaacgttaacactgaagagtaatatgaaaggaagattgcaggatgctaagtcaacctatacgagagaggtatntatganacaaaaaganatcctttctganaaatattattatatgaaaccttctgtnggccagaataaatagaaatcgggtgggactattctaagcaaagtgagaaaatgagaacattcccagggaagtgtggagcacaggatgttcaagggactgcaaaaaggatgatctcttggtcatcccaataccaactcaattattgatgaaatggcccggaaagagatatacggcaccatatgaaacagtttgttcttatcaaaacaaaata

SEQ ID NO: 566934 - DNA, 331 bp, Homo sapiens
tagcggatctgcaggtgattgagctcgagaactacgatcagcacgactacctggtgttggctacccgcggcggtttggtcaagaagactcgtctcgacctgtacgacacgaaccgtcaggcgggcattatcgcgatcaagctgcgtgaaggtgacgagctggtatcggccatggcggtcagcgagggcgatcacatcttcctgttctcgcacgccgatcaatcgctgcggttcgttgccgatgacgagcagctgcgaccgatgggtcgcggtacctcgggtgtgaagggtatgtccttccgcgacggcgactacctgattaatgcggcggc

SEQ ID NO: 566935 - DNA, 683 bp, Homo sapiens
gggggggcattgctgaagctggcaggatgccggcccagaagtttacatccgtgggcttaggtgggctcgctctacggtctttttttggcctggacgctattcagtgtactgccaagatgcaagtttacttacgtcaaacagtcaagaatggtaaggtaaatcagctgaaaaggtaagggtctgggttccaaacatccgacattgaaggtgacatactgacgaaagtggagaggactgactgaatggtgcattcagacttgtctttgagcaaggactggactttctatttattgtgctacgctgaatttatccccagtgctaaagatgagtctgcctgactggtgaaccatgggacttttgcacagtccaccatgggacagtgggatcgagccatgtaagcaacttgaatgcagtaatgagatgccgcatttggattggatgaatatccaaatttggatgggtggaattcatattgatgtggtttgacacttacacttgatgcgcataatgaatggctcttaatgcgcaacatgggcgttatcttcattgttatattgccatgaatgctgttatcatgttagatggattggagccggtaggtcacaaggagcttttaggagggctggcaacttagatgtagggagcatggaattctttagtcgaccacattgtcttgcaccttt

SEQ ID NO: 566936 - DNA, 1645 bp, Homo sapiens
  misc_feature (1247)..(1247): n is a, c, g, or t
gatccaattcttaacagcaaggatacaagaggtagaatccacaagtcactgaggagttggacagccattcgatgtcgctgggatgagggacacgagaaaactagggtggggtcgaattacagcggatggtcgccatggaaggcttggcaggcacaactacgcagcagggattctcggagacggctccaattgcgcacacgtacgtcgcgtcattatgccgagcacacgccgcatcgcgtcacactaagagccatgtgagcttccgtcttctggcgcgagggaagccttgtgtccgtagggccttcacgggtgggcgtaggaacgatcgtcgcgaggtgcacgtgacgcctcgatttcacgcatcgcggcacgtgctaccaccgcgaacggtgaaaccccttcacgtgcgacgtcatcgcattttgcaccgcattcatccatagaattcgcggagataagggacgtgctctcacgaatatggtcccaagggtactagcgtggagaaagacatggggtggacgcacccctgtggctcggagtagcaaaggttccacgttggttcccgtgccacaagcggaaggctcccgttgttcagagagcactccaaaggcggtggacggagggggcaaggaacggaacacggggtccacggaagggcctgggcggcctagtggaaaggacctttgtggcgggggggtgaccttgttcgcctggccaggtgaggcggactctgtcggaaattgcgccaattggggatcacgggcctttgttaggaaaggccgcatgggcatttaagccggggttaagggaaaccggtgtactttaagaaacgagcaccaaccgaaggaaaaagtcctagacggaaggaaggggcgcctttttcgtgcgttccttcgaccaaagaaggtaggcgcgtcggaatttctggtggtaagatacacgaggtctggacccccaggtccacggaaggggattcggttgccggtatgtaagcaacccatcagcctggcaagaggcgtgttcctttcgcgttagactggttggagacgataaggggtcccggtggtagaggcgcggagcagggaatgggtgtaagggctctgtggagaaaggccgtggcggctctgacaaggagaaaaccggccatcttcccacggaaaggagagcgcacggacacgtatggttcgcggtggcccacgaggatagtgcatggtgtcacaacgaccgtgtgtggaacccgcctttangttagacccgcgtggacaacgcgtcatactaataatggaaagccggacaactgccaactcactcgggagcgggcaagggctccacgaagtgatccgaaagcgctgcaacacatgtctggagcagccaaggggtgtctccacacgtagtcgcctcatgggggtgcggccgcaactgccaagtgtcctgcgggcgactttaacggccccccgggattggaaggaagtcggcacgaaagtctcgcgaaggggcattgtgaacccagctgagaggcccaagcaggaccaaaattgcacgtgggcgacagagggaatcccacaggggggccgagataagagggaaaaccacgccggtgagagagaacgagctaacggagagcttcgggaggggggggaccacc

SEQ ID NO: 566937 - DNA, 771 bp, Homo sapiens
ggtggtaatacgaggaaatagtatcatcatgtgagaagccttggaagcgagctatagaataagtggctgtgcaggagagaaaccccatgtcctctctccatagggcctgtactagtatgatgtaaaaattgaggtcatgtacattgtcatattgagactgtatgtctaaataaactttgtaatagtcaaaaatgctttctcagatgtgctgaatatagaatatcagctctcattccagtttttttctaacgatgaattttcctggttgacattgatttcaaagggttttatgcattaaagtgaaagaatcttattaaatgtgaaaaaaaaaaaaaaaaagaaaaaagaaaaaataaaaaagaagaaatgaagaaaagaaaaggaaaaaaacaaagaggcaacacaacacgaaagatccacaggagataagcacctcgcaacgacgaaacagagaaaacgagcagggggcgaactgaggaagtcaagaatgcatcatgcgggaaacaacaggggattcaagacacccctgacaccgcaatgtagtagaaagcatggtgacaagcaaatcaagaaatgagaactaaaaagaagaggcgacacggaaggcacacaaacaggataacgacaaagccgagaacaaacaaagcacaacgcgaagggacatgaagagacaggagaccaacatagaacgtgagggggagcaaaggaaggaacaaaacaccgaagatgacaaacacagaagcaaacgaacaagcaagagaaacaaaaaag

SEQ ID NO: 566938 - DNA, 920 bp, Homo sapiens
  misc_feature (539)..(539): n is a, c, g, or t
acggtgtcctgtgatataagtgtgtgtttcacataagagcaggccagaactcatctaggctaaattacagcttcctaggtcataattcacatctgtattcagcagttgcatggttgtacatatacacgtgcattcgctggttttgagtcgcgaactttgtctacaagggactgcaggaaatctataacacttttttcttacctggtctttctctatcgtaacaggtaagagaagcgaagagcaaattgatcgtgccaccagttttatgcagtacttgattcttcatgcttgcactcagaattacacacattgctaactctcttaacttttacattgtccgtaaatatacttttaatgaacgaaagacaattttgctctcgtgatcagcgttttcctcctattaatgttaagctacagggacatctcactttttcttcctgcaattctattgtgtcgtcctcgagtgaagcctatgattgcatcctaggaagagtacataaccttggtaattcatggtgatgctttctaaggatgcgagnaatatctagtaaagacgtaataagttctccaggagcacctctggtacattgtgctgaacacttttgctataagcgctactagacacaggcctgtttctactgagacaagtgcacagctatggcctgtcggtattcaacatccagtgctgctgcgctgcttttcagtgggccttgtgagctaaggacatcgtgtgtataaacttccaacctgtcattggcactactaggaccttcttacctgaataacttggatccctttgacgtcgacttgttagcagcgctcctctcatagaagttttggctgaaaacactaccaataatacacagaagtagagccaacaaaaccattgtcatggggcccgcttccgccaaatgtggaga

SEQ ID NO: 566939 - DNA, 297 bp, Homo sapiens
gagtaggagcaagagagagagtggggaggtgctatacatttaaacaaccagatctcacaagaactcactaccataagaacagcatccagggggaaatccccaggactcaatcacctcccaccaggccccacttccaacattggggattttcattcgacatgagatttgggaagggacacaaatccatatcacagactgtataaagaacccctccagtccaggcgtggtgctcatgcctgtaatcccagggctctgtgaggccaaggtgggaagagtgcttgaggccaggagtttgag

SEQ ID NO: 566940 - DNA, 322 bp, Homo sapiens
tctcacgatcccggcacgatctttgccaaaatttcacaccccagttatagcaggctgggtgtgaagactagagggcagtcaggagcggcggcatactcggcatgtggcagcccatccctgtcactaccacacttctgctgcagaacttatgttctacgaattctacattaaacctggccttccaggttgttcgatggttgcgagattgcgtgtcgcttattaccaatgtgttagcctttgtttctattttccagcatttagatatatagggtaagctctcttcgtctacacttgtcctcccagccttgctacgaatcgtgcc

SEQ ID NO: 566941 - DNA, 397 bp, Homo sapiens
cacacacctgggagaagagcttggggcagtgaatggctgaggcttcttggggagctgggccatcttcttcggttttacttccaattatgtgatcgactttagagtaagtgctacatggcaccaagaaaaatgtatattctgttgtttttggatggagtgctctgtagatatgtgtcaggtccacttggtccagagctgaattcaagtcctgaatatccttgttagttttctgtcttgacaatctgtctaatattgacagtggggtgttaaagtcttccactattattgtgtgggggtctaagtctctttgtagatctctaagaacttctttttatgaatctgagtgctcctgtattcggtgcatatatatttagggtagttagatctcctcgttgaa

SEQ ID NO: 566942 - DNA, 944 bp, Homo sapiens
  misc_feature (702)..(702): n is a, c, g, or t
gggagtagaaggaccgccgctccggcctcccgcgacttctcgaaggtgggcaggtcccaccttgtggaggatggaggtgaccggggacgccggggtaccagaatctggcgagatccggagctctaaagccgtgtctgctgcgccgcgacttacagccgcgaacgagcacggcgtggcctcgcctcctgcctcgtaagacctgaggagcaaggcctgtgacattctggccattgataagtccctgacaccagtcaccctggtcctggcagaggatggcaccatagtgggatgatgacgattactttctgtgtctaccttccaatactaagttggtggcattggctagtaaatgagaaatgggcatacaacaattcagatggaggtacagctgggggatttcccaagagtccttgatgtggatggaagacggacgtgcggggcagggtttgcaggtggaagactgtggcgcaggcagttgaaagaagatctgtccaggatcatcctcctatcagaggaggaacctccagatgcttgtagacgctccctggctcagacctggctcagggaagctacgtcagagttgggccaccgtccagcgggtgcgcaaacctccagaggtgctgacaaggagaggaagtgcggtcggcccagcagtcctgcaacgggacctccagtgttgggagaaacgatgggcgcctacgntaacgccggatagtcaagtgccctggcgagagggggatacgaaaaccggatcacacagagaccaggacatgcaggaacgcatcatacggaggggggacagggcccacgcaatactatacgatgagaaggacaaaaccacacagggcggaacacataaaagaagggaggagcggcaccacgcaaacaagagtagaaaaaaacacaaaacaacacaatgagagaggacacaaccacgacaacga

SEQ ID NO: 566943 - DNA, 2687 bp, Homo sapiens
ttgtgtgacaactgagggcaaagaagggaaaacagaagcaaagaaaactgtttcaaaagccttggaattgctactgttaaaaggctgcggttcatttctgatttcctcatcttttgctacaaaggaaaaagaaatccaatgatgtgtctacctttggtgagaagaaaacacgagcaacagcagtgtagtttcgaaagtcattgtgcagagagggcaggagtgaattaaggccccggggaccgcggacgcctggccaggagaccgcctgaaatatgagccgaacctgttttgcagaaactgcaggctgttcagaatccaattctctggatattggcatgctacattcaatgtccagctacattaagtgtccatctatcaaaatactagatttcatggctggagcaggaaaagttatgagcttggaatatcttcagtgcctgaaagtgaggaagtgctcccaaaaatatgaaggcctgtcaaaagggagagaacaagaaggaggaggagctagaaaaagaaaaagcagtgggaactgtcatgggtgaatcccagaatgggcatcccagatgacatctgtctccattcctgccatctcttcctggctgccagccacttagcctccaggtgtttgtgtctaaggccaactctctttccagactagaagaaagtgaggcagctcaccttttcatttaggtttactttggaaagttctgtggttgaatatcaacatagtgactgatttgtggctgtaaagctgtagcagctcaggtagcacatgtaagagtgagactggatggagagactggatgaattatgccatcttaccaaggcattgattagttgattaaggcttgtttgagcaaaaaagtgagttatatcagatatagttatatcagatacactgatactcaaatcccaccagagaactcagcaggccaccgataacccattcacttttcttctcccgtgactttactcatcttattattaaacaaggaatgtcttggtccaccactgaaccaagtttaagagtcaactcaaatgccacttacttcttgaagcccctcatgatactgtcaaggataatggaaatatatgatttctccctttcatctatataaattacttccccatatatacattaacatgtcgtcaggaaacttaacagaaatatggtaactcttattaagtttcctttaagcatttttttctatacttgtgccttagaaaaattggaagaactagaaatggaaatattgcagagtgagaaacttatgggatgttcgttagagagagtatcatgaaggaaaacatgagattaaagacactgcaactatctgagaggcctgtgtaaaattgtgtaagcaaaataaggagtctaatattgaaatatgcaaataattttacttttaggaacttagactcctttgtagagcattaaattttatgctatattaagtagaggtaatgctgttttgtacataaaaactatctttggattatttacctttccttttctttccgaaattgttgtcttttcaactccgtctttagggacagacaaatgatcagctgagtggtataattaatagaagcaccagttttagaagctctacttctggaagtagaataaaaaggaggtgtaacccagagtttaagatatccactgataatgagagtatttgagtgatggtaaatggcaaggagaaagacttaaagatctatctagagacaaacccttatactctaggcatgctgccagataaagactaaaaacagcgtgtaagatggcaagggaaatgtgctgtttggtttcttcattgccataaaagccactgagaagggcttaaagagatatgccattcctaaatggtaacattagacttcttgttctatgacttgagtgaaaaattttgccattaggaaatggggacaaggaatgtcatcttcaacacagggtagctttttggtctatctactcgtggtcaacaaaaggtacagtaagtaaggtcacagaatggtcaccccactttggttcaatcctgttcttggacagatcagtaactcaacgacgctttgtttttcttttgtgaagcctcttcagccttgatcataatgatttcattagcagtgtgtgcttgatttttgcacacccacacaatgttttgtattacccaacaaacttacagaatgtagccacagcttcttgctccaggaaatgtctatcaatttaattattaaaactagtttaatgtttggtgccctgtgagcaggatctttaagatgaaatgagccaatccacattccattatttcactgacatttaacataatccttgcagctatcaagctatgcctcccaaatctaagacaatgagtaaatgttattagttgaatcagtgactaaatcagctaaaatggttgcttgactaaatgaacgagttacttgatacatcgtgaacacattgaaggaaattggaagaaatggaattctggctcctgggtccctaaaaattgctgagtgtgtttccttttttgtaaaataggtatattaatattttgcctagatgtgttacagtaaagattaaaaataagtcaagtaaaatatctagcatatagcagagaataaatggttgctgtaacttattatgattatttattaaaagttcaagttgctttgaagaaatt

SEQ ID NO: 566944 - DNA, 786 bp, Homo sapiens
gaggcattgaggtagccagcgcacgtgctactggtgatgggtcgcaggcggagcttgaggaaaccgcacataagtcttttctctttgaaagatagacggattaatacaactacttaaatatacatatagtcatagtaggttactaagatatagctctagcgtcaagttttgaaggtagataataaatagcttaagattgtaagagaaccactatgaagacttagaagagtagcatgagggacaggaaaatgataaagggtttctaaaacatgacggaggttgagatgaagctgctccaatggaggtacaaaaagtgtccttgtaggaacgaaaattgacgagaagggagtacagagccccggaattaagtaccaatagcatgggcaagtgcttttagattcacaagtgacaggtagacttagacagcttaaagtttagtttcacacgtgtgtatggtgctccaagtaattcgaaggcgatcgttttaaaaagagattaaaccgaaggtgattaaacaagaccttgaaatccatgacgcagggagaattcgcgtcattaaatagcctaggtaagcatgtactaattcgcagacggaaaatggaaagattaattgggagtgaaggatgaagcaagttgcagaagatagaagtatgaacgtggaaaagtggaaaaccggacgtaccggaagggacaagggatccgagagatggggaatagaagataaagccatcttgtgaagaaaaagataattaactgaaagtagagcgaataaaagacagtgtgaac

SEQ ID NO: 566945 - DNA, 502 bp, Homo sapiens
tccttttgagaagagagagatgacctatggagttgaatttattagtgcaagacagtacctaacaaacccacaggtcctaaactaccaaagccgtgcgttaaaaatttcggctggggcgacctcggagctagaacccaacctccgagcagtacatgctaagacttcaccgagtcaaagcgaactactatactcaattgatccagtaactggaccaacggaacaagttaccctagggataacagcgcaatcctattctagagtccatatcaacaatagggtttacgacctcgatgtaggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcgtctcttctcttg

SEQ ID NO: 566946 - DNA, 509 bp, Homo sapiens
taaggacgtcttgggagatcttttcaacccctttttttttttgaaaagaggggtcctgcaggggaagcagagttagcacccgccttttggggctaaccctcaaatgacatagtttttttcagctgcctggggccccccacaagtaaactctgtgcgggcggaaagaggtgccccgtgggctcaaaagcctaagtgggtggttttcaagaataaggaaccctatccctcatgcccgttttgggggtcctcaccaacaagggtggtggggggcccctggtttgtccctgagcctttttcacagggaaaaaacagttttttttgtttttgttttgttttgttttgtttttaaaacaatcatgttacactaataaaaacttggccctcttgggccctttgcctgggcaagcaaataacaaatttaattgttttaaggaaggggggggccgggaacaatggggccttcagctggagctgggggtttttggacataccctaaaattttgaagtta

SEQ ID NO: 566947 - DNA, 164 bp, Homo sapiens
  misc_feature (1)..(1): n is a, c, g, or t
ncgatgcttaactgggttcgagttccacacgacgagatcattatggcagttagtacagatacacgggtgcagacacctcctggtggatcgtcctctgtcagcgcaaacacagtcagcatgtcagccaagttggccaagcgcagagccattatccttccccagag

SEQ ID NO: 566948 - DNA, 421 bp, Homo sapiens
tgggatgatgctctgtcagctaactgtctttggatctgtgccagataccccagagcagagcatacggagcacctatggttggaaccccattctgtgatgcaccagtaggctgtgacacgaagaggcctactggcccaaggtttgacatccggtccctgggcatcatggccatcgaaatgattgaaggggagcctccatacctcaatgaaaaccctctgagagccttgtacctcattgccaccaatgggaccccagaacttcagtaacccagagaagctgtcagtctatcttccgggactttctgaaccgctgtctcgagatggatgtggagaagagaggttcagctaaagagctgctacagcatcaattcctgaagattgccaagcccctctccagcctcactccactgattgctgcagct

SEQ ID NO: 566949 - DNA, 395 bp, Homo sapiens
  misc_feature (138)..(138): n is a, c, g, or t
gaattcggcacgaggagtccacgccggatgagctgccgtcggacgcagaggagcagctgcgcagcggcgaccagcagctggagctgagcgggcggcggttgcggcggctgcccagcgcagtgtgcgcgctgagccgcntgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccg

SEQ ID NO: 566950 - DNA, 1028 bp, Homo sapiens
gacgccggtgcagcgggggggcccgggggccctggtggcccgtgggatggggaaccgcggtggcttccgcggagggtttcggcaggtggcattccggggcctggggtcgcggccgtggacggggccggggccgaggccgcggagctcgcgggcaggcaaggccgaggatacggagtgtatgcccgtctagcaagttgggccgctttggtcacagggattattgaagatcaagtccctggaggagatctatcgtcttctcgcctggcccaattagaggaaatcgagagactcatttgattttccttcctgggggggcctctctcaaggatgaggtctggaagattatgccagtgcagaagcagacccgtgccggccagcgcaccaggttcaaggcatgtgtagctaatcggggactacaatgggccacgtcgggtctgggtgtaaagtgctccaaggagtgttggccaccggcatccgttggggccatcatcctggccaagctctcccatcgtccccgtgcgcaaaggctactgggggaaccaagatcggcaaagccccagagtggttcccttgcaagggtgacagggccgttgagggatctgtgcttggtacgcctcatccctgtacccaggggcacttggaattcgtcatcgcaccttgtggctaagaagctgttcaatgatgggtggtatcgaatgagtgtacactcagccggggctgaatggccaacctgggaattcgccaagggccactttgatgccttctaaaactaaggtactggacccgacttctggcaggacatggttcccaattcctataggagtactgaacacctgtaaaacccacaaattcggaaggaccagcccagttggtaacaagggtttaacgaaaacagatacggggaaaaaagaaaaaaaaaaaggggggaaacacggggaagaacctttaaaggcaggatacacagtatggaagcaattagctgtgacatattgtttttttttttttttttcttttcttttagaaaaaca

SEQ ID NO: 566951 - DNA, 149 bp, Homo sapiens
tgaaacggatctcgtctgtcgcccatgctggatgcatggtgctatcttggttcatgaactccttctcccaggttcaaccattctcctgcctcacctcccaagcatggactaggtgcccgccaccatgcccggtaattttttcctttcaa

SEQ ID NO: 566952 - DNA, 345 bp, Homo sapiens
taaaagtaaaaaaaaatagctgtgcgtggcggtgcacacctgtaatcccaggctacttgggaggctgaggcaggagaatcacttgaacctaggaggcggaggttgcagtgagccgagatcatgccattgcactccagcctgggcgacagagcgagactccatctcaaaaaaaaaaaaaaaaaacttccgttttttttttccgggttatcacattttcctttatgggaaaccccgggaggggaaccaggggtattgggtattgtgtttcctctctctgggtggggtcccacacattaggggggggcccaaactataaacactgaccaaacagggggggtcccaaaa

SEQ ID NO: 566953 - DNA, 128 bp, Homo sapiens
ttgtatcatagctcagaccatacctatttatccaattgttctttttttccggagtagtaagttacaattatgggagattattccgaagcctggtaggataagaatataaactggtccgagcgggagat

SEQ ID NO: 566954 - DNA, 718 bp, Homo sapiens
tggccattcatcgagcatttattggtggagtaccaaacccgggacaggagtttgaactaggaggggctctcagttaatcttcatcacaagtttacagaagtccaaacgcccatttcacagggtgatggaaatgatgcatagaagaaagaagacagaaaacacagggaatagggggatgggggacatgtgggaatatgtaacagcttagtctgggcaatgtgtgttagtggggtgtagccctgggatctggggaacatgcctccctccttttggtgccttggacttttctacattctgagatgttatagaagacagatgctggagatctataatgagaccttctggatgtatctatatcccaggttctcttctttacatcttctacaaaatgtaaatggcatgagataccccatggagaatgtccccctccacatctgtggaggagaggtgatgtggtccaaaaaactatttcctggtgtggggacccaacaaagtattctatctactggggggagaaagcaaaactcgttgggggactttccaacatatctccccctgtgtggtgctttgtccacagagatctattcaccacaacacaaacatttgtggctaatgcacccaagaattttttaaaagaacaggggggctccctgtggggagacttgtgcaacaaaaaaggcacccaaatttgaccgaaaatatctcacgccttgcattt

SEQ ID NO: 566955 - DNA, 193 bp, Homo sapiens
tttcccggggtttttttcccccccgggcccccccccggggcccccccggggggggggttttttcccccaaaaccttttttttggggggaaacgggggccaagggggggggcccccggccccccttttttttttttggggggaaaaatttatttttttttttggggttaagggggtaaaaatttccctttttta

SEQ ID NO: 566956 - DNA, 111 bp, Homo sapiens
tgtaagaggaagaacgaggtggcacggtgctgagacagagctggagatgaggcagaccatggacactacacccagcaatagagacggtgactgcggaggaagtgagtgacc

SEQ ID NO: 566957 - DNA, 2121 bp, Homo sapiens
  misc_feature (334)..(334): n is a, c, g, or t
gtgttgtgtgcgttcgtgttgttgctgtctcttcctttgcttgttgtttggttttggtgctttgttcttgctgtttgtcctttggctgtctgcggattgtctgcgtgcttccttatactctgtacttgtgcgtgtgagcctgcgtgttcgtctcttgttggtgatccttggcgtgtttctacgtgcgctgttcttattctacttactctttctcgatctgtcctcgtggtgtcttatggctggtctcgctgtgcttgtactggtctgcgtctttgcatggtcgatgtggtgttgactctgtggatgtctgcttctctactgcgtgtctgtatgntgcttgcttgctcttaggatcctgtagttctcttgtggagtgcgtcgttgttgttgtgtcttctgtgggttctttggtgttgtgtttttggtgttgtatttgtgctttatgtgtgtgttgttcgttctgttgtgttcgatcttcgtgatgtctctgtgttcttgttctggtgctctgtgtcctagtttgttgtttttgttgtgtttggttgtgcgttggttcttgtgttgtgtttgtgtctctgtttcatcgcattgtgtgtgtcggttctttgtgactgtttcttctgcgtgttgttagtgtagtttggttgcgtgttgtgtgtgtattattagttgtgttgttgttaggtgggtttgtgtgttgttggtgattgtttgttgttgttaggtattttgtgtattgttgtgttggtggatggtgtgtcgtgtctgttgtgttgttgttgtggtgtgtatttgtgtttttgttgtttgatgttgttgtaatagcaagtcaagtaggaggccgagggagagcgagcacgggagagagacggagctgtgggtaagtatctcactagaaggataattaagttgttgtggtctaccacgtatgatagagtggggctacatctacctctcgtcgctactgtgtgtagaatcaagctgctctctgtgttgacgcttctactagctgttgtgtgaagaacacatgagggcgcccccgccccctgtggggcacgacgaccccggtggggtgtcgcacacccaaggggggggggtccacacccctccctgtgcgttttaccacggcccagtcttcaatgtgtggtccctgcggaagctctgggtcgtgggaacccatggggtcacggttttcccccggctgtgccacatttgttgtctagccccgcgcttttgcccccccgctggacccacgccggggccagccccaccaggttgccgggcggccttgtgcgacgtggcctcggggttccaccccccgccggaatggttgttggaagccccacagggaccaattgatggcctggcccttgcgagccccccccctcattgggccccggttacccgtggaccggtgtgcccgcccgctggttcagggggccgccaatgtccactgaaaggaaggtggaattgaagcccaaatgctttataatggtccccccaaccacatataaccacggcacgctatatcttttgttggaagtgggagtcccgccaccacaatgtgagaaatcggctgtttctgtgaacactacccacacctcgcgggggcttaaaaatggtctccgccaccccttcacattggcgaaacaagcaccggccacttccacagagagctgtttcacaagcgcacatcttctcgaggcaccgattcaccggccacatgttctccggccgcacaaggccttctcatgcacactggtatcacccggcgcgaagggcacatggagccgaagagtggaagttcaaccgaaggcccgagaggccaacactgaatgagcctcggtggtcgcgaggtatccacagcacgtatccacaggagtgcccaccacagccgaaggaaggagggcgaggtttcgaaggaaggaaggctcgaaggaaggaaggtggcctaagagccctcacagtcacctgggggaaagcccgggaagccagtgtggactctttattcactccccgacctgtcctgtggcctgtccccctgtgtgcacttgctgttttccccgtccacatccctgctgtaccagaccaccccccattaagccttttcatagtggaaga

SEQ ID NO: 566958 - DNA, 1884 bp, Homo sapiens
atgtagcgtccaaccggttctctgtcaagacgaccccaagggaatccgaataatagggtcgggtccgtttgtcagggtgtagttcgatctgtgccactagtgcgtagtaagttcctggcactattcaatgatacatgagtgactatgtcagatgctaagaaaatgtaccattataacaaaaattgctcgacgtatgatcacataaagaacttgtctaagaactatgatttcgactaggcatagacgtcttgtcgcggtactggtcgcgtgggtcctggattcctaacgcaatagggccattgcgtggtatcaccaccggttcgttgagtacaccaaatgatcgatctatgcgcagatgctaggttgcaagcccggtttgtcgacgctccacttcgaaatgcaagtaacctgctccctaccatagatatgcacaagctgtggttgagacgtcgacgcagtacagcacattgcagcttcatgacattcagctgaaacttcacaatccttttagcccatcagttccaataatgggaccattggtggtcatcggcctactgtgttagcttcaaggaaccctttggtttctaacaacgccggtaaaattcgacaggcccctttcttgggccgaagagcaaaataggagtctccggcggcgacaactgacatgaccgcagatttttaacgttcaaaatgcccagtgcaaatactaacacctctatgcgtcatcctccaatgctcctctgggagcgctcgatcctgtgaaaatcttttcaccctcacgaatggccccccaattcgtcacgccaatgacccaaagggtccctggaatgttggcaactggcaatcctcctagtccaaaagttcgactcgctgatatagcactgattgcgacagacacataattggcccaagccgcttgtacaacgacgacaagctcaacgcaacgattcaggtatgcacggccacactcgaatgacgtcactcctgctaacccttcacgcgcacactgtgaaggacttccccttcactttcggggcacagcggcattacaagtaaattaccccgcagagcaacgtttaagtaggtacatctccccgtttgttctgaagcacttgtcggagacggcaagacccgcaagtgtatcacactcttaggacaacagtgggggcggtctctactgaccagtgttccataacagatccagcctcctgcacagggcaactaatgggtgccaatttccccctatggtgtgtgcctagagcggctgcaattacccaacgcgcgaaaactcaaaaggacgaggattcaggtataggccgttactgcgggagacgctcccaacaagccgccatttcggcggcttctgcatatgggccgcattcgccaccatcagacaggtggggcgcctccctataacgagcgccaccacagcaacgggtatctttctgggacaaattggtgtcaaccccctctatgaattcaccgaggtcggcattcgagttagagactgatgtgagaaccaaagaggacggcgcctcctctcaacattcggctcttggggacaccaaccgcgaactacctggctcgacccacctacattctactaaccacgccactacaatctctgcccatacggaccaaacacaagtttggtcagacctgtgagcaaccccatcctagaacaccagcctatcagccagaccaaatcatactagtgagcagccatcttggaccataccacaagctcgccacccagcagctcacgtatgccacccatccacctaacaaagcacaagcgtcagacatcaccaaactccacacgacactgccccaaggcctcccagagcaccggcgactcccagccgtcctacagtcaccgagcaa

SEQ ID NO: 566959 - DNA, 321 bp, Homo sapiens
tgtagttgatagaagtgtttaatgtgtacagttgaccctgtatctttttttattgacggagttttgctcttgttgcccaggttggagagcagtggtgtgatctgggctcactgcaacctttgcctctcggattcaagcgattcttctgcctcagcctctggagtagcttggattacaagcgtgcaccaccatgcccagcaaattgttttgtattattagtagagatggggttttaccatgttggccaggctggtctcaagcttctgacctcaggtgatccacccgccttggcctcccaaagtgctgggattacaggcgtga

SEQ ID NO: 566960 - DNA, 172 bp, Homo sapiens
  misc_feature (67)..(67): n is a, c, g, or t
  misc_feature (121)..(121): n is a, c, g, or t
cacagccacgcctaagaggtagtgagttacactgcccctccttaagcatgggatatctatgtaaatnatttggaattctcctggatgggacatttgtctcttttggatttactaattattncaatcatgtttggccatatggagtcatgaatacttattttatacttggtgt

SEQ ID NO: 566961 - DNA, 702 bp, Homo sapiens
gcgttgacatgccggagatcccgcctccgggatgtcgtgtcctgctgcagccaggactcgactcactgtgcagaaaatcttctcaatggcagacacttaccgaaagatggcgggcagccgcatggcgaggctgacgaatgaccattcgtctgtggtccatacacgtttggacgacatggacggatcatgatacacagtagttggacattgcgtgaatagatgcgctcaagttttcgtggacggtgctgcgtgggcagttcatgctggatggctgctggtgtgagcaaagaccttagtgcagtgtcctttctggtgtcagctcatttgcttattcatggtcgccctaatccttgaggacgtcgcggcaagattggttctcaagacaccacaagaccagtcgtttacgacagttggttcttggtggacctttgaaccaaaggcttggattccctggcgtcagacccgtcccgaaaggaaacgtcgactagggtgatcccggggttcaaagacagttggtttttgggcaagcactaagatcacgtacctaggactaaaggtggagcatcgcgcacgcattttggcggcttctgaacgttgtaatcgtaaccgtgcttttcaaggtaggcaccgcccaaggacaagagcattgacgggccaggatgtggcccctggttccccagaagggttgaacagttgaaccac

SEQ ID NO: 566962 - DNA, 251 bp, Homo sapiens
ttttgggggggggggggttttccccttttttccgggggggggggggcaaaaaccctcccccctgaagggggtttcccaaatagggggggggtttttttcccaggatttttgttggttccaacccccccccattttcccccccattttaaccccggggggggggccaaccccccccccggtttcccctttttttccggggatttgggggtttttcaatggttttttttttttaacccgcaaatttcccccca

SEQ ID NO: 566963 - DNA, 338 bp, Homo sapiens
tccggcggggctttaaatccaatcttggcggggttcaaacattttcctgcctcagcctcctgagtacctgggattacaggcacctgccaccatacccagctaattttgtattttgagacagggttttcatcacgttggccaggctggtctcaaactcctgacctcaaataagctgcccgcctcggcctcccaaagtgctgggattacaggcatgagccaccgtgtcaggccagcatgcagcctttttttttttttttttggaaacaaagctctctttctgtttccccaggcggtaggttgcagtgttgtgattctcgctctcactgcaccctctccac

SEQ ID NO: 566964 - DNA, 119 bp, Homo sapiens
  misc_feature (66)..(66): n is a, c, g, or t
gcggctcccggtcggggcatccctttccttcgtgtgtggatccggcgttcttcagacgacgctggngctctctttcctcgggtccgcggtcgccttcagtccatcctggtcctcgctgt

SEQ ID NO: 566965 - DNA, 117 bp, Homo sapiens
tccgggaacgcgccattgtgttgtacccggaatcccgcgcgtcaacgctgtgctgcacatgtctctattgatcctgaaaatccaccattttttgcaatttcccccccctccaatggg

SEQ ID NO: 566966 - DNA, 190 bp, Homo sapiens
acgctgcaccgcggtgtcaaacacattctccttgcctcaaccttcccaatgtagctgggacctacaggcgtgtcgcacattgcctgtgtaatttcaggtatagtaggaagagacgggtttcaccatgctggcaaggctggtctgtaactcctgacctcgtgatctgccaaagtgctgggcattacaggcg

SEQ ID NO: 566967 - DNA, 208 bp, Homo sapiens
  misc_feature (62)..(62): n is a, c, g, or t
gtggcgtagagctatgcagcttgaaatccaagtagcactaaattttattatttcgtatttgntacaataaggcttcacacgagaaggtgttcaacatttttgggtgaaggaacttgaaaggacttctttaaggaaggagatatgaaggggcaactggtatctcgaaaggcgataaaaagggatgggggtttaggatgaatacaaatag

SEQ ID NO: 566968 - DNA, 137 bp, Homo sapiens
  misc_feature (133)..(133): n is a, c, g, or t
cccccgctggccttctccaccacaaactcctgctcatgtggctgcagccacaccggcggctgccggctctgactggctctgcctcagggccttggcactggcaatcccctctgttcaaacgtcagtgtgtcancgag

SEQ ID NO: 566969 - DNA, 237 bp, Homo sapiens
  misc_feature (5)..(6): n is a, c, g, or t
  misc_feature (36)..(36): n is a, c, g, or t
tattnncgggtgaacccacgcgtccggtcaatcagnatctcctataagggcaggcaactgaatctcaatccaagataccctgagatcctacgcatgtgatctgcaaggactggatcaatctggctgagaaaaactacatcattctgaacatgacagagaacatagactgtgatgtgttccggcagcaccgggggccacagctcctggccctggtggaagaggtgctgccccgccatg

SEQ ID NO: 566970 - DNA, 905 bp, Homo sapiens
ggaggtccagcggctcaatagggccctgggagagaaacactgtagcattcaaacgctcgtgcatcattctcacaccaatgagcatttagggagccccagaacggagcacgcggtgccctcctaacggaacacacaggatgctggtgcatgcacgcagatgagttgttgacatatgcatgccaggctgtaacgatacttcgtaggtagggaccttccatgaggtgatgcgacatgtgactcgatgacgcggcactgtatatgcaggacgaaggagagagcatgaagaaagcgaagtggacgacaccgtgacgaggccgcaagagtctaccacttggtgctcatgccccaagcctaaacaaggcgatccgaggacgcatgacggtaggacagagcgagagaacaacgcccgtccagtaccagcttagaaggtagtgaagatgcatataggccgcgtcgagaggagaaggcggttaaccaatgctaggagacgccgcacacacaggagagcacttgtcgtggcggtggacactgtacccactagcgtccgtaagccggcccgattgccaggcctactggtgcctacattcgagtagaggctatcgagggcacttggttcacacagggatccgcagtttagccctcgagatatcacccttgacagacatcagttggggcaccaaaaatgaatcgccaaatatgatcaagtgttacaaagaccataaacaaaaccaaaacccagtataggactaataacttggggacaggcggggtggcaacacgcagggaagaccaaggatgaatgggggcatcgatcaaaggccagggcttacaccacaaagctgacaaccccgccatacatacccattctggatgtaatggagagctcgggaaggaagcgcatagaa

SEQ ID NO: 566971 - DNA, 782 bp, Homo sapiens
aatacttcggtgccttggtatgagtgacgcattactacagtattctatctataccaccgatgacagtcgaaactgctctgtactcagtcctgactcactccatggtcattcatcaacctacgcatatagcagaagaggtcacgtcaatatggctagggttcacccacgagtaatcgctgcacgtatatgccaggaagtgaatatgccctcgattgacggacttaagatgctctgtctgataccgagtatgtctcagagtctattacctctgtacattgctcagagattcatgagttggatcctagagatctgatgctgtcattgtagataattctgatatttgaaatatactgggtctgataatgcgaacactgaccagtagtgattagaaagagactcaccactcgtattgatgtacgctcgaacatggagactattcgcgtgactagatggagtaagcgtaaattgaatctttgttaagtagacagtttgtcttccatgactgttctgatcgattagagtaagcatgtttattcgcagagaagcgtgtgactgttgaagcctgaacgaattaggcctggaggtggagattgaggcattgcaaactaaatatttaaatatggagcataatcccgaatttgagtctagacacaatttcatttccagcatttttataaagtaccaaattagtgaaccaaaaatagaaattagattttgtgcaaacatggagaaatctactgaattggttccagatttaattttatgtcatagaaatattgact

SEQ ID NO: 566972 - DNA, 246 bp, Homo sapiens
gtgcagggatccttgcagggaagaagtatgtgcaagggatcgccaccactgctgcctgaaatgctttgacaagttctgtgccacacctgtgtggaatgccgcaagcccatcggtgcggacttgcaggaggtgcactataagaaccgcttctagcatgacacctgcttccgctgtgccaagtgacttcacctttggccaatgagactttgtggccaagacaacagtactgtgcacagtgcacatcgg

SEQ ID NO: 566973 - DNA, 950 bp, Homo sapiens
  misc_feature (39)..(39): n is a, c, g, or t
  misc_feature (67)..(68): n is a, c, g, or t
  misc_feature (93)..(93): n is a, c, g, or t
  misc_feature (103)..(103): n is a, c, g, or t
  misc_feature (108)..(108): n is a, c, g, or t
  misc_feature (112)..(112): n is a, c, g, or t
  misc_feature (114)..(115): n is a, c, g, or t
  misc_feature (120)..(120): n is a, c, g, or t
  misc_feature (136)..(136): n is a, c, g, or t
  misc_feature (139)..(139): n is a, c, g, or t
  misc_feature (148)..(148): n is a, c, g, or t
  misc_feature (161)..(161): n is a, c, g, or t
  misc_feature (173)..(173): n is a, c, g, or t
  misc_feature (202)..(202): n is a, c, g, or t
  misc_feature (212)..(212): n is a, c, g, or t
  misc_feature (277)..(277): n is a, c, g, or t
  misc_feature (289)..(289): n is a, c, g, or t
  misc_feature (299)..(299): n is a, c, g, or t
  misc_feature (308)..(308): n is a, c, g, or t
  misc_feature (334)..(334): n is a, c, g, or t
  misc_feature (353)..(353): n is a, c, g, or t
  misc_feature (399)..(400): n is a, c, g, or t
  misc_feature (497)..(497): n is a, c, g, or t
  misc_feature (531)..(531): n is a, c, g, or t
  misc_feature (644)..(644): n is a, c, g, or t
  misc_feature (653)..(653): n is a, c, g, or t
  misc_feature (655)..(655): n is a, c, g, or t
  misc_feature (658)..(658): n is a, c, g, or t
  misc_feature (663)..(663): n is a, c, g, or t
  misc_feature (700)..(700): n is a, c, g, or t
  misc_feature (725)..(725): n is a, c, g, or t
  misc_feature (756)..(756): n is a, c, g, or t
  misc_feature (824)..(824): n is a, c, g, or t
  misc_feature (833)..(833): n is a, c, g, or t
  misc_feature (842)..(842): n is a, c, g, or t
  misc_feature (865)..(865): n is a, c, g, or t
  misc_feature (874)..(874): n is a, c, g, or t
  misc_feature (878)..(878): n is a, c, g, or t
  misc_feature (882)..(882): n is a, c, g, or t
ggggggggggtgggggcgggggggggtgggggcgggggngggggggggggggggggggcgggggggnngggggggggcgcgcgtggggcgtgnggtgggcggngcgcngtgngnnagtgnggagtgcgcgccgttnccngggggatgngcagggggggagngggggggcgtgngcgcgaagggggggggggggggcgtgggngccctgtgcnctgggcgcaggacttcagggggatgaccggccagtgctggggctgctttcggtcacagtgcttgngaaagctcagcngcgccgcggnctccatggnttggatctgggcagcgctgtgcccgngcaaacgcttgagctgggnctggggccgctgagcagggctctgagtgggggcttctgccgggcgnngggggtggcagtgcaggtcgtggtcagcgttcacatagctgtacaggcgctctgcatccagctgctgctgccgccgtcgttcttctctatgcctctnggtctctgccaagtactggcggactctctcagtnatttccatattgctcaggtcacattctacctctgcatctgacttagtctccatctcttcctctttggacaaagcttggtcttcttttgtggatgcctggatcctactgctgtnacgtggatncngcncagancttctgaaatgtgaagaactgcaggggtagttctgcnagggcacatgatggtcatagaaggnctgaggatacgcagcctcattatcgttaganctttggggaagaagcgcagaaggtaagttccatgggagattgacacaggatttcacggcctttctgtnggcattgtnatggctttncatccaagccatttcttgaaganaatgttgcnagtntctngcatataccggatgagaattccaaggcctgggagctttcgatgttgacgcctttcccgctgccatctc

SEQ ID NO: 566974 - DNA, 120 bp, Homo sapiens
ggcaggcaccctgatgtagcacaccttgaggaggtctgagaccaaggctgacgcccaaatggacagaccccaggtcaggcaccccgagtagccacacctggaggggtctggcccaaccat

SEQ ID NO: 566975 - DNA, 221 bp, Homo sapiens
  misc_feature (9)..(9): n is a, c, g, or t
taataatcncagacatgtttaaaaaaaaaaaaggagttaattgggaggctgaggcaggaggattgcttgagcccaggagttggagacctgcgtggacaacgtagtgagactccatgtctccaaaaaagacaaagattagccgagcattgtgatacatggctgtggccctatctagggatctgcactctagcctgggcgacagagcaagacccggtctcaaa

SEQ ID NO: 566976 - DNA, 112 bp, Homo sapiens
  misc_feature (26)..(26): n is a, c, g, or t
  misc_feature (29)..(29): n is a, c, g, or t
  misc_feature (32)..(32): n is a, c, g, or t
gcgtcccatcatgtacggggcttggntanatnaaatttatgcatgtaaaatgcaatactatgcagtcattacaagggatgaagaagtatatttactgatgggagaagatgcg

SEQ ID NO: 566977 - DNA, 212 bp, Homo sapiens
gacggagaggctcacttattgtctttgtactatggctttgttttgaatttggcatgagggagagagagagagagagagagagagagagagagagagagagagagagagagagagagagagagagatagagagagatgagatgatgagatagatagatagagatagggaggaggggggagggttattttatgtgtgatgtgttacgtgtatgg

SEQ ID NO: 566978 - DNA, 814 bp, Homo sapiens
gatggagacacaacaatactttcgagcttgcatctattcattctatcatcagggaccagctatgaggctgaagaaaaggcaagatccgcatcagatcaatctggcttgagcgtcacctggtcgtccgtcccgaaggagaacctgccccgtacggaatactcggacagtgtttggagtagctcgtatggattaggagggatggtggaggagtggagagtgcgtgaggtccatgagatcaaatgtgggccagtatcctagtggcatatgggaggaaggaaaaaaagtgtagaattgcagatggcctattgcggggatggcatgcgtgcacagcgatgacacctaaacactactggagttgccaaatgcgctccggacccactgggaacgaagatcgacagagatgagcacgagggctcacgtttagagtacgcaaacagaataacagctggcacacatgggatttcccaaagatgggaggggaatactcgcatggaccagactggaatccaatgaaacgtgcttaaagggccccccacactggacaaagcaaaccgccgagacgttaagaacaggaggtaaatttaacccgacggtaaagaaacggtgacgaaaacggaggttctagagcccatttttaggagaaaaaacacatcctcggggagttacaaacaagggcagccacagattcagaggcctgggggaccgccgcatattggcgcccagagcataaactagcatgtgcacatagagatggacccccacacattttcgagacataccgaatgacctccgcgggggaactaaaatccccgga

SEQ ID NO: 566979 - DNA, 318 bp, Homo sapiens
atacaggaaagctatactatgcaaagtatatgagtaagatacacaatctaaataggcactgaagaaataaagagctggtataattgcatcctcagactattattgactgtgtgtgtgtgtgagaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtg

SEQ ID NO: 566980 - DNA, 374 bp, Homo sapiens
gttaccactctgccttgctttcgctctcttctctcgcctcccctccacttcataaaggtatgatacctttaaaggtatcttcatgaacagcagttatttattttaatgtagctcaattgtcgagttctcgacgattttcgccaaaaagggaattttcttctgttcttgccttgtcacagaacaaaggggcggggcgggggggtgagggggtgtgtgggggggggtgtggggggggccgctgggggtgaagaatgtgtgtctgtgtgtgtatgtgagtgtgtgtgtgtgtgtatgtatgtacgtacgtgtatgtgtatgtgtatgtgtttttgtttaagaaatcttaacccatccctaggtcaaatgaaatagtt

SEQ ID NO: 566981 - DNA, 311 bp, Homo sapiens
  misc_feature (1)..(1): n is a, c, g, or t
ntttttctgcagggcctggtgtccggatcgcatatgccgggctctgctacgctgtttggacttggctgagcagggggaaaccatgccgctacccaaaagaaggggggggccggaacctgtttggcccgggggcccgggaaaatggtgccccccggggcggccaagggggggggctccctgaagggtcaaaaagaaaaaatcccccgggggggccccttgaaccccttttaaaaaaccggggggcccccgccggggaaaaagaaattgggggtattggggggggaaacaaaaaaaacccccgcgggtggggg

SEQ ID NO: 566982 - DNA, 479 bp, Homo sapiens
  misc_feature (46)..(46): n is a, c, g, or t
  misc_feature (107)..(107): n is a, c, g, or t
  misc_feature (322)..(322): n is a, c, g, or t
ctcatggaacaagggtgtgaaatgaaaatattttaggatttattcnaaaacagactattctgttttcagcttcagaattgttcttgatcctaaggaacctctgtcancagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattaaaaagaagaaggaaaaactctgccttttagttaacctttggttcccttccactcttgtnaaaattgggttggccaacaagaacatgtccaggtttatgtccccaattaccatcctgtggtagatcttaatgtttttgatcgttgggttaaagtggaagtgccacccacagtgaaaccagatcccattaataaataagcttaaaagaaaaaaaaaaa

SEQ ID NO: 566983 - DNA, 259 bp, Homo sapiens
cgacggatcccttcggcagtatgtagatctagtgtagttgagcagttcacatctatatgcacactttaaggaggcgcttgatgtcaggctcaatgttgatgtgttgggaaggtgcggctgtacagcgtcggaaggggctctccctccggccctatgaggaacttctcaaagttcccaggcccacatcttcagcaggcgacaccagggcatccccacacatacatagagctatgacgacatcggtacatgagggcacaca

SEQ ID NO: 566984 - DNA, 395 bp, Homo sapiens
acaagcctaatatgtttattatctgaacctctatagaaatgtttgccaattcctggtctaaataatttctgaatgtatattctttagtttatcactatcatcatcattttataataaaatccatcataaaattatagttttgtatatagcaaggaggggtatatgtcttaggttttggattgtgttgttgctaatttttgcaaaaatcacttatcttctgtattttccatacctaataatgactagtatatatcagacactcaataacaaacgagcagaactgactcggagtccagttatggcttatgaatggcataatcctggtttcctgggcttagcaatatgaaataatcccctcttttggccaactccagaataaagaagtgtgttgcatt

SEQ ID NO: 566985 - DNA, 274 bp, Homo sapiens
cttggcgagcacggcgaccccgttccacgccttttgcccatgccagaccgcgccatagcccgccgcctcgatcgcttgcgccgggaaggtatcgtcagccgccttcagttcctgcaggcagacgatgtcggggccgtcctcggtcagatactcgaccagccggtcgagccgggccttgatgccgttgacgttgtaggtgacgatcttcacggccaccgctgtagagcaaagaggccgtacgggaataccgttcgtgctgagcgaagtccaggga

SEQ ID NO: 566986 - DNA, 823 bp, Homo sapiens
gccggaaccgtcatctgccgttccttcgatggaatgaagaacacaaagggaaggaggagaggcgaccgatgatgtgttctctcacgagcctattcttacgagacgtggcagtaggtcacgcattctgtgtctcctatatcctaagtctataaagaccggctgtatgggacatatgaaggctaatgtctccgtccttccaaaggaaatgcctctcaatataccatgctcatccaagggaaaaccctgaacgagtctagcaatgggttcaactcatatactgactgtatagcagtaagtagtaagagcagcccgagagttaaggtctccagagttcggtggttgcagaagacgtttgattgatgcagtaattgaagcaccatgagggccatcatatatagcacggtgatatgctgtgcatgaccctggtgtgagcgtgcattgttgcatcaagtcaaaacagacacgaacgccagagagcatggttttccggttgccaggtacaggggctggccgtgctcgaaccatgagaaagagacctgtgttgctgacagccaacaggagagagcgatcgtgaaactggatggaaattctattgtgcctatcagtccatgctcatataatctgtgttaacttatctaatccttgagccgcatcaggcagagtttgatgctgactagaagaccttacgaaagacaactgtctaggggcagcaagggcctctaagagaaaacgaagttgctattacagagccagaggggtcctaatgggcgatattgcaggaagcatttagtatgagaggaccacagaggcggcaggagaccat

SEQ ID NO: 566987 - DNA, 199 bp, Homo sapiens
  misc_feature (29)..(29): n is a, c, g, or t
  misc_feature (90)..(90): n is a, c, g, or t
tgtatagtgacgatcttgaagtgcgggcntttcgattacatcgctggagatcccaaggagcttcatgaactcatcataattcttctcacnctccatctcgaacttgccggtgaaagccatgctgctgggaggctttcctttatgtgtctgtttcattctctgcaggtctcctttccggctcacccatcgcacttagaca

SEQ ID NO: 566988 - DNA, 1007 bp, Homo sapiens
gaccgcggcctcagatgaatgcggctgttaaagacctgcaataatccagaatggctactctgatctatgttgataaggaaaatggagaaccaggtcacccgtgatggttgctataggatggcgctgaagctggggtctggaccttcattctatcagccttacgatggagagatctcaatgtttcaacaccacgttttggctacaacgttcgatgccccaccagccttacctaaaagctactagaaaggctttgggaactgtcaactagagctacagtaataatgtctgtaaagaccaagggagcccctcaaacaaaaacagccaagcttttctctgccagaaagatgactgagaagactgttgaaagcaaataagctctgttcctgcctcagatgatgcctatccaggaagtagaacaattctgtcccttcaatcctctagactttgagagatgtcgacattgcctgaacgagcaccagcattgcgtcaccgttcccttgaaggtggcagtgcctctcagtgatccttgacgaggagagagagcttgacaaagctgttcaagcctggtacccccacctatcagctggtgaaacgtatggcctctaccaccatgggaatcgcaatgcagttagcacggtctcccttgcaaggcagttcatgtcgagccttggagtgttagaatttggccacactggtactgctcgtgacgcttcgaattagttacaatagacttacgtgctttcaggaagttgagagcagtaatcacgtactccattaagagacattcggttgagacaggacaagaggaaaaaaaacgagcatagacaacagataagacgacgcctcacgtgctagcgtcacatgcaacagccaaacagcagcaacagacgaacaccaacatgagcagagtctagtcggagagattgatgagaggcaaccagagatagccgaaaacaggaagcagacaggagacagagtcacaagtattcggccacgccatgaatgaa

SEQ ID NO: 566989 - DNA, 821 bp, Homo sapiens
gtgcccaggacgcgcgacgtctggaggccgggacaagtgggggctgagcagctgctcagtacgtgatggcactatacatggctcacgtcgctcacataaggtgtcaggtgatcgacggtatgcccagtatttcttctggggttatgaactcgcgaaaataggcctgccaagtttgggacccgaaatggttcaggtttggctcactcgtgaacagagtggctcagtacttgttgcggtacccttggtagcggacagtcactcttcacgctatgaggcaccgagattggtgtagatcagcacgggagaatgcaacgtacaaaactctcgctcttggctgcattcgcgtaacctcgattcatgccttcactacgaatgaggttaccatgggagagatgcgctctggtaagaattgggcctacagacggtcgcttcgccgttggctctgtgactgttactgagcgaggtgctcgatctggagtcgaaggacgagctctgcagggacaggtagagctgagccgcgtctctcgcgagagtgaagcccagtggtagcactgtgtcctcgccctgtgattcgaacgtcctcatctcttccccgcggagacgtgtgggcagaatccaggacctcagcaggaggaggccatgtgtgcaacaaaggctgtcaagttcgttcacttgtgaaaaggaccccgagtgcaaagtggacacaagaaggggctcaggagaagtgaaaaaccagatgcccggtggtcctcccagttggagtggtgccagaatagagtgggtccagaatccacaaaattggactcttggagtagagggcg

SEQ ID NO: 566990 - DNA, 335 bp, Homo sapiens
  misc_feature (320)..(320): n is a, c, g, or t
ttccccccccttttaacccctgaaactttttccctctgggcccaaaaacctgttggcttttgtaagggcccgggccccccctttgcagattcggggccccaaaagcaaagatgtttcctaagccgccttttcccccccgtttggcctcggggcccctttgccttgggcccccggcccccccccggggcccctcctttttcctccccagggtttgggggggacgaaagccctttttttttccctattttttgctttcccattttaaggttttggtgaagaagggggccttttctcccaaccttggttaaccttttaaaaanaaattttgaaagcca

SEQ ID NO: 566991 - DNA, 105 bp, Homo sapiens
tggaccagcactcttttcttcacaggtacatgtattaaggaactgtcagctcagagatagtaagcagcctgaatttctttttatttcttgcatattgtgcaggag

SEQ ID NO: 566992 - DNA, 122 bp, Homo sapiens
gctgaaaatgcaggcttttgtaacagtgtgatctttccccacgcactcatgacaagtacccaaggttttttagctattttagtagtgtttgttccattaatatgctagctgtaaggtaaaaa

SEQ ID NO: 566993 - DNA, 144 bp, Homo sapiens
  misc_feature (113)..(113): n is a, c, g, or t
acaccatccaccagttcatctcactgagctcgcaggcagccccagccaccagcgaaatggccgcgtcggcgctgcaccagacgaccagcttcctcggcaccgccccgcggcgngatgacctcgtccgcagcgtcggcgacttcg

SEQ ID NO: 566994 - DNA, 101 bp, Homo sapiens
tttcccccaggtaaacctgtgtcttttatggctaggaaaacttaccacagaacaaattcatatatcacttactggatacctcaatagccatcacaaaggat

SEQ ID NO: 566995 - DNA, 170 bp, Homo sapiens
ggggccccccccggggggggggggtccccccttttggccctgggggggcccccccccccccccccacaaaaaccaaattgggttcccgggggccccccagggggggccccccccttgggtggggcccccccccccgggggtttttttccataaaatccccggggtttgga

SEQ ID NO: 566996 - DNA, 339 bp, Homo sapiens
aaatataccccagcagtgggactggtgggtccatatggcagcctttatttttagccttgcctgaggaaactcccagactgttcctcctacagtggcctatactaattttcactccccacccaacagtatgtgagggttcccctttctccacatcctcgccagcatttgttactgcctgtcttttggataaaagccattgtcactggggtgagatgatgtttcactgcagttttgagttttatttctctgacgattagtgatgttaagcatttttcatatacctgttggccatttgtacctcatttcaatatttgagaaaataaattatgattattcttt

SEQ ID NO: 566997 - DNA, 245 bp, Homo sapiens
caagaacctatgccagtgtgtttatgagagtttgcactgtcccacactgttgccaccagccacgtgggactgtttaaatttaaattttacaaattagccagtcatggtggtgtgcacttgtagtcccagctacttaggaggctgaggcaagaggattgcttgagcccagaagttcaatactgcagcaagctatgatcgtgccactgtactccagcctgagtgacagaatgagacctcatctcttc

SEQ ID NO: 566998 - DNA, 162 bp, Homo sapiens
agtagatttgggggcagtgtatcaagggagttgtaaatcctggcaacgtcttatgagaagactctggcactggcacgcggattgttgtagttttccaaagcgtagactgccagattcttcagaaacatcgcggatcaaccatcacaacaaagtcttataaag

SEQ ID NO: 566999 - DNA, 132 bp, Homo sapiens
cctacttttcacagtggtggtgatgtgctggtgagtaaactggctgttgtaccggaatccaactccaaaccaaaggcccctagggagaaacaggagacggcccctgcgagccctggctgctccccagcaggt

SEQ ID NO: 567000 - DNA, 256 bp, Homo sapiens
cagtaggcaccctgcactcggctctttctgcctacctaccccgcagactgcggcaggcctctcaccggaacttccagccagaagtgctgcagacccaggtccacggtgccccgtgcccacggtgcccaggtggagccctgctgggggcctgagccaccgctcccggccatggccctccactattcgacccaacccaggctgggctcatctctgccaggtgttcctaacccgacagactctggccacttgctttgcg

SEQ ID NO: 567001 - DNA, 137 bp, Homo sapiens
cggcccccttgttatttgctacagaaccctctaaatccccttgtacatttaactgtatagtccaaagaggaacagctctattggactaacagttaatatacaaagggataacgagggtacatagtaggcacaataaa

SEQ ID NO: 567002 - DNA, 285 bp, Homo sapiens
agacgagtgatctaccttactcttggtgatgtgcccgatcgtcacttcatcccacgtaggtcagcgtgcctgttgggtttgctcgatagatgtacgtcttcaggcgggtcatggtgtcttcacgcctgtattcccaggactttgggagtccgagatgggaagagtgcttgaggccaggaattcaagaccagcctgatcaaacatagtgaatccccatgtctaaattttttataaccattttttcaaaagtacatctcactcagaacagagtgaaagctgaaagtg

SEQ ID NO: 567003 - DNA, 633 bp, Homo sapiens
  misc_feature (201)..(201): n is a, c, g, or t
  misc_feature (203)..(203): n is a, c, g, or t
  misc_feature (210)..(210): n is a, c, g, or t
atagctggctgtgagcggagaagcgggggctatcaaagaagaacatgtgatcatccaggccgagttctatctgaatcctgaccaatcaggcgagtttatgtttgactttgatggtgatgagattttccatgtggatatggcaaagaaggagacggtctggcggcttgttgggttgtggcgatttgcagctttgaggctcangngcattgnccaacatagctgtggacaaagccaacctggaaatcatgacaaagcgctccaactatactccgatcaccaatgtacctccagaggtaactgtgctcacgaacagccctgtggaactgtgagagcccaacgtcctcatctggttcatggacacgttcaccccaccaggggtcaatgtcacgtggcttcgaaatgcgaaacctgtcaccacaggagtgccagagacagccttcccgcccagagaagaccacctttttcggaagttccactatctccccttcctgcccttaactgaggccgcttaacactggagggtgaagcactgggcctttggtgaccctttttctagccctcgcagtttggcgctccaaacctcgttcagttcatcaaagaaccttttatttacactggactaatgaagaaatg

SEQ ID NO: 567004 - DNA, 138 bp, Homo sapiens
acaacgtcgttactgggaaaacacaacgtcgttactgggaaaacacaacgtcgttactgggaaaacacaacgtcgttactgggaaaacacaacgtcgttactgtgaaaacacaacgtcgttactgggaaaacacaacg

SEQ ID NO: 567005 - DNA, 1509 bp, Homo sapiens
caagaagaattgggcgcgcttttaattgtgatagattagttgccccctagccgcccccccacgatgtgggggccgcccgacagcacggaggaagaagagcggtgtttgttgggacaaaggagtgtgacaaaagcccaatactttctggcgaagggagagtgttatttagatcctgtgtgcagcccaccaagggaaggagttggggtggcccgcccctgatatatcctgtggggggccctacttataagaaagaagaagtttcctctgggggtaaaaaccggaggagttgttttttgtgtgtggaaagaggaagcgcagtgtgtgtgcccccccccgcctgtcttggtgctggttttgtttttggttgggcggccgccaccaccacgcacagaagagtgggggaatttatatttttttataggggccaccaccaggcggggtcataagagtgggtaataacgacgccgcggtgaaaactccccgcactgtgggtgctttgtccccccccctcccgtctgttatgagatgagaggagatattctctctctcaagggttaacttttatcgcgcacaccaattttctcctgcctccccaaagagttttacactcacacacacacttttgtaatagacacgccccctgtctctctctctggcctttgtctctatgaggaaggactctctcacttgggagacccctctcttacactctgtggggaatttttgtgtttcgccacattgcgctctgctcttctctctcgccccacgcccacagagagaggtgtgtctcactgtggagccacacaggccttgtggcgcacacgcaccacaggtttgtgagcgcccggcacactcttagagagagggttgtgtctctcacagacacacacacgctgtctgtctctctccggcgagtagtgagagagagagtgagagtggacactccctgctgtgagagagatattgagagagcgctgctggagagccacacagcgcgctctcacagagagagttgttcgtgtatgagttgctatatatatgcgccacgacgtgtgtgtctccgtgtgtgaggatgtgtctcacacgcggggcgccacgacgcggtgtgtgtgtgccccacccttctcatattatgatgtatatctctatgcgtctatacaccggacacacacatgtgtgcgcgtgtctcagatctctgtgtggggatagctctgtatagagagagaatgagagatgggccttctgggagatgacatagagtgggccagagttttaacaaataaacattctcattgttttggcgacacctgccataatttagcctgttttgtgggaacacccagagttggattccttgagatttcataatataagactgctcgccagtcacatccaccataattcagtggtgaaatctctgtcttgttactgtcattccccttccttttccgtttagaatccagaataaagttgtatttccaaaaaatcttaaacaaaagaaaaaaaaaa

SEQ ID NO: 567006 - DNA, 897 bp, Homo sapiens
  misc_feature (6)..(6): n is a, c, g, or t
  misc_feature (67)..(67): n is a, c, g, or t
  misc_feature (70)..(70): n is a, c, g, or t
  misc_feature (86)..(86): n is a, c, g, or t
  misc_feature (96)..(96): n is a, c, g, or t
  misc_feature (103)..(103): n is a, c, g, or t
  misc_feature (105)..(105): n is a, c, g, or t
  misc_feature (112)..(112): n is a, c, g, or t
  misc_feature (119)..(119): n is a, c, g, or t
  misc_feature (127)..(128): n is a, c, g, or t
  misc_feature (132)..(132): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (147)..(147): n is a, c, g, or t
  misc_feature (151)..(151): n is a, c, g, or t
  misc_feature (182)..(182): n is a, c, g, or t
  misc_feature (185)..(185): n is a, c, g, or t
  misc_feature (192)..(192): n is a, c, g, or t
  misc_feature (206)..(206): n is a, c, g, or t
  misc_feature (214)..(216): n is a, c, g, or t
  misc_feature (220)..(220): n is a, c, g, or t
  misc_feature (224)..(224): n is a, c, g, or t
  misc_feature (228)..(228): n is a, c, g, or t
  misc_feature (231)..(231): n is a, c, g, or t
  misc_feature (245)..(245): n is a, c, g, or t
  misc_feature (247)..(248): n is a, c, g, or t
  misc_feature (254)..(254): n is a, c, g, or t
  misc_feature (262)..(262): n is a, c, g, or t
  misc_feature (274)..(274): n is a, c, g, or t
  misc_feature (280)..(281): n is a, c, g, or t
  misc_feature (284)..(284): n is a, c, g, or t
  misc_feature (294)..(294): n is a, c, g, or t
  misc_feature (325)..(327): n is a, c, g, or t
  misc_feature (331)..(332): n is a, c, g, or t
  misc_feature (337)..(338): n is a, c, g, or t
  misc_feature (346)..(346): n is a, c, g, or t
  misc_feature (352)..(352): n is a, c, g, or t
  misc_feature (363)..(366): n is a, c, g, or t
  misc_feature (369)..(370): n is a, c, g, or t
  misc_feature (375)..(376): n is a, c, g, or t
  misc_feature (382)..(382): n is a, c, g, or t
  misc_feature (389)..(389): n is a, c, g, or t
  misc_feature (393)..(394): n is a, c, g, or t
  misc_feature (397)..(398): n is a, c, g, or t
  misc_feature (401)..(401): n is a, c, g, or t
  misc_feature (405)..(405): n is a, c, g, or t
  misc_feature (407)..(407): n is a, c, g, or t
  misc_feature (417)..(417): n is a, c, g, or t
  misc_feature (422)..(422): n is a, c, g, or t
  misc_feature (427)..(427): n is a, c, g, or t
  misc_feature (435)..(435): n is a, c, g, or t
  misc_feature (439)..(439): n is a, c, g, or t
  misc_feature (444)..(445): n is a, c, g, or t
  misc_feature (447)..(447): n is a, c, g, or t
  misc_feature (450)..(451): n is a, c, g, or t
  misc_feature (453)..(453): n is a, c, g, or t
  misc_feature (458)..(458): n is a, c, g, or t
  misc_feature (461)..(461): n is a, c, g, or t
  misc_feature (468)..(469): n is a, c, g, or t
  misc_feature (474)..(474): n is a, c, g, or t
  misc_feature (479)..(479): n is a, c, g, or t
  misc_feature (481)..(482): n is a, c, g, or t
  misc_feature (500)..(500): n is a, c, g, or t
  misc_feature (506)..(506): n is a, c, g, or t
  misc_feature (508)..(508): n is a, c, g, or t
  misc_feature (531)..(531): n is a, c, g, or t
  misc_feature (538)..(540): n is a, c, g, or t
  misc_feature (545)..(545): n is a, c, g, or t
  misc_feature (547)..(548): n is a, c, g, or t
  misc_feature (553)..(553): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (581)..(581): n is a, c, g, or t
  misc_feature (585)..(586): n is a, c, g, or t
  misc_feature (592)..(592): n is a, c, g, or t
  misc_feature (598)..(598): n is a, c, g, or t
  misc_feature (602)..(603): n is a, c, g, or t
  misc_feature (614)..(614): n is a, c, g, or t
  misc_feature (623)..(623): n is a, c, g, or t
  misc_feature (625)..(625): n is a, c, g, or t
  misc_feature (632)..(632): n is a, c, g, or t
  misc_feature (716)..(716): n is a, c, g, or t
  misc_feature (739)..(739): n is a, c, g, or t
  misc_feature (781)..(781): n is a, c, g, or t
  misc_feature (785)..(785): n is a, c, g, or t
  misc_feature (812)..(813): n is a, c, g, or t
  misc_feature (816)..(817): n is a, c, g, or t
  misc_feature (830)..(830): n is a, c, g, or t
  misc_feature (893)..(893): n is a, c, g, or t
aaattnattttgctttggataccatacttatttttcacaaacattctacttatattaacctataatnggnttattcatgcgatttnaatataaatnaataaangnggtaaangtatgtntgtgatgnnaatnaangtnggnaagggnatanattaaaacatttcttagtttcaatctcaaangcnataaatnccagcaaatattancccaaatnnncggngacncttnggnatccgccatcattngnngggggnctcagggnatcatgagaccngggggnntgnggccactggngtccccactgaacttgaatacgggggggggnnngggnnattgnnccgggggncggccngggcctcgaannnnggnngcacnngggggnggggggngggnnccnngcnaacngngggggcgccngggcnaaacngcatccgngggngtccnngngcnncnttcanctncctcccnngcccnggccngnnggtgtgcgcgcggggganccgggngnggggggggaatgggccatcatcncccgggnnnccttngnnggganggnggggntnggccacccttacaacctngggnncgcccngcgcgngggnnccacggcctcnatgtgtgancngcgtatntggttgcgctctcctctcttgtggtcctgtggattcctctctcctcttacatcctggtgaaccctgtaggcctcattccaagtncatatcttctggtgccaactggnatactgggcttaatgtggtcacctgatgttaaacagcagggntgcngcccatcaacttctcacactttcttcnnggnngggggctgtgtanaactagttccctatgcctggatccatcccatagttacagcaaaggactactaaaaacacagcntagt

SEQ ID NO: 567007 - DNA, 86 bp, Homo sapiens
gcggccgcctactactactactgctcgaattcaagcttctaacgatgtacggggacatgaaaataaacatttcctttttaacatcc

SEQ ID NO: 567008 - DNA, 112 bp, Homo sapiens
cgatgttcatcgccaggaaaaatgactggtcaagtaggatctgggcattcagggcacctgggacataatggtaccctaatattcatttgaatactgtgaaactggcaatacc

SEQ ID NO: 567009 - DNA, 296 bp, Homo sapiens
agactaacccacacactgatgtgttccatgttatcttcagttacaatgcaactaaatggaaacacacaactgagtcagatataccaaaagaatcaagtttggccttatatctgagaaactgcaacagcactgaattctgcctgacaaattacagctctaaccccacatccacacagttttgatgtacagctagctttaccatacaagtgttaggtgctgaactgtaatatcattgacagaaatgtgatgccagaatgaccacggaatcaaatgtacatacaagtcaccaagttagc

SEQ ID NO: 567010 - DNA, 468 bp, Homo sapiens
ggcctgctcagaagaggcacacactataaacatgtttaatagtctcataacatgagaaaattacatgaatttcaaatacaaatacagtatatctttatagtatcgtatgttatagagatggagtcctatgctctgtagcccaggctggagtgcagtggcacgatcttgggtcactgcaagctccacctcccgggttcacgccattctcccaccatgtccactgtgagagcgaccctcagaagtactgagaacagcccaatcagttcctttagcacaagtattgttgttacacctgaaaacccaacaacacagggccctcctgtactgatgtctgccactgggacccaaacattccctgtacctactactgtcacctttggcagtatggattcctctacgtccactcttcatactcttactccatcaacaggcttgagccagatcatgtcaacatcacagtttcctatt

SEQ ID NO: 567011 - DNA, 1573 bp, Homo sapiens
gaactggttctaggtgttcacctccctgcctcatggcaacgtctcctcaccctctgcacttactgcgcaccgcaacgctcccaacgcctggcagccttcctccactctctaccccagccaccctcaggctcttccacacgccctgctagcctctgacgccccctacacacctccactccctcacctacctcacacccaccccctgcgcagccaccctccctgcacctctgctcgcccctctcactgcgctacgcaccacacctgcacgcgcccactccctactgcaccactcctgctcgcctacgcacacatccctcgccactactccgccacgccgtcgcccaacctcctaccaccctacaccccctctaacgcgcggcccctctactctacgcccccacgcacctctgcctgctccccttcccacctccaccctgcccctttcccaccctgcacacccacctctctcgcacctcgccgcaaccgcccccctctgccacacctgctcctcgcacccccctgcacccagccacactctccccacgcaccccacacgctctgcgccttgcccccttaccctcccctgccccacttcgctacccttctcccccctccctgcgcccccaccacttcactgccctctccttgccctcccactccctcccctgcccctcgccacgccaacacacgcccccctaccccacctgcacaacccacgctcctctctcctgcctcacgcccacgccagccactccaccccacacctggccctcctgccctctcctgcacgcccccacgccccacaccccaccgcactgccgctgcaccccccctgcctgacccctccttccgcccccctgcgcctcccccctaccccctgcgcccctctgccgctggcccctgctcgcgcctagcccccgcctgcggctgcacccgcgctgcgcctctctccccacgccacgcacctggcttccacccctgccccctcgcccccctcctcctgcctccctgaccccaccctcccaccccacaccccccacacgcctcggtccaccctcccctcccccacccctcccctgctcgcggccctccccgcgctgcccccccccccccttggcccccctcccccacggcccctccccccctccccccccctctcccccagtctcgttcccccactccttgcccggccgctggccccctgcgcgcttgcgccaccgcaccccctcgtgcgtctcctccctgcggctctcctctcctctccactccctcgggctgcctgcccccttgctcctcgtcccgcttccagccccccccgccgcccgccccgcctctgcgctctcgccctgcccctggcgcgcccctccgcccccctctggaccccccccgccctctctcgcgccccctcccctccttcctcgttcgcccgctccgtgcgccccgtccgcgccctcccgcgctcccatccctgtcccccccgcgcctcccccgcccccccgcgcgcgcccgtccctcctcgccgccctccccttgccccccactcatcgccgcccggccccccgctccacaccgc

SEQ ID NO: 567012 - DNA, 133 bp, Homo sapiens
  misc_feature (15)..(15): n is a, c, g, or t
  misc_feature (103)..(104): n is a, c, g, or t
aattttgtgattacnctggtgaaaaagggtagacgattaggccagccggtccggaagaattaggtaagggtgggaatgtgtgaagggtatttccagggctgcnnaaactcagttggattggattgcttggttt

SEQ ID NO: 567013 - DNA, 147 bp, Homo sapiens
  misc_feature (146)..(146): n is a, c, g, or t
cggtggctgcgttttggaaggggacccagagagaaaatcctggctgatgacacactcggtctatgtagagctgggccacggcggtggccgagttctggaagaggtgccacagattctgctgcttgtgctcgggatgggaggcggcng

SEQ ID NO: 567014 - DNA, 1162 bp, Homo sapiens
cacggtggctcacgcctgtaatcccagcactttgggaggccgaggcgggtggatcacgaggtcaggagattgagaccatcctggctaacacggtgaaaccccgtctctactaaaaatacaaaaaattagccgggcgcggtggcaggcgcctgtagtcccagctactcgggaggctgaggcaggagaatggcgtgaacccaggaggcggagcttgcagtgagccgagataccgcctgggtgaaacgagcgagactccgtctcaaaaaaaaaaaaaaaaaggtttttggggaccccttatagcaggttaaaagcttaaagaacttcatggggtctctctcagctaaactttatttgcccatttcaccccagtgggccaaagggaagaaacgcgggtatcataacactccattaggtgaggatatcctcgaaaaggcaactgggtcgtagtgagttctaaacaaaacacaacaactattctcttccgaagaaatgcgcactgccttacaacagtgcctccccatactcaggttacactattaacgcccgctttaacacagtgcgtgtcgacacaacagtacagcctgtcaactcccctaaaagttcgctcgaggaagacacaacaaattttttgagagaccctgtagacaccacactaatggggacccgtgcgggataactaaccctttgttgaaaaaacaagggggggcttaggggaaacactcagcgaaggcactccatgggccccggtataattcccaaaggacaccttttacaggagaatgtgcccccaaaaggtgtgggcaaagggaatctggcgtgtgtacgcccagcggagtttggttgatagaaccaccccctgtgggtagccaaccacatcgtagaaagcaccccttgggttgtcgctatacagcaaaaaaatgtgtttgtttacacctctttcgcccgggggcattgtcccctcgggacaacaaccactggccggtgaaataccccccagcattaccttgggggagagaacccttgagagctgtaactgaacgggcatctgacttgtaacgccccccgagagaagagcttgagagcgactatgccagtacaacgcccggtgtattaccccacatgtgcacccccaacacctggtggtgtgcatcacatgttgtac

SEQ ID NO: 567015 - DNA, 231 bp, Homo sapiens
tgatggtaagtgatatctcacaggatctgatagtttaaaagtgtttaggggctgggagcagtggctcatgcctgtaatcccagcattttgggaggcagaggagggcagatcacctgaggtcaggagttcgagaccagcctggtcaacgtggcaaaaccccatctctactaaaagtacaaaaatcagctgggtgtggtggcacacaactgtaatcccagctacttggaagac

SEQ ID NO: 567016 - DNA, 397 bp, Homo sapiens
gcatagtgcaagtgttgcaggtaatggtatccactagacattacatctggtcagacgtatggcccagtgcaccatgactccagttaggtagaggatctcataggttgcgtcgcacaatgcatgctctggatgatgaaactgcccccagagtccagatattaggcaagtgtcggaaggctcttgtatgagtattcctcaatgctgctatgcaggccgtgtagataggtaccactatagcatatgcagcccgtatcacctaggccttggcatcaatattgtatgcgctttagtcgagtcccgttgtgcgatctagggtatggtctggaattcggttcactcttgtagcagatagtgcgcaattgataaagcacctcacatgtcagatcaggtgtgtgtc

SEQ ID NO: 567017 - DNA, 183 bp, Homo sapiens
taatctgtattcattgcgcactcctgggagctccttcagctttgtctctgatttcctggtctcatttagggcatcctctttcttcttcttggttcttctaggttgctgagcagtgtcttgcgctcttcgttggttttttctatgagagtctttatcgtgtttcacctaaggcgccggtgtacc

SEQ ID NO: 567018 - DNA, 678 bp, Homo sapiens
cgtttgtcttggccattacattcagctccttattacttatgcaaatttctgcagctggcttggatttctcagaaaatgggattttcttttctattgcattgccgggctgcatattttccaaacttttatgctttacttcccttataaactgaatgcctttaacagcacccaagtcacctcttgaatgctttgctgcttagaaatttcttccaccatatactctaaatattctctctcaagttcacagttccacaaatctctatggcaggggcaaaatgccaccagtctctttgctaaaacataacaagagtcatctttgctccagctcccaataagttcctcatctccatctgagaccacctcagcctggatttcactgttcatatcattatcagcattttggtcaaagccattcaacaagtctctatggagtttccaactttcccacattttcctgtcttcttctgagcccttcaaactgttccaacctctgcctgttacctggttccaaagttgcttccacatttttgggtatcttttcagcagcaccccacttgtgctaccaatttactgtattagtttgttttcatgctgctgatgaagacatacctgagactgggcaatttacaagagaaaggttatcggacttacgttccatgtggctggggaggctcatat

SEQ ID NO: 567019 - DNA, 140 bp, Homo sapiens
aacggatcacccgcaacgtcactttttcaggatacaagacatggtgggcctctcagcgacctgggaaagcaagtttagttcatttgagggctctggtcatcaccattttcaatttcatttttcacggtggtttgctgcct

SEQ ID NO: 567020 - DNA, 199 bp, Homo sapiens
gatatccatcagaagcagcggacttaccgccatatgtaccttctctggttggctatatattatggcgtgtgctggtgtgcatcatgtaactggcctgtgtttaaaacctttcctggaacacattggcccaggagccagaatcatcttctttgggtctacaaccatcttaatgaacttcctgtacctgatgggagcaaga

SEQ ID NO: 567021 - DNA, 699 bp, Homo sapiens
  misc_feature (126)..(126): n is a, c, g, or t
  misc_feature (342)..(342): n is a, c, g, or t
  misc_feature (497)..(497): n is a, c, g, or t
cctctgagaacaggtgtatcgaggtaattatctattccacagtgtatcctcctaccatgacctactatccgtggcgcattgaatgcttcgcctatctcttctcaattatctatctcttccccatgnggggatctagttcgtgcatatgaaccccaggaaaagaactttgactatgaagcatacagacagatacttgacgagaatgtacctgtcgtgcgaacagggtgtcgtatatgcgcacgcatgaatgccagaggcaatgtgtacatgccatgcctgtgcctgtgtcccccagaatacctcgtttaccaaaaaacaggcgccctccttttctacaaggtntgtgaccttagtgccgcaagcaagagctgaagaaagggagaatctgaccaagtcggcttttttctgctaacttgtaacaccattggaaaccccacaattggctgtaatttcctattcttgtggcccaatttgtgcaatgcggaacatactaaaanccaaggtttccccaacattaattctgtcctttaattcctttttcccatgtcccctctattcacattggggaaattcaaacaagagctttttaataagaacttgggataagggtagaccttttggggattttttttcggttatggaaccaccttatttgtgaaactaacaaccttgggaattacaattgtccttgggctggta

SEQ ID NO: 567022 - DNA, 122 bp, Homo sapiens
ctcccctgaggacatgacatgccctgttgatgaggaatggaagtggtccttttctaacggcaagtgatccactgcgttttacatttgtcattctctctgtggcaaaaagacatacaagttag

SEQ ID NO: 567023 - DNA, 286 bp, Homo sapiens
ggcacgaggctgcggcgaacatcttctcctcctcctcctcacaggtcagccggctccacctccgcgtcgtcctggatgatccaggaggggagctcgtcctcctccatggaggcgcggcttccgctgggggtggcgggcctcctcgcgccggcggtccaggtccaggcgcatgaacagatcaaactcctcctcgtggccggggcgatcatctgggtggacgggtctctgtcgtcggggcaccgtcgtcttcctccttcatcctggctcctcgtggccggggtaccgg

SEQ ID NO: 567024 - DNA, 216 bp, Homo sapiens
agaggacaaggaggagttactgggaaagttacaagaaaaaaaatacaagtggacagaaataagatgcacataaaggggatgacagcaactatttgaaaagggcaggctggcctgcagagagggagttcagcaaggcaagacttaatggaaagggttggcagtctggattggatttcaagcaagtccaagaaagcaagggacaggaggaactaggga

SEQ ID NO: 567025 - DNA, 885 bp, Homo sapiens
ggctctcgtctatgcccgcttccacacggatcaatgccaagcacgcccgacccaagctggggtgtccttgacaaaggtcctatcgatccatttccaaaggcgtcgctgccagaaatgacaccctaccattaaggctgtcaagcactcctactcactcacccaacctactatttcccattggcatacttacttgacgcttaattctcatcatcgctctcctcccggccttggggactcccctcacccgtggggacctcagtccagtcaaatgctcaacaaccaattgcattgtgcacacatgtcaggcgactacatcagctccgtgacgatggtcttccacgatctcctgacattctcagtcctcctcccggtgttctaaaagcagcaaaaacaagccatcgcaggatgccagggccgaattcctctcccaaagttcttttttaaaaagccccggagccagctccaaaatcaagcattaatttgcacaatctacgacaggcaatgcagactgtaatgcaaggccaagtggagccaaatccgcccgggaaggaggcagagaggagagagagaactgggtcgaatgcgtaagcctgccacgaagcggaaacaagagctctttttcgcgacaggacagccacattcccgagtggggcgcgcgccgactcgagctgcgggcaagaacgaacacgaagtacagggtcccgaacgctcgggcgggcccaagggcagcgtccccggggcttcggtggagctgggggcgggggcgaaagcggccgggcaccgaggcgccgaggagttagacggaccgcggggggacaccgggggcgcgggcggacggctgggccgggcgctcacctcccggtgtggtggacacagaacgtcccc

SEQ ID NO: 567026 - DNA, 686 bp, Homo sapiens
ggtgctatttcaagatagtctaggtttaggcccttgtacattatgcccataacatttctgtacagagtatttctttatattgcacgattcagagaatgttgatatatagtgtcttgtgtgcgtgtgcttaaacttccaatcttactttgtctctgggagattgtgaacgcagcattgatctaggaacggggatgggactagattctaatacatgtatttgggaccagtgggaatgatagttgggaagaaatctagtttgcacaacgacggattgctagatacttttcgctgtcgtagttttatgtcatatttcattgaacattttgacaaatattgatttatcgtaagcctaaaagtggattctttgaaagttgtaaagaactcttggaccaaaagatcgagtgactgtaacatgggccacttggaatgtagaactgttaccgtatgcgttgaaattatgtattacggggtagtgtgagcttttagtggtagaagtcatattaaactcttaagtcaaattaagcagaaccggggttggccagggtagccatagactttctgagtgtcagtagaaatcaaagattggcggacttgaaattagatcaggccaaggtttcgatacacttgtcttaggatattcaggatgcacttcaaaacactgatgtgaagtgtccagattctcagat

SEQ ID NO: 567027 - DNA, 1001 bp, Homo sapiens
  misc_feature (17)..(17): n is a, c, g, or t
  misc_feature (883)..(883): n is a, c, g, or t
  misc_feature (917)..(917): n is a, c, g, or t
  misc_feature (929)..(929): n is a, c, g, or t
  misc_feature (942)..(942): n is a, c, g, or t
  misc_feature (987)..(987): n is a, c, g, or t
gtaccggaactgctatncttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaaagagcaactgaagggatggttgttgctgacaagaactgttcaataaatacacttcatatctcctaatatttattgttgtggtgctgggacagctgcagacgcacagacatgacaacccagctcatttcttccaacctgggagctccactccctctccactggccgtcttcccagagttgtgacagccaatcggatgctgaaggcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgccatacacagtgcccaacaagaaggggaccaggcttggccggtacaggtgtgagaaagggactactgcagtcctcactggagaaaatcactcctctggagattgagggggctggaaagaaacagtccaaacaatggacacttcctgaatggcatcagtgggnggctggccccggttttggaaggtggtgagcattnaggcccagtaanacactcatgtggntagtgtttgccgaatgaaactcaactcaataaaaaacaaaaaccnaattgggcaggtga

SEQ ID NO: 567028 - DNA, 429 bp, Homo sapiens
  misc_feature (33)..(33): n is a, c, g, or t
aacccagtttcccatgtttaccagtttaaggtnccttggctaacttgatagaccaaaatggtatctccattgtttttaggtggcatttctttgattactggtaaagataagcgattttaaaatacattgtattgttatttgtatttattttgtgttaattgtctatttgtgtattttgcccattgtcttttgagatatgagtgttttccttattagaatgtaacattacttcatatattaaggatgttgaccttttgtttgctatatccatcgatattttttttgggtttgacatttatcttttagttttgtttatgattttgctgacttccaaatgtttgcattttaatgcagaaatatctatcaatcttctcctttggaatataatctattgctttttttgtgcatagtaaagccttcaccactctg

SEQ ID NO: 567029 - DNA, 821 bp, Homo sapiens
gaactgcttccttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaaagagcaactgaagggatggttgttgctgacaagaactgttcaataaatacacttcatatctcctaatatttattgttgtggtgctgggacagctgcagacgcacagacatgacaacccagctcatttcttccaacctgggagctccactccctctccactggccgtcttcccagagttgtgacagccaatcggatgctgaaggcagatgcttttcaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaaggttggggaccatctttgggtattagtggggagtgtccttgtagcagatggggaggttctgggtcttggcagcatgggtggtttgacgataagttaggccgactggggggggggagcagaatttggggggagctgggatgggtttcaagacggggcggagaattgcctggttacaaaaagggttttcgcaaaaggcaaaaaggagtggggggga

SEQ ID NO: 567030 - DNA, 1220 bp, Homo sapiens
ggacatgagtatgttcaggcttcagacgaggctcgcactctagttgtcctccgctgtgcgaagaagaaggtctggttagaccccaattgagaccagatgacaatctgcgcaatagccaactcccgtcagcagatccgagaagcgtcatcacaatgatgggtctcgatcatccgcaaggccttgtgagggtccattcccagtggctcgactgcctggtaataagacactcttgcgtcccagccgcgtaagggctatggcgacatggtgctataggtaacgcggaagtggtacatgccaaagtgctaccgagatgaaccacgaggcaacgtgtccacgacctgcgaagttgacgcgacgtacactggacgtgacgttatggcagacgcagagaattggcatcatgacacgcaatatccctgtgcacactcgtaaccgaaacgaaatgcggaattcagtcccatcgacttgcttatcgacaacgcctaggatacccgtgaaacaagggcttgacaccgggcggaaaaccatggtggctcaccacagcaacacgcgaacacagcacggggcactatacgcgtccaacctatgtgaaacaaacgaaccagcttcccaagcaaacgtgcgtaggaacaggcggcgaaaggaacccaaaaggggagcccccggcgacagacggaacagagcgctcccagttggtggacagtggaaagcctccgcaagtagggccttggcaaggggccaccacggccacaagagaggaattcatataaaagggaaagccccaaagtaggtgaaagacggagcaccaggccaactaacgtgcccggcaccacgggatggtaacacaagaaacggcacagggcgcgcaatgcaccgcacagcgggaccaccagaaacaggacaaaggaggaacaacgagcaagggaaagcttcccaggttgcccaagacgggaaacgccagccatgggcacgtacccccccacacagcgggcacaaagggcgccaacaaagcgcaatgggcaacaccgccaacgagcgagacacacagcacttaaacacagaccagcgcccggcttaccaccgccgcacaaggcagttgacataagggcacacaacagtatgggggagtagaaccaacagatataacgccaactgggcgaaccacacaatcaccattgagtagagtaacaattcaacaggccgaacgactcagtaacagt

SEQ ID NO: 567031 - DNA, 427 bp, Homo sapiens
aagagtatgtctcgatgtcttttcagatctcatgtttcctcctggattgctctctggaaaggtttagttgtttaatacttttgccatgtgcttaaagagacaaccaaattgctgcaacaaagatatgtattcaaggatgttcattgcagtattgcttatgataacaactgaaaatatcctaaataaccatcaatggaagattgagtaaatacattacagaagatgccataagataataccaaactgtccattaaaaagatgagtaggatttgtatatattgagtaggagaattattcataatatatacggtaaaaaatgtaaagaagtgaattagagaaacacatgtataatattacattgtttgtgtaaaaaaatttgagttaatacactctatgcatacaaagtatgctagaatgtattccaaac

SEQ ID NO: 567032 - DNA, 994 bp, Homo sapiens
  misc_feature (876)..(876): n is a, c, g, or t
  misc_feature (910)..(910): n is a, c, g, or t
  misc_feature (922)..(922): n is a, c, g, or t
  misc_feature (935)..(935): n is a, c, g, or t
  misc_feature (980)..(980): n is a, c, g, or t
gaactgcttccttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaaagagcaactgaagggatggttgttgctgacaagaactgttcaataaatacacttcatatctcctaatatttattgttgtggtgctgggacagctgcagacgcacagacatgacaacccagctcatttcttccaacctgggagctccactccctctccactggccgtcttcccagagttgtgacagccaatcggatgctgaaggcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgccatacacagtgcccaacaagaaggggaccaggcttggccggtacaggtgtgagaaagggactactgcagtcctcactggagaaaatcactcctctggagattgagggggctggaaagaaacagtccaaacaatggacacttcctgaatggcatcagtgggnggctggccccggttttggaaggtggtgagcattnaggcccagtaanacactcatgtggntagtgtttgccgaatgaaactcaactcaataaaaaacaaaaaccnaattgggcaggtga

SEQ ID NO: 567033 - DNA, 647 bp, Homo sapiens
gggttgtcgacatgtctccagctttcagctgtccagggtcccatgtcagatttccaggaatttgcgccctaatctttgcttgctaatcgtggttaagagctatcccactagaaactatcttaatcctaatgtcttagtccttgcctgtgagatatgaggtcttacaggagactctcagagctcccagcccgttctcctcactgctaacccttctcacaccctcaagtaggagttagataacgaggtccttgtcattctcacctcttaatggaaaatggaataagaaataatcatatcctttcttcccacccttctcctgttatttaggatttctgacaaagctggcttgagattggtcacttagagcacgactgtctcctctgccttttggttttcagcttacagagacagatcctaatatagtcccagggacatgggtctctgggagaggaaggcaagagggagggagcaaagagattggggtacgtcccctgtagtacactcgttactctctaacttcgctagactttgagttctcctggcagccaagatgttcagttctcttggcccctctctgaccccatatatgggatctggttgtcaagtgtccaggtccaatttggcaaaacacagatacagagagtgta

SEQ ID NO: 567034 - DNA, 426 bp, Homo sapiens
  misc_feature (13)..(13): n is a, c, g, or t
  misc_feature (97)..(97): n is a, c, g, or t
catgagggagctntgtgggttgatggtaatttatgtaccctgacaggggtttggtttacatagctgtattcatttgtcaaaacttatattaaatggntgcaattaatattgatgcatttcattgtatgtaaattttaccctaaaataattttagacaaattgtaaaacctagttaaagacatatatgctgatattttcagggttacctctcttgatgtctgcaacttactttgaaatgcttcaaaaggaaaataggataatggatggaaatagggagagagaaatggatcgatgtgtaaataaaacaaatctatctaaatgttaaagcttaattgtagatgatgaatgtaggagtgttgaatgttaaattctttcaacttttatgttgaaaaatcgtcataataaaatatttgaaaaatgtataaa

SEQ ID NO: 567035 - DNA, 995 bp, Homo sapiens
  misc_feature (10)..(10): n is a, c, g, or t
  misc_feature (16)..(16): n is a, c, g, or t
  misc_feature (877)..(877): n is a, c, g, or t
  misc_feature (911)..(911): n is a, c, g, or t
  misc_feature (923)..(923): n is a, c, g, or t
  misc_feature (936)..(936): n is a, c, g, or t
  misc_feature (981)..(981): n is a, c, g, or t
gaaactgctntcttgngaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaaagagcaactgaagggatggttgttgctgacaagaactgttcaataaatacacttcatatctcctaatatttattgttgtggtgctgggacagctgcagacgcacagacatgacaacccagctcatttcttccaacctgggagctccactccctctccactggccgtcttcccagagttgtgacagccaatcggatgctgaaggcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgccatacacagtgcccaacaagaaggggaccaggcttggccggtacaggtgtgagaaagggactactgcagtcctcactggagaaaatcactcctctggagattgagggggctggaaagaaacagtccaaacaatggacacttcctgaatggcatcagtgggnggctggccccggttttggaaggtggtgagcattnaggcccagtaanacactcatgtggntagtgtttgccgaatgaaactcaactcaataaaaaacaaaaaccnaattgggcaggtga

SEQ ID NO: 567036 - DNA, 852 bp, Homo sapiens
  misc_feature (852)..(852): n is a, c, g, or t
acgtgatctacattcaaaaacagtaaccccataatgcctggaacgttgaagtctctatgaccactttaaagacttttgtacatgtgagtcaaatattagatagcgacacttcgcgaaaacaacacttcatctgtgatcataataactaagtctacattgctccctattgtttgtggaatagactgtactagatggcctagtatagactagagaataacatgcatgccagattttacatcattaatacgagatgacttcgactgggagtaactcagatctatattatatatcattatcatagagcaagtagagcattcatataaaccaatagtcggcaagacttaatccaatcgatcttgctctaaacgtaatacaaaagttatagataatcccaaatcaatcgtggagtcgacgagcatgaattgttgagacttttcaatattggttcgtaattctctatatattttccgcacatacgactattaacgggacaagagtgatctagtcttataagacaacagaccaaagccaaaggctcattggtgggttgcagtggcactagtacacctcagcttgtacgttttggcgcatgcggctagcacggcacatttgcatgaaatacgtacttttgacaacccgtggggaagggcagacgggattgcaatggggaggtctcaatagtactctaggtgactctagtttgacgacattctccaaccattgttggcccaaggtatagggaaccatagaggaatcttgtgcagtcatttgattcaacacaataactaacttacaaaaaaaccaaatccaaaaatatgcacaatgtggttggcccaggaacttctaagtagn

SEQ ID NO: 567037 - DNA, 1011 bp, Homo sapiens
  misc_feature (10)..(10): n is a, c, g, or t
  misc_feature (16)..(16): n is a, c, g, or t
  misc_feature (893)..(893): n is a, c, g, or t
  misc_feature (927)..(927): n is a, c, g, or t
  misc_feature (939)..(939): n is a, c, g, or t
  misc_feature (952)..(952): n is a, c, g, or t
  misc_feature (997)..(997): n is a, c, g, or t
gaaactgctntcttgngaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaaagagcaactgaagggatggttgttgctgacaagaactgttcaataaatacacttcatatctcctaatatttattgttgtggtgctgggacagctgcagacgcacagacatgacaacccagctcatttcttccaacctgggagctccactccctctccactggccgtcttcccagagttgtgacagccaatcggatgctgaaggcagatgcttttcaggtatctagatggtctacaatatgcgtgctagtcgctctagagttacatagaggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgccatacacagtgcccaacaagaaggggaccaggcttggccggtacaggtgtgagaaagggactactgcagtcctcactggagaaaatcactcctctggagattgagggggctggaaagaaacagtccaaacaatggacacttcctgaatggcatcagtgggnggctggccccggttttggaaggtggtgagcattnaggcccagtaanacactcatgtggntagtgtttgccgaatgaaactcaactcaataaaaaacaaaaaccnaattgggcaggtga

SEQ ID NO: 567038 - DNA, 487 bp, Homo sapiens
  misc_feature (487)..(487): n is a, c, g, or t
tggggggggatagtgggtataaggataaggatggttgtgaagtatagtacggatgctactgtgtccaatgatggtaaaagggtagcttacgggtggtcctcgcgattcaggttaaaatgaggaggtctgcgcctaggaggtcaataaagtgatgggcttagggggcgaaatattatgcttggtggttgggactatatggaggagtggggattatggctaggatgaggatgcatagtaatagggcaaggacggcctcctagtttgtcagggacggatccggaaaacttggtgctaccgccgaatacggacacatcatcatcccgggcgcttgactcgtggcggcgacgcgcggcgtccccaacggcgcgtcggcgctacgcgcgtccataaactccgtcccgcgggctccgccctcagcgaaggccccgcggtgcaccaaccacgccggtcccaccgtccctctcaaccgcgaaccacgcgaaccacn

SEQ ID NO: 567039 - DNA, 884 bp, Homo sapiens
  misc_feature (10)..(10): n is a, c, g, or t
  misc_feature (16)..(16): n is a, c, g, or t
  misc_feature (766)..(766): n is a, c, g, or t
  misc_feature (800)..(800): n is a, c, g, or t
  misc_feature (812)..(812): n is a, c, g, or t
  misc_feature (825)..(825): n is a, c, g, or t
  misc_feature (870)..(870): n is a, c, g, or t
gaaactgctntcttgngaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaaagagcaactgaagggatggttgttgctgacaagaactgttcaataaatacacttcatatctcctaatatttattgttgtggtgctgggacagctgcagacgcacagacatgacaacccagctcatttcttccaacctgggagctccactccctctccactggccgtcttcccagagttgtgacagccaatcggatgctgaaggcagatgcttttcaggtatcgttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgccatacacagtgcccaacaagaaggggaccaggcttggccggtacaggtgtgagaaagggactactgcagtcctcactggagaaaatcactcctctggagattgagggggctggaaagaaacagtccaaacaatggacacttcctgaatggcatcagtgggnggctggccccggttttggaaggtggtgagcattnaggcccagtaanacactcatgtggntagtgtttgccgaatgaaactcaactcaataaaaaacaaaaaccnaattgggcaggtga

SEQ ID NO: 567040 - DNA, 108 bp, Homo sapiens
tcaaagctactccccggtggcaacccaaagttctttgtggttccgtgggggtagtatggttgccccgctcatacttaacatgtgaattgacgcgaacgccaccaccag

SEQ ID NO: 567041 - DNA, 846 bp, Homo sapiens
ccccaagaaaaagtgtacagacagctggcagtggagcctgctgttatttagtcagggcgcctggaagtgtaaacagccactggggtacaggcaccgaagaccaacatccacaggctaacacgccccttcagtgccagcacaaagaagcttcatattttctatttataagcatagaagataaacacacccaagccaagtatttgtgactgttgctctgctacctgctggtagtttatgtatatggaagcatcgtaagtactgtcaggatggggtcttcctcatagtagggcgttaggatgtctgcttgtctttttccattagttaaacattttgtttctcctttggaggaagggaatgaaacatttatggcctcaagatacgtagtacatttaaagcaccccaaatgtctctctttttttttttttttacttcccttgtcttcttccttatataacagttgaagaacagtggttttaatctgattttaaaagatcttttggctatgtaacgtgtaaagggctggttgggtatcccactgaaattgtctctgtgtggcagaccaaagtctgtttatgtcagggggatggggccatgtgcatccttagccatgtgtcacaagaatatgttggcgtagtaacttaagtcatgtaaagttgtaacgataacatacctttaaaatgggaatgcgaaagcctgtgaaaagttcgggggtcttaatgtctctgtatttatgccgtgattggtctgtctgtaactgaagtgtgggtccaagaactccctaactacttggcttctgtatccccaaagattcggcgcgtcggcactcaatctctctccggttaccaa

SEQ ID NO: 567042 - DNA, 330 bp, Homo sapiens
ggatgatgtgctgggtagagagcattgaagcccaatgccacttcccgacatgattttgcccgtaggtatttcttcatcgaaacacctttgtaatatcctttttattgcatatgaaggatgcaatatcctttttattactctgttacaccgggtcctcttttggactcctctggctggaaggaaagcgtttctctcataatttttgctccctgaacctatcacacagctctgagacttccttccttccaaagccagaagattaagggggaatataccccatctatacctgtggtcatcacgtccattcttcacgtttttatctcccttcac

SEQ ID NO: 567043 - DNA, 787 bp, Homo sapiens
ggtgaaaccccgtctctactaaaaatacaaaagttagccgggtgtggtggcacgcgcctgtggtcccagctactcaggaggctgaggcaggagaactgcttgaacctgggaggcggaggttgcagtgagccgagattgcaccactgcactccagcctgggcgacagagcaggactctctctcaaaaaaagcgacaaaaaaacaaaaacaaaaaagcatacacacacacacacacacaaatcagcatcataagggaatgtagccttccaagcagagatgatgctgttcgtatgttaatctcagagacagtatttcaagagagtggcaggtcatgtcctggtaaaattttcacaccattaggattgcagcatcaatgtggaattctgctcatctctcaatcaatccaggacagaattggcagtgtgagggcttggggtatagtggttaatccatatacaaattaggtattgaaatagtctacaggctatataaaagaacatggcttaagaagtgataaaagtgattacagatgtaggatcaagatcagggacaccatcatatacctaacaagagtacatgatactaagggtaatgtcacaacatttggtatttaccaatcttaagcttattaaccatttgtgagtaagacaaaatgttatttacagatgcttgatagtaggacaagtcgatgagggataacaatagtcacgtgttataatattcagtggggagcttaaaagatatataagaagtatgttggtaaatatataatacgtgtaatggtaacg

SEQ ID NO: 567044 - DNA, 242 bp, Homo sapiens
gatgtcccatcaatcagccaagaatactgtgcagggtgggttaaaggcctgcatgggcaggagaggctgaggttacccctggacggtaatatgtgtatgagggggaaatggtggggtcgtctgggccatagaggacattcaaggatgactgagtcgctgtgctcagcacttaatgcgttctggattcccacattcatagggtcctacgtcattccttgtggacattgagtagagtgagggtc

SEQ ID NO: 567045 - DNA, 140 bp, Homo sapiens
ttacattaacggagcgtgagttcacgtttcgcattatctgagatgttagcattagctgacgtggtgtggggactatggtacagctcatgactctgcggtatgtcgacaggactgaaactttgtcctagccccttcactat

SEQ ID NO: 567046 - DNA, 196 bp, Homo sapiens
ataaaccaagccctgtttgggttaaagcccccccttatgcccaagcttttatttgggggttgaataacgggaactattggaatcaccctcccccaatttggggggcccccggccccccggttcttatcccatttttgttttcaaatggccccccccattttcaactggtttataaataaagggaggcagaattgca

SEQ ID NO: 567047 - DNA, 561 bp, Homo sapiens
ggagccggtacccctcacggattactcaacaataagaaaacaaagaacctgatcttaagaacaggacaatgaccttaacggacacctcactaaagaagatataaagatggcgagtatgcatatgaaaaaaagtcacataatcaggaaaatgcaaattataacaataccactacacacctattagaatggccaaaacccattaacagtgacaatatcaaatgctggtgagaatgtgaacagaaactcccattcattactggtgggaatataaaatggtaccatcactttgaaagacagtttagaggtttcttgcaaaactaaaggtattcttaccatatgatccagcaactgtgttccttgctatttacccaaacgaactgaaaacttatgtccacacaaaagacacgcacacagatgtttgatgtttatagcagctttattcacgattgccaaaactagggagcaaccaagatgtccttcagtaagtaaatggacaaataaacccgggtatatccagataatagaatagtcaagtgcaaaagaaaaaaaaaagctgtcaaa

SEQ ID NO: 567048 - DNA, 653 bp, Homo sapiens
cctgggtaggcatgagcaatgcaatataggggggctcactccccaaatgaccgctcacttggccatactctgtactctaagttgaacccgacaggagccgtgagctgggtgctcaggaagtctcatgtacaaactatgcttggaatgtctgtataggaacatgcatttatattgtaggcaagaaagttgtctcctaaggctaaccctgatggccccaggatcaggccagtatttaggcgaagaactgctatagtgcattgtctatataacagaggccctacaagacctttctccaagctctaaggtcagctgcatagagagagactcggtgcgctggtgcagtcgttatatttttcatggtccaaagtgtgcttcgcggtgaatctcgtgaggtgtttgtacgaaggctactaggagtcaagtgtcaccccttgactgtccacagcttcaagccacaatctattaaccaatcatccctcatttggctcacagctctcaatggattcaattctatcctatggcttgtgcctcatcagtgttaatgacagttacaaaaggggctgggtgcggtggctcatacctgtaatcccagcacttggggtggattacctgagctcaggtgtccgagaccagcctgagcaagcaggtgaaac

SEQ ID NO: 567049 - DNA, 156 bp, Homo sapiens
atgggactcattagcaggcaggactctagcgtggtcgctttgcgcttcagtttccttgtggttgccctgggcaaagtcctcagatacagcttaagttgcaaccgtgcaaaaacacatccatatagacaaccatctaagccaccaaccaatgtcatg

SEQ ID NO: 567050 - DNA, 316 bp, Homo sapiens
tgtgctcattcccacatctcgattcctccttccaacatctcatgactcttccaacatctcatcgcctatccaccatctcatgtctccttccaacatctcatctgctccttccaacatctcatccccccttccaacatctcatcactccattccaacatctacatcgacaaccaccatctcatgtctccattccaccctctcattgccccctctccaacatctcatggacaacattccaacatcacatcaaaccttccaacatctcatacacacctaccaccatctcatgccccataccaaacatatcattgaacca

SEQ ID NO: 567051 - DNA, 921 bp, Homo sapiens
ctatacgggctaccggacacctcccatgaggcgagggtactagatatgatctggccgtcctggaactccggacctcgtacaggagaagcatctgagagcacgtaccgtgtagtgtctatgccggaccgtggctgcagcccgagtcgagatgtatcttagagtagagggacgcatagtgctgacccagcgattgctcccgggagtgggccggtgtcctttggtacctagactcgttacgtctccagtgagggtagagtagcacgctagtacatacgtcggatggcgtttgtgcccatgactggtctgccctagtgtttggggcccccgagtattggcgggtttggctgccataaacgtgttcaacgcgtgttgtgaccgtcgtctactgtctgctcgtctctctaggtctttgcaatccggtcaagttcttgttaataacgtaggagggcgtctcgcgcacgtaggcgacaccaagtgtcttgcacactaggtcgtaacctcgtcacacgtgtaggctagaggcgatagggtacgtcggcaccactttgcgtttgcctctcccggtagggagcacatcacactctattccttgctccctgtagaagccttaagccacgcgtagtcgtgtcgtctagcctttaatggggagcgcctactctagttgcgatcaacctaggtagatttctttccaattagtttcttttacccccgcgggaaccaataattcacgatatgagctaataggtgctctcaccatcttttggcgtccttggactcacctgtcccttaaatccaataagccttgtctcattatctttcataccgtattcttcgtctccaagtcccttaggctgatttggcattcatttattacgtacttagtaaggatcggaaaacttaaatcattcatctttctttcga

SEQ ID NO: 567052 - DNA, 236 bp, Homo sapiens
taacgggaagagcgaagaccgggcggagggccagagcgggagtcagtggatgtgctgcggggctcactgcacccggcagcctccccggacaggtgatcttctagcctcagtctcccgagtagccgggacgcaggcacatgccatcacacccagctaatcggtgtattgttagtagagacagggtttcactgcatgggccaggctagtcttgaactcctgacctcatgatccacctg

SEQ ID NO: 567053 - DNA, 486 bp, Homo sapiens
aaacaaacaaacaaaaaaaaaaacttaggaatatacctaaccagggagtcaaaaacctccacaaggaaaactacaaaacactgctgaaagaaatcatagacgacatgaacaaatggaaacacatcccatgctcatgatgggtacaatcaatattgtgaaaatgaccatactgccaaaagcaatctacaaattcaatgcaatccccatcaaaataccactatcattcttcacagaattagaaaaaacacttctaaaattcatatggaaccaaaaaagagcccgcatagcctaagcaagactaagcaaaaagaacaaatctggaggcatcacactacctgatttcaaactatgctataaggccatagtcaccaaaacagcatggtactggtacaaatataggcacatagaccaatggaatagaatagagaacccagaaatgaacccaaatacagccaactgatcttcgaccaaacaaacaaaaaaaaa

SEQ ID NO: 567054 - DNA, 341 bp, Homo sapiens
tggtggtgctgggcagtatgtctttttcattttcttcaaaaaacagtgtcttttgaagaacaaaaatattaaatttgatgaaattcatcagttcatcacatttttaaaaaatggttcgttttttatgtcctatctaagaaatctttgcctaatccaagatcccaaagattttctatgatttcttctatagttttacagttaagttttaagttttatagttttagttcttatatttatgtctattatccgttttgcattaatatgtgtatatggcatgaagagtcacaatttatttaattggtttgggcactggcgaggctaggacactggcgaggctagga

SEQ ID NO: 567055 - DNA, 118 bp, Homo sapiens
aggttttaaatcatttacgcgttaaggacaatccatctatagcactggttattagaaaaagacaaaaagaaagctaccaggcagtgactcatgcctgtaactccaggtacatttggga

SEQ ID NO: 567056 - DNA, 123 bp, Homo sapiens
  misc_feature (60)..(60): n is a, c, g, or t
ctttaaacatatattcacattccaagtcagtcagtgtgcccaggcaagcaggtccagctngttgtggggcaatctctcagcagtctgcacgtgccaggccatgccaagcttggccactggcct

SEQ ID NO: 567057 - DNA, 178 bp, Homo sapiens
gcggagctagcttagacacgaagtggagtttacagcttaaacctataaagcaaggatgatagtagccctacccaaaagctagaccacctttgtatttacatctgtttgtttttgtttgtttaatctcagtcagagtctcactctgtcacccaggctggactgcagtggcacgatctca

SEQ ID NO: 567058 - DNA, 5801 bp, Homo sapiens
caggcaaggcttatctggtgaaaacttttttgctatgctcagagggtaccgagtagaaaattatgacccaaaagggaccattgctttgtggtcataattttctactcggtaccctctgagcatagcaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacactacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccgccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataag

SEQ ID NO: 567059 - DNA, 531 bp, Homo sapiens
tcggacctgcttactgggcgtatggtggagtggctgtgcctctgtggctgccagtggagtggtctgtgcctccgtggccgtcagtcgagttgtctgtgcctgtcgctatatctgaatgtccatgtgtgtgtgcccatctgtgcatgtctgcgtctgtgtgtgcctgttggtgtatcactgtgtgtccgtgcgtgagtgtgccatctgtgcatgtctgtctctgtgcgcgtgctgtcactgtatctgtgtccgtgtgtgtgtgtgtgcctgtcttggtgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacacattatggag

SEQ ID NO: 567060 - DNA, 182 bp, Homo sapiens
tagcaactgggcgatgccattctgcatgtattcgccggtacggaacacaccgaagtagttctgcatgcagctttgcagctcgcgacgcagggttgctacatcttcgccatcagtgcgctcgttcagagcgttcagacgcgccagggcagcttcgatgttggcgtcggagaacgacccaccga

SEQ ID NO: 567061 - DNA, 713 bp, Homo sapiens
  misc_feature (38)..(38): n is a, c, g, or t
  misc_feature (70)..(70): n is a, c, g, or t
  misc_feature (78)..(79): n is a, c, g, or t
  misc_feature (84)..(84): n is a, c, g, or t
  misc_feature (174)..(174): n is a, c, g, or t
  misc_feature (182)..(182): n is a, c, g, or t
  misc_feature (191)..(191): n is a, c, g, or t
  misc_feature (204)..(204): n is a, c, g, or t
  misc_feature (213)..(213): n is a, c, g, or t
  misc_feature (219)..(219): n is a, c, g, or t
  misc_feature (233)..(233): n is a, c, g, or t
  misc_feature (240)..(240): n is a, c, g, or t
  misc_feature (244)..(244): n is a, c, g, or t
  misc_feature (254)..(254): n is a, c, g, or t
  misc_feature (272)..(272): n is a, c, g, or t
  misc_feature (284)..(284): n is a, c, g, or t
  misc_feature (375)..(375): n is a, c, g, or t
  misc_feature (386)..(386): n is a, c, g, or t
  misc_feature (500)..(500): n is a, c, g, or t
  misc_feature (579)..(579): n is a, c, g, or t
  misc_feature (600)..(600): n is a, c, g, or t
  misc_feature (645)..(645): n is a, c, g, or t
  misc_feature (674)..(674): n is a, c, g, or t
tgttgtttaggttttgttgttttaggtggttgctgggntgtggttgttttttatttgttggtggttgttngggttttnnaggtngttgttggtggggtttagcttaggttgggtgtggttggttaacagggttggggggggggtggtggaggtggtgttatttatattggagtnggggaacnagaggactnggaggacagaggnaggttgggncagganctgggacaggtttnggacggncggnttttttaggntgttgttgcttatttgtnggttcagggganatctgttttggggtaggactgagttgaagtgggaggagcaggtgggtgtgaagctgtagggttttacccatagtgatttcagctggtagcnaggttctaggngggtctcagataggagtcgggcacctcatcccccagctcgttgccggccaggctgagctccttcaggctctccttggccctgaggacacggcacagatccccgcagcccttggnagtgatgccacactcccagatccacagggtcctgagcctggagctggggtggagagccctggggacagctccgccatgnccacatcacccagcttgttgntgcccaggggcagctcccgcagcgagggcttggagggcacaatgncgcacaggtcccgggagttgtttgatgtnacaacggagctctccagcttgagcgccttcagctgggag

SEQ ID NO: 567062 - DNA, 409 bp, Homo sapiens
aacactgaagctgccatgcacactatgggattacgtgcatgtaactcaaaagaagtgcacgggctataagcagcttttaccgttgcgtgtttcctcatgagtcatcgtatgcgtattaactctactaattaaaaaaggtaaatcaaaaagaaataacatgtaaatattagatatgtgctctcaatatattaggagccattaaaaaaatagggaagccaggcgtggtagcacatgactgtaatcccatcactttaggaggccaagacaagaagaaatcacttgaggtcaggagtacccaaagtgctgggattataggcatgaccacaaatgtgatgggccagaaaacataatccataatggtgacagcacaactgcttatagaaaagtccaggaacttttctatgtaggc

SEQ ID NO: 567063 - DNA, 147 bp, Homo sapiens
taagagagcatggagtttgctttagatatagctgggataccttgcatagtcaagccaatggctctgataaaattggcaggtataagtatgtcccatgcaatatatgggatgtagttacactaaatttttggtttgtttgtcagtttt

SEQ ID NO: 567064 - DNA, 235 bp, Homo sapiens
ggctcactctggtgtgtgtacactaggggcacacagatcgttccagtgctcgtgtttgtgatcgtgggattgggactgaagggccagttgacacaacagtggctataagatgagatgattcttcacgttcttactcactccggtgtatgcattcttctggtgattctgatagttagagactacaggcgatcagaatccgtccgaggagatacctgccagctggatatgagagctt

SEQ ID NO: 567065 - DNA, 148 bp, Homo sapiens
acacatggaggaagaacctgctcttcagaaaacctgaaacacacagaagagatttatgactgtcacttgggaaagaatgctcaccattgacggaaacaccgtcaatgctcaccagatggaggacacgataaccagtaaacagagcatg

SEQ ID NO: 567066 - DNA, 113 bp, Homo sapiens
tctagaggatcccgaatgggtgatgcggttgagctgtggaggcgacatcacacggctggcagggtgctggatgagctgaccctggcaggaccgactggagatgcagatcgaag

SEQ ID NO: 567067 - DNA, 451 bp, Homo sapiens
cctgctcgtgggtagatagtatgaacaccccatcttagccatgttatatgcttcatgttttaaaacctctagacttgtgatatcaagtcgccacatgtggctatttaaatttaaattaacttaaaataaataaaaatttaaaattcagttcctcagttgcactagccacatttcaagtgctcagtagtcacatgttgctgctcgttaccatattggaaaacacagacatagtaaatttccatcagtgcagaaagtcctttcttcgaaacagtcctgctctgtcacggaggctgaagtgcagtggcacgatctctttacactacaacctctgcctcacaggctcaagcaattctcatccctcagcttcccgagtaaataggactacaggtgtgtgccactgtgcccagctaattttcgtatgtttagtagagatgaggtttcgtcacattgg

SEQ ID NO: 567068 - DNA, 250 bp, Homo sapiens
tagaggatcccgacgtaatatgtaaccaaactttgtctgtgtcaaaagaatacaactgaagatgtcattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatcttactaagagctaatagaaaggctaggaccaaacctatt

SEQ ID NO: 567069 - DNA, 303 bp, Homo sapiens
  misc_feature (99)..(100): n is a, c, g, or t
  misc_feature (102)..(102): n is a, c, g, or t
  misc_feature (199)..(199): n is a, c, g, or t
  misc_feature (201)..(201): n is a, c, g, or t
ggaagtggtggtactggcgtccccaaccacggccttgaagccgtcgtctgacgcgatgatgagcacctcgaagggctgcccgcgctggaaaggaacgcnncncgccgcgctcctcgcggccccatgagccttgctccttgctgttgaagaccacctccgaacggtgtccaggccgggggttgaaattgcaggtgcggcnantgagccctgctcctcccctgcacagcaggtttacatggaacctgctggcattgggaggaaccaagccgcgaattctcagcacctgtgccatggcggatcgcc

SEQ ID NO: 567070 - DNA, 307 bp, Homo sapiens
attagtgaagaagctatctctatactcctagtgagagctcgtaggtcatgcactgaggggagatgtgggaattctgagacacagatggacaggaaagacactgtagaagtaaaatagatcagaatttaccatgctgctctatgtgggcccaaaggagaaattaaaaaatgaaatgtaaattgcagtcgaggtattaaatgcctagaaaactggcaagctaatggtaccattacatggcaatggacagagagaaacgtatataagctgtagacatctggaaaatacaagtaagttaaattctttccat

SEQ ID NO: 567071 - DNA, 616 bp, Homo sapiens
  misc_feature (24)..(24): n is a, c, g, or t
  misc_feature (35)..(35): n is a, c, g, or t
cttaacggtctgttaccgggtcancccattgcttnatgctcgccatgacaatgcgaagcgtttctttccaagttgtgagggcctgtgcagacaacaggttggactgtgtccgcgagtcgatatgtgtttttgcggcgtttataagagaaatttggctggcgttcacatctagtccttttggtgtgttgagacattcaaagtgactttatacgctaaatttcaaaaaaaaagctaagcagcaggctggtcgaatgcggcgtcggctctggcaccctaccccgtcaattcaagtgggagcgcttggcgccgcctagcggttgacggtcttacgctcgtatgatcttgcgaggatcgcactactgatcggtacatgtggagagaagctgcatgaggtagtaaaagggtgttactagccaatcgcacccgagttcgtgccagtggtggtacgaatgtggtacggatttttacttgttaccccagaagccttttattgcgcggatcaacgagctagttattccaatccatcatcggagcaacagagaaggcgacggagaaagcgatggcggttggttgctataggtgaggacattaggatcttgaatggatagggcgaatg

SEQ ID NO: 567072 - DNA, 381 bp, Homo sapiens
ctgttcttcctgagaactactattggcatcacagaatgattgactctctgtccctaaaagcggatggattcttctctcggtgttgataatgcagtggcttgtttgggcagtgctttctgagactttcccaccaagagtcacccctggatgaggcaccttcatgtccactgacgggtccccctgcagcattgcccactcatactggacgatggcgtgttcatctgtgctctcgcggccgtctagaaccaccccgtctgtgggcagatgcagaaccacatcctgcccagccttgctaagtggaggcgcatccttttcctgccggggcgaggcgcgcgcggtggccagtggcgcggtccggcgcgcggctgaggctgtagctgc

SEQ ID NO: 567073 - DNA, 319 bp, Homo sapiens
  misc_feature (33)..(33): n is a, c, g, or t
aaagtaaaagtgaattaacttaagaatacattntatcaccagggtcagtggctcatgcctataatctcagcactttgggactctgaggcaggaggatcgcttgagcctaagagttcaagaccaacctggccaacatggggagatctcatctctacaaaaaatacaaacattagccaggcatggtggcatgtgcctgtggtcccagctacttgggaggctgaggtaggaggattgcttgagcccgggaggtccaggctgctttgagccatgatcatgtcactgcattccagcatgggtgacagagtgagactccatctca

SEQ ID NO: 567074 - DNA, 224 bp, Homo sapiens
  misc_feature (69)..(69): n is a, c, g, or t
  misc_feature (97)..(97): n is a, c, g, or t
  misc_feature (121)..(122): n is a, c, g, or t
ttgtgttaccgtgacctataggttatgctacaccacagccagagcatgttggatccgagccgtgtctgnagctatataccacagctcacggaacgcnggatcgttaacccactgagcgagnncagggattgaatctgcatctcatggctcctagtcggattcatttccgatgctccacgacaggaactccctctttaagggtttatggtaacaccaacagtacg

SEQ ID NO: 567075 - DNA, 191 bp, Homo sapiens
  misc_feature (178)..(179): n is a, c, g, or t
cagaccatcagatcaaagaaggaagagctgttttgggtgttttgttttttttgttttaaaagcattttgctttttcttggaatgtaattttcttatggcatgttaattggtgcacttcgtgtaacctgtttggtgagcaccctccaattggaataagttttaggaacatgccataggnnttttcctttcca

SEQ ID NO: 567076 - DNA, 853 bp, Homo sapiens
  misc_feature (853)..(853): n is a, c, g, or t
agcaaataagcttcatttgggggcattattttgcggcattttatcacagtaatattcatctcttcaatatatagaaattaagctctagaaaatgttagtctgttagtgtattctttttctttctttctttcttttttttttgagatggagtctccctctgtcacccagtctggagtgcagtggcgcaatctcggctcactgcaagctccacctcccaggttcacgccattctcctgcctcagcctcctgagtatctgggactgcaggcgcctgccaccatgcccggataatttggttttgtatttttagtaaagacgggtttcaccgtgttagcaaggatggtcttgatctcctgacctcgtgatcatcctgccttggcctcccaaagtgctgggattacagtcgtgagccaccatgcctgacctgttagtgtattctttaaactcagtgaccacaagaagatgatgttgaccttgtacccgttttccatcactaaggataacagcagtagcctccttcagagaagagctgagctggcatgataagagaagttgggaggtgatgtgaatgataaactcttactccattttacttaaagcaagtggttttaattaaacacagtttatacctttatcgctgcacttggcaagtttggggaagttaaagacctgtggtactgctactccggacagttatcttgtagaaaacagccttaagtcttttcccaacaaaatatccttttaaaattgaagtgggtcccaattccaatttaaattccctcttaaatgaactggtgcaatttccactcttatgtgggtcgatccgggagtcaaaaaatccttagaattgccgn

SEQ ID NO: 567077 - DNA, 912 bp, Homo sapiens
gagagaaggcccggaggggttctgcggtctgtagtggcgctgcttggagcccgtggcgaatgtaagctgctggttttgcggctggaaagagcggcgagagggtcggcatttttctgtcgggatccccgtcgaagcgatgagtgctggcataagagtctcacccgtcatggtggtgaacgcgttcatggcctccctcgagtactgacgaatctggtgatctacgcaatttggcgaggcagccagactcgggtacatgaagcagagaaaacaaagagttcttgagacttatgggtgcggaaagaacgaacatactggccgtcttgtaataggaagatcacaaatcaaatctcattccgaaccggggaagaagaccacgacacattacatgaagaactggaggtctcaaatatcaggcaaagtatggaacagtaaattcatcaggaagatatcggcgacattgtggacttggcttcagtgaggtagaagaccatgatggagaaggtgatgtgggctggacactgactgatgatgaccgatgatgattcacctgatcctgaaagtccagatgattccttgaaagcgattcagagtcagagaagaagaatctgtggaagaaactccaaggctggtgaagcaccctgaataagttggggatcacaaacaaaaaagatgcacacgcattttacatgctgttggtcacaccacggggtctaaccccaagctagcttggttaaaggtaccttttgttcactcccggggcgatcgtttgacgcagacctttgttatattaaaagcctttatatacaaagtgcccacgaacggacccttggcaatacacttgacgaggtgaacacaagagacgtctattaaccaacacgagcatgtggttacacacaagggggcaactatcag

SEQ ID NO: 567078 - DNA, 1033 bp, Homo sapiens
gtagctgaggtggaggcaggctgcggcagacggcgacagtggcggcggctgccatggctagggctttgctatggatccctgtctgccttgagtgatcccgggcatgacagccagagagcacagcggctcagctcctggagagtgagggttgaagaaagcggagggcagccggctgcgccctggtggctcccattaggtcggttcctgcagcggtgcccggacagccttggtgaaggccctgtcccgtgcagagatcatgtattgccgtccagatggctgctgcccgtcctcctcatccccaagctccctcagaaccacagacctgatggattcaagacattcacatgttcatgggcttctacctgctcagcttcctcctggaacggacgccttgcacaatattgtgccttggttttacctggcagacacctgtatccttaatctgctatagctgcatgggagaaactgataaacctgtaccactgctccgattccccgcttccagaatcggcagcatgatcccggcgtagtgggcacctaacggactgccctgttagctttccaaggaagcagaagacgggaggggaggcattgacataggtcaataaagcatggaagatttcaaaatcacgagagactcgggggtgttaattactgacggaacctaaaaggaactgtgatgataaatcattacaaggtgaataaatggaattgaacgaggacataaaaaggaaaaggacaaataacaggaagaggacacatgaagaagacgagacgaaggccacaaaaaagaacaggggaggcaaagaacaaacagaagactaatcaggtaagagacaggaacaccacgaaaaagcaccaaaaacggacaaataaaagaaacaggcacacagccccacagaggaacaaaaacaaaaaaaaccaaaacaaaagagaacaaaacaacaaaaaggaaaggaacacaaaaaaaaaagagaaaaagaagaagacagcacgcgagaaaggcaaacacaagcgcaaaaaaaaaaaacaa

SEQ ID NO: 567079 - DNA, 295 bp, Homo sapiens
ggggcccccacccccgcgggggggggggttttttttaacggccccccccccctttttaaggagccttttttagggggggggggggggtctttccgcccccctccgggggtgaggggggttttttaaacccaaagggggcccccccccccccaaggtttttttatttttgggggggggttccccccggggttttttcccccctttttttcttcgggggtttattaaaaataatcggggggggggttttttttttgggggggccccccaaaaaaagggggagggggttcccccccca

SEQ ID NO: 567080 - DNA, 914 bp, Homo sapiens
  misc_feature (681)..(681): n is a, c, g, or t
gcgagaccgcaccaaggaagctcctgcccgtcctttgagactgaagccagatactcaccgttgtttatcatgccactcaaggcaatgttgaacagtgttcactagaccacatcctgaagtaagagtccgaacgtacccagcttccggcggtcgaagacacttgcgacatcctgggaacttagctccagacatatcctcgggatgcattcgactccgcgaggtagaaccaaggcttggaacactatgcctatcatgaacgctttccgttgtagcattgtggtctgctcatggactactgattagaagtaacaagaccaccttgtgttcattgtgcgagtgtataagggactctacaaggctgccatattaaactggctgtgaggatacttgtatgtgcattgatgtggccagccgggttccagcgaatcccttcgccatttcgtgggaacttagaataagggccagaacgaataaggacaaagcgcccattcttggttcctcctgggaagcatttcggggggccttctcttgtttgacctttttaaacggactttgcctttcttatagggggaatccggttattggccccaacaccctttaggagattttaaggagcgcaattcgaactcccttattaaactgtcggtaggattcccgcaattcggtcgtcgcgctgcaaanttccagtccgcagattaattcaattacttgcatacggtatggtatataggtccctttggtgtacattcgcccattttctttgacaaaccaaagacttttaattacccaaaggagcccctcggaagtttggttaatacccaagttgcgcagagtgtaccagaggacaggttgatgtgatacagaagacaaattgggaacgttgggtctctttaggaaactgattggcggttact

SEQ ID NO: 567081 - DNA, 109 bp, Homo sapiens
agctccgggtcccccactaagtagctcctttaaagagacggggaaaggtgttaagcaaatctagtttggtataataaaataagaaaatagcaataaacttctttgcagc

SEQ ID NO: 567082 - DNA, 181 bp, Homo sapiens
ggatgaagctctcgtatctcccagaagctgcccaaaccctaaaatccccgagaggcacctgtcccaatccacatccttgctagggtttctattctttgctttcgtttctttctattctttcgtttctattctttactttcttctcttatctttctattctattcttccttctcttttcgtt

SEQ ID NO: 567083 - DNA, 220 bp, Homo sapiens
ctggatcacgccactgcactccagcctgggtgacagagtgagactccgtctcaaaaaaaaaaagaaagttatgtaggataagggaataatcattttttaaaaagggcaagggaggtattctggactcttgggtaagatgggcttcttactggccactacattttctctgggttaattataacttttaaaacaactggtgactcactggggggggaagggg

SEQ ID NO: 567084 - DNA, 282 bp, Homo sapiens
agctcagctgtatccattcctcctagcacagtatgtgcccttcgggttagcctatatctgcgatagagtagtgtcgaatgtctccctacatgtgtcatatcatcacaactcgtggtgccttaggcatgaactagtccatattctgtgcaaatgaagtcagttcctttgaggagacattcagcactctcttttataaggcttgcttcttcccctggacaaaatttctgagccctggtgctgatgctgggggcagagacaatggtatgcttctgtgtgacaccc

SEQ ID NO: 567085 - DNA, 230 bp, Homo sapiens
cggagcgtgcttgcctagggcgtggtgtaatcatgccagtagctatctgcttcagagtcagcttccgcatcgtcatcgtcatcctcatcatctgcgtcatcctgatcgtcctcatcctctgaggcaggggcagcagctgctggtttcatcgctgcgggttcaatttcatcttcatcctcatcctcgtcctcgtcatcctcctcatcctcctcactgtcatcatccgcctc

SEQ ID NO: 567086 - DNA, 121 bp, Homo sapiens
tgagtttcccgacctccccgggcacatatccctagcttcttgtctgcggccagtatcctctgaagtcttgggtagcgaagcgagcaggagggtactcagcgacactgccgcctggggactc

SEQ ID NO: 567087 - DNA, 1099 bp, Homo sapiens
tctttgttgggtctcggtgcctctgctatgcttccttttctcctctgcgattttctctgctctgcgtggtcgctgtcgtattctcgttcggtgtggatgtgtttcttgtgtcccggtcttccgctccttgggtcttgccgtgccgccccgggtccgtgtttgtttgcgagtggccgggtgtgcgttggtccacgacttgctcatgtcccctcccgcgggcatgtgttcattggcggtgaattcgctttcccttggccccagtcgcggccatgcccctcgggggcccatacacggggggcccggacccgccttgtgcgaggtgtggcctgtgcattcctgctcggtctctcaaagtccttgagcttggtgtccctggccatttcgggcctgagcgccttgccttgcccgttgaggatttgggtccccttgtgctacccgttgggtccaccatgcaatcccgctggctcaacaacctgggcaacgtttgcatccactgtccgccagcccttcatcgtgtccgcctcttccttcgacgtgctacccctggttgagttctacctggaggaagggatcacctgatgaagacccctctccctcatcgacctggaggtgctgagaccccagcgggatgcaccagcccagctagagattcgccaaccaccagctccccagattctcgcggctaagtggagacccaggactccctcggagatgaggaccccgttccccagctaagctgagctttgacgccaggtggctccagagttctgtgccccgtggtggtgacccggctggttctgccgctccctgagcccccgggatgtcctcatccagcgatggcccccccccctgaggtggccatacttccgctccactgctgcctgacgcctcccttaccctgtgcccctcctgcttcccagatgttcccttcttgaggactatgagttgtctggtgcttccagcctggctgctgcccctactgcccccaggtgccaggatgaccctggccccatgacccgccatcctggggacggcctgccaccctctgccccccttggggtctgctgggctgtgaaggagaataaagagtttaactgta

SEQ ID NO: 567088 - DNA, 155 bp, Homo sapiens
gacattctctactaaccacaaagacattgcatcaccataactattattctgcgcatgaactgtcagtcctaggcacagcactaaacctccttattcgacccgatctgggccagcctggcgaccttctaggtaacgaccacatctacaacgttatc

SEQ ID NO: 567089 - DNA, 300 bp, Homo sapiens
gcatggtggcacacactgtcatcctagcacttgggaggcgaggcgggtggatcacttagaggctaggagatcaagaggcgggcgggcaacacagcaaaacaccatctgctactaaaaatacaaaaaaaaattagccagacatggcggcatgcacctgtaatcccagctactcgggaggctgaggcaggacaatcacttgagcccgggagatggaggttgaagtgagctgaggtcatgacattgcactccagcgtgggcaacagaacaaggctctgtctcaacaacaacaacaaaaggatg

SEQ ID NO: 567090 - DNA, 2174 bp, Homo sapiens
  misc_feature (156)..(156): n is a, c, g, or t
  misc_feature (577)..(577): n is a, c, g, or t
  misc_feature (1340)..(1340): n is a, c, g, or t
  misc_feature (1353)..(1353): n is a, c, g, or t
  misc_feature (1403)..(1403): n is a, c, g, or t
  misc_feature (1413)..(1413): n is a, c, g, or t
  misc_feature (1500)..(1500): n is a, c, g, or t
  misc_feature (1529)..(1529): n is a, c, g, or t
  misc_feature (1533)..(1533): n is a, c, g, or t
  misc_feature (1571)..(1571): n is a, c, g, or t
  misc_feature (1762)..(1762): n is a, c, g, or t
  misc_feature (2162)..(2162): n is a, c, g, or t
  misc_feature (2169)..(2169): n is a, c, g, or t
ggtccagtgacgagcattcgctgcggctcgtgccggggtggtggacctttcagagctcggtgtgggctctcgagggcagtcatggggggcctgtgtgacgaccgtcctacgtgggggcctgctcgactagactttaagacgacgcaggcgtgtggnctgacccccaccagtacacgtatggcctggcttggactataagatagaaccaccttgcggtacagtgaagacgagagagtagagacaggctattgcggatccgaccttagttccggttggcaacagagcagctatttcctcagattgtacagtttcctaggccagggtgcgttaggagggccacgcaattactgcatatggagggagggggctctcttggcatatagtgtattgcagcgcacgcgactacgttcggattgggaagtaaacttgtgaacctgactttcgggtgtaaagcgtaagtttctacgtaaacggagggaaaccgcacacatttggttcccactctgggaatggcgcacattgatgctccgtgagagcggcgtactcttatgctttacacgtaagcaatgccgagacntgtgagagtaacttgcgggcgcaaagtttgtgccactatgcgtatgcattcccatacgggcggcattccactatttaattcgaactgcccatggatggtacctacgtaccgacttggggatgtatggcacgagttccttcgtcaagagtcaaatgtccttcaacaggagcgccgttggggcgccattgcatggcgagtggtatggacgtccccaccacagagaggggggagggaaccattgtgaaggtccttcaaatatgaagaacctacacaaagagacgtggcgtacaacgcgaatgtaccccctgcgactttaccctaaacattggagaattaagcccacgattaacattttaatttttcccaaaaagggacacttgcggattccatttgttggaacacaccaaggcgtgaaccaaacggttattataggaggcagaaaattggcgttcgacagagagcagctttgtgacgggttcggtatggagaacggcccgatatacaccagttggctcgtatttatggatagcagcagacatagcggagcagctcggggcgcacgccgatatcccgcaaccgggtatccaccacagcaggacattccgtatcagatttattagtccacgcggtagagtatcattattggacgacaagtgggttgacagcacaacacggatcctacgttacatgttcgtattggcagcgaccagccgacaagcttggtatgtcatgcgccgaacgaggatggacgacgcccgcccantataaagagatgntaacatacgagagcgagcgtgtaacaccaacccagagacagcgcgcaagngatagagttnatcacccctttattaacatcttcggacccgcaggcgtctgtgtatttcacagcacttacagacggcggggccccccccggcgtgatncgagtattatcacttattcggaccagccnaggnagacgatgagtgaccggcatgctagagcatccacgtanagaacattgaggagcagatcccctacactattgagaatagttgagacgtacgcacggtggtagagatgtgcgtcccacgcaaacagaggcaagacattacgcacggtcaacaagctagggagaaaaggtatacaacgggcgctaacgccagagcgcgggcgcaaaacatacaaataagtacacgagcgagnacagccacaccaaaacgtttgagtgagtgtaggagtagatcagctggcgagcccgcccactaccgaccaataagagaacacacaccgtgacagtgagacgtaaagctatatcatagtgaggcagcgagtacggaccactcaaaagtagaacatcaccagactgagcatcaggtagtacagacgccagagtctggcctctatatcaacagcccagcaccagaccgcttagagagtcagacgatgacgcgactaaaatttgggtaggccacagacgggtcatacactatgtagcgaatcaacgtactgcgtgtcggatagtactaaccgaacaataagcgcgactgtagtcataccattcgattctttgtttcgtttgttctcctcgttctcttctctagtnggcgggncgagc

SEQ ID NO: 567091 - DNA, 406 bp, Homo sapiens
  misc_feature (38)..(38): n is a, c, g, or t
  misc_feature (62)..(62): n is a, c, g, or t
  misc_feature (70)..(70): n is a, c, g, or t
  misc_feature (98)..(98): n is a, c, g, or t
  misc_feature (121)..(121): n is a, c, g, or t
  misc_feature (143)..(143): n is a, c, g, or t
  misc_feature (146)..(146): n is a, c, g, or t
  misc_feature (201)..(201): n is a, c, g, or t
  misc_feature (204)..(204): n is a, c, g, or t
  misc_feature (237)..(237): n is a, c, g, or t
  misc_feature (242)..(242): n is a, c, g, or t
  misc_feature (369)..(369): n is a, c, g, or t
ttgtttttgggtttggtgaattttattttgtttatggncttggtcgtgtactagtggaggangggtttgnggtggaaaatgggggtgaattgtttggngatgtgtttgaggagtttctggntgggtgtgttgttgttgatganggngggggatatttttaggtgggggggggggatgttgcatacggtcgtttttatgttnttngggatttattttatgaagtagttgttgtttttnttttntacgttgagtatttttttgtttactttttttatggacatgtgggtcggaagatggtagctaccgttagtagcggacgtggcgcgggttgtaggtgggcatctatgttcttggagtcgaacatctgcngggtgagctcgggcacgtgagaacccggtactgctgg

SEQ ID NO: 567092 - DNA, 847 bp, Homo sapiens
agcggatttagagcggcgggggcgggcgggatcactgtctggtggcgccgcgggattataacagagaaccatggcggaccatagggaatggaccccgatggtgtcatcgagataggaagatggaatgatgatgggcgattaaactttgagtgatattgagagtttaacacggacgggtctgcggcttgcgtaggcaatctagtgctggtacgggtgtggatgaatgccttcagcgtattcaggccaggagacgctactgatcctacctgttatgaaacgaggatattggatcgtgattctggcttcgcaagcgatcagcgatcacgagtagcatagagcgcaaggagcactgcacgacgactatgagctatagtcatcgcgatttcgcgttgcatcccacggctagagacagatttggagggctctcacgaagggatgaacaccacgaatgccccataagataaattgaggccacaccagatcaagacggaaccttgggctgccacatcagactcgccacagacacggaggttaccattccctagggcagcatatgagcgagaagctcactaaattggtgaaagctcaagcactattgttgcaagttgacccgttggcaattaggcggtggcgaagagccaaagaaattggagttaccagcacacaattggagaaattgctagtacacgacacatgtgcaatggggacttgaacaagcaacgtgcaacaatgaacatggggaaaggaattgagcgcacatacccacaggcggcaggacaggaaggttacgcggtacacttggctaaaaaactcgatcgcaacggtaattaacccttatgcaacccaa

SEQ ID NO: 567093 - DNA, 410 bp, Homo sapiens
  misc_feature (410)..(410): n is a, c, g, or t
gaaaggaagcgattaactattttcttccctacacactttcttgaaggtcaggagctttatcatatgaaaaagttagtattatagttcttatgtaacctgtgtgaagcagcagtccagccttacagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcatttttccccattctttttttttccctgtctccgtgacaaccagtggttcttcatttttgatcatgcgaaatgcactttgacccagatggtctgcagaacttcacttaggacaacgcgagtn

SEQ ID NO: 567094 - DNA, 616 bp, Homo sapiens
gagatcgcaccattgcactccagtctgggcaaccagagtgagatccgtctcaaaacaccacggacaccggcaaaacacacatagcattatacctcttccttgtctccaaccgccatgaaaattctgacacacctccaccaattcagtggaatacatccacaccacaccttttctcagttattcaacattacattataactgtctatatagataactagatatacttaaaaaaggcctcgggggctatataatcttcataaacagctacaatatcagtgggcagtacatttacccaacctattggtctctagatggacgacacaccttaggccatattacacctgctgtgttacgcctccaaggtgcctaaagcattgggatgcccaacaatacaagtatttgcgataaaacattaccacactagaacattggtgcacaacccatttcgttaatatggtatacaacttggcaccaaaatatttcaaaggccccgtggaataaactgtcaatattgggaactatatacatcttaactaagcattacaccagtacattgacagtgaatggatggtgacatagaacttaagtctcaatatttaaaaccctaaacactgat

SEQ ID NO: 567095 - DNA, 364 bp, Homo sapiens
ctgactatttgtggcacgtaggatgtcttggttggcttgtcagatgaactggctaaactggatgcatgagtagaaggagtggttaagaacagtagctcaatacatggctgatgtatgggagagatagcaaagacaaagttcaagagaatctgtaggctaatggagtggacttggttacttatataacaaggttccagtgggcacatggccaaatatccaatcaagcagtccctgcaaaaatatttctagaaataatagccaagggcagtacactcgagattgcatcaatgcaccgtgaactctcgcagcatctgctatacaataacctgcaaaggcaaatcttcagcaattgtggaacgaaaag

SEQ ID NO: 567096 - DNA, 109 bp, Homo sapiens
ctgctagcgtgggcttcctaagcgctgaagaggatccgcctatactgcttcatcttcagcgatgtggacctggtccccatggatgaccgcaacctataccgctccggca

SEQ ID NO: 567097 - DNA, 105 bp, Homo sapiens
gctgtgagcctcccgttccattcctggctgtatttcatcagcaaatctgctgattctatctcgccgtcttttgtttcccctattccctcaggtgtctcttgcctt

SEQ ID NO: 567098 - DNA, 347 bp, Homo sapiens
ttcaggagtaacttcagtaacaaccagagttggttccgcttagagtgccagtgaagcctccgtaatctcctgccgaagaattgtctctggcggaggaccttctggttgactgcaagcactcaattctctaaatctggtttgtacttctgccctcattttattcccttccagcgctctggcatgcgagataatccctctcttaaattccagacttcccaattgagatgaacgattattgggcttgggttggggtttataaccaatccgatcattgatcatttgttcccggctcttgggatcactgctaagcccactggctccttctccatcactaactccctaaacga

SEQ ID NO: 567099 - DNA, 785 bp, Homo sapiens
cagggaatttggtgactctgtacatgatgcttttgaacatttatcgaaaaccaagaaatacagtgatgctggctggttgcccccagcgtcactgagaaagtggtgaaaaggatgaactcagggattcgatgtctgggctgcagctctgcataaatgatctgagagtttcttagtgtgccctggatcagaatcttctctcctgtagccacagggttgaaattgtagaaaatcgagcaccagctctcacgcgattagctgagttaaaacgaaagctgagcttccaggcatgcagggcgtctgctgttaaagtgggggcacttaggccggatgccgtggttcacacctacaaccccagcatgtttgcaggccaaggtgggaggatcacttgagcctgggagtttgagaccagcctgggcaatgtagaaagactccatctctgtattacaagaaaaaaaaagtgaggacatgggtggcaaaggaagggatccttcaagttgggatggggacatgggaagcccatggccaggctggagacattgagttccaaatgatataaagttgagtcaggttgagtttagtagtgtgggcccactagcagagattatgcatttcatgttgcagtggtagagttaggaagggctctgagtctttgtttggttggtgaaacatggatcaaaaggtggccaccttaatagcgtggtggttcggctgtgatcccagcatttgggaggcgaggtgagtggatcgttgagcccaggagtcgagagaggctaagcaaatgtggg

SEQ ID NO: 567100 - DNA, 209 bp, Homo sapiens
gtagctggaggcttttcaccataagtgaagccacgtgctgtcaggtgacactgtgcagtgatgaggagatgcatggccattgaggataactgcagaatgaccaaggagcggccgcagaaggcagagaatgagcttaaggagctggaacagaagcactcgcagctgaccgaggagaagaacctgctacaggaacagcttgagacacgcga

SEQ ID NO: 567101 - DNA, 354 bp, Homo sapiens
  misc_feature (66)..(66): n is a, c, g, or t
  misc_feature (68)..(69): n is a, c, g, or t
  misc_feature (309)..(309): n is a, c, g, or t
  misc_feature (342)..(342): n is a, c, g, or t
accgtagtgctcgacaaggttccaataggtcataatcacgcacggagttccgtcccggccacggcntnngtggccaatagggtgtcgcgagtgcgtaccccgcgctctagagccccggtagtgacgtgctgaatgacggtgccgtccatcatcgggtcggagtaaggcattccgatcacgacgaggtcgacaccggtcccagtagtgcccgtagtcagtgccttcatagcatcgatcgagtgaggagctgacgggtgtccaccgggaagtaaccgacgagggccgggcggttctcttggtgggccctgnggtagacactggcgctaccggtcattccatacntcccgtgggggc

SEQ ID NO: 567102 - DNA, 111 bp, Homo sapiens
taaagatgtcaataccaaccagatggacctaggcgtggccgtgcttgccaatcttcgaagaagacatctcgacgatcttaacatggccggcctttgagcaccaccaataca

SEQ ID NO: 567103 - DNA, 148 bp, Homo sapiens
aggtcgtctagaggatcccgtagtcgatcaacgagatgacaaagagattcaacagatactgaggtagaggcctctaaagataaggaaaaagaaaagactcaaatgatcacaagttaacaagagatctgtataatggactttagtggta

SEQ ID NO: 567104 - DNA, 568 bp, Homo sapiens
  misc_feature (334)..(334): n is a, c, g, or t
  misc_feature (364)..(364): n is a, c, g, or t
  misc_feature (366)..(366): n is a, c, g, or t
  misc_feature (424)..(424): n is a, c, g, or t
tttcttattcatttttcatgttgcagttggtgcttcccgggcagcagttgaagcgggctttgttcccaataacaggcaagttggacagacgggaaaaatagaagcaccagaactttatatggctgttggaaaatctggagccatccaacatttagctgggatgaaagacagcaagacaattgggcaaattaataaagacatagaagctccaattttccaagtggcagattatggaatagttgcagatttatttaaggaggatcctgaaatgactgagaaattgaagaaaaaatgaatcaggatcatgccttaaaaagaaaacttttgttaaagnattccactgaaatcacagatatttgtgggnanaataacaatcattggaaagcatggagagctacatttcataatttgagggaaaatttcnaacagaagccagaatgcttgcccacaaaaaagctgtgtttcaaaaaaaaaaaatgtggttccaaacaattattgtttgaactttttaaattctggactaaaatctataaaaaagctttcccacagctttaaaaccaccaaaaaa

SEQ ID NO: 567105 - DNA, 134 bp, Homo sapiens
tacggtcagtggatctcacaaactctctgaggcttgcactgagggtggtgatgtgtcccatttatagtttcggttcttcagccccactgagctaaagattccattaggtttctcacaattttgtcttggtctgt

SEQ ID NO: 567106 - DNA, 829 bp, Homo sapiens
gggcgcgacctggcggcgggtctggcttgctgtttacttctcatcgggtctcacgcatgtccaggaacacagtctagaaatataatggtttgagtcttcaccctagggtagaggcatgattgaaggtatacaatggcttttggcgatcctatgctaactaattgatttgcgttctcacagacgactgagtgcctgagtgacgtacctgccaacctgacactttcgtactacgatggtgtcactgcacaagggttcacagccaattccatgaacgaactgatgtagtcatgccggcaccgcgagaaacctgtggcatagagaatgatttcttgctgaacaggaatcgactaggaggtagaaagcggtggtatcggcacgtacgcccatgctgaagtgactcttgaaaattattattccgagtaatctttggagcttggtctcccggctatcccgttgacgtggtcccgggccactcctacagcgcatcacatgcctcttcaagactactttgttctggcattcacgggatctaccatatgcaatgggcatatgtgtgagattaccccttcgcgccagaccaagatagagcttctgtgacgttctatgttggtgtggatatgggagttgacgtcttggctcagtggacgttacgaggttgctgaacaagtagatttgtagcctgtaaaggaagaatgcataggtaaactcaagacgatccagtgtggctttttgaatgaatttccggttacttctcagattttataattgaactactttgctttagaattattagggttagggaaggggcaaaggcagatggaacattaag

SEQ ID NO: 567107 - DNA, 152 bp, Homo sapiens
cccccggatattttctatgcgtgctaagataacatttatcctcgagtgagagagcttggcgtggtctgtttgatgagatttttgcttgctaagtaaatattgtaacatgttctcacagcttgcagtacagtcccttccatagaaaatctatg

SEQ ID NO: 567108 - DNA, 309 bp, Homo sapiens
ggcctttgcttaatgagcaagaggcttgtgtcctcccaagaacatgagggagttcacaagggagctatagctcacacacagaaacctgcccgctcaccccattcctcgtgactgggagcatgtctgcttagaattttttaacaggactttccctcttaaaaattcaatttgtgtccaaaatgtagtataacccttggataatgttattctttcatttccatctgttaatggacacagatgttttgctcacggatcaaaaacatcaaattccagcgcccagtggccatggtgttgcattaatctgtgcta

SEQ ID NO: 567109 - DNA, 860 bp, Homo sapiens
cccacgcgtacgctttcgaggaaggagtacttactcgccaatgatgatgaatggaaaaatacttttcagggatgaattgaaggggttcacaagtgttcaaactagtgcttgccgtagacaagggttcttctaaagacaagacagcgcaatctttgcaatgcttttcttacttgtttggtgaccgtaagtttatgtggaagattgttatttcattaggacttgagctagaaattgttgtctttctgatgtctaagacttattggtgaacaattgagctgtacagagtattcgttttgactttcaagtgtgggaacgattgggacagaacaaggaggtcttgactgtgcctgtacaatatagagacatatgaatagtcataacagtttatcaactgtgtccttggtttctgttaaagctactattgcctagaaacatagtttgaacaagctgggtcttgtgtgaggcttgtcagaattggccttcattggaacaaataatctacaagaagtatggtttaattgattgtcttacagtgactaattttcccgtggtaagcaacttgagtaagtgatatatcttatattcctaaatgtgcttacatacttgtgaaatagctctgacaaacttggaagtgtaccatttggcatattagtcttccttttatgcatgatggtaaaaatagaaagcatgtgtactggtagatttcttataaggcagcgttacccataatgtaatgcttgaatgacagtggtcatattagtaagaattatggaatcattaagtccttaatgcatcacagttcttaagggattacgatcattaagcttcttacggagtaaacaaagaaagaaacaacaaag

SEQ ID NO: 567110 - DNA, 573 bp, Homo sapiens
tggccaaacataccggggaataccttttatttttttttaacctgtggggtgatggttccaaaccataaatgtgattatagttaacacatgacccttctagcgtcccagccagtgtttttcctgacctctcttcttgggagaggaggatggaagggaggggtccggcatgctagctgggcatttggctgtgtcctgcagcccctttccgggacaccggggttcacacagcttttatagcttacataactgggtgcaagatttcctggtgtgggaagattgttggccttgaccagcctgggctgggactttaccaggcattgcaagaagcctggtaccaacacagactacagcacccaggaggtgcgatgtgtgggctggctcaggggttataacaggcctgactgctttggttcaccggattataatgagccaaaatgtttcccggggttggcgggttcagggaaggagtttgatatagcagattaaccaccctccttgtagctatgggggctaaagggttcccgggtgattcttaccaatccacaataaacatggcccatgggcatatctgcg

SEQ ID NO: 567111 - DNA, 777 bp, Homo sapiens
  misc_feature (195)..(195): n is a, c, g, or t
  misc_feature (202)..(202): n is a, c, g, or t
  misc_feature (206)..(206): n is a, c, g, or t
  misc_feature (208)..(208): n is a, c, g, or t
  misc_feature (347)..(347): n is a, c, g, or t
  misc_feature (417)..(417): n is a, c, g, or t
  misc_feature (432)..(432): n is a, c, g, or t
  misc_feature (454)..(454): n is a, c, g, or t
  misc_feature (586)..(586): n is a, c, g, or t
  misc_feature (616)..(616): n is a, c, g, or t
  misc_feature (621)..(622): n is a, c, g, or t
  misc_feature (624)..(624): n is a, c, g, or t
  misc_feature (626)..(626): n is a, c, g, or t
  misc_feature (640)..(640): n is a, c, g, or t
  misc_feature (648)..(648): n is a, c, g, or t
  misc_feature (707)..(707): n is a, c, g, or t
  misc_feature (750)..(750): n is a, c, g, or t
  misc_feature (770)..(770): n is a, c, g, or t
gaggagaattgtgtgcttgcatgagcagcagagtggagtgtgagagtgcaggatccagaggggggagaggcgggcggagtggggggctggaggtggggcctggttacttggtgacgtgcagagctctctgtggggggctgcagcgcatcttggggggagcaggactaagatgcacccgtagtgcaaaagcaacanccacatntcantnctcccggtgctttttgcggtattcctgcagcgctttctccgccacggtctccataaatttagggttcttcctggagacttctacagggaccgtgacagtgatgggatcagagtaaaagagcttgacgaccacctaagtnacaacggaaggaacgtccgagtaagaagtgtgggaagccaccgtggtgacccgcagatagtactggtctncgccttgcgtgaggnttgccagcggggacaaccagtnaaactgctcgtgcagctgcaccagcaaggaggaggtgttgagcatcttccactggtaggactttagcagcccgttgtattttctggtcaacctctcagcgacctggagggatttgtcgagctcccgccgcancttagcctgggaggggttgtaggtggaacngtccnnananaagatctcccggcnctagtaanactggtccttcaaccgcaggcagcccgtggagttgtggcggatctcccggcacaaagtncggtcatcgtcgccttctcgtatgaattctgttggcgggtgcnggaaggccgggctgtggaanttgatgt

SEQ ID NO: 567112 - DNA, 1475 bp, Homo sapiens
  misc_feature (142)..(142): n is a, c, g, or t
  misc_feature (263)..(264): n is a, c, g, or t
cttgcagtgagccgagattgcaccactgcactccagcctggccaacatagcaagactccgtctcaaaaaaaaaaaaaaaattacaaaatttagccgggcgttggtggcacattgccttgtaactcccagcttacctcagganggctgaggcaggcgacttctttgaaccctgggaaggcggagctttgcagttgacgccgagatttgcacccacttgcacttccagcccgtgggccgacagaaacgagaacctccattcttcnnaaaaaaaaaaaaacaaaatatattacaaatatttagcccgggccttgtgtgtgtggccccattgccctgtgttattctccccccttattctcggggaggccttgaggcagaggcgggaactctctttgaacacctgtggcggaggtgtggccctgttttgccagtgtgtgaagcccgagagatactccaccccctatttgggccctctcccaagctctgtggacacaaacaaggagacccgaaaacacctccggaacttccacacacaaacaccacacaaatatttccaacaccttattaagcgccaggggcgttggggggggatattcaccccctgtgttggctccccagggatatatttccgcgagagaggggctataggcgcgccaggagaaaaatcctccctttagaccccctggggcgaggggttgagagcgcgcttgcacgagagagcgcttggaaagaattcagtggcccaactgtgcacctctcacagcgctcttgtggggcaaacgagaagcgccacaatatctctccttcttctcttcaaaaaacataaaacacaaaagaggggggggggggagccggggcatactaaaaaaagatatactcccctcgaagagaaggggggcgccccaaggtgatttatagcggggggtataacccccgaggccttttctgttcgtgtgtcaccagagggtgggggccccctccttaaataggggggagagcccgcgattatattatataggcgcccttaggcggacgctgtggcggcggcggctgttttatcacccgacgcgccgttcgtcggccgcgggtcgcaacacccctcggttctgcgtcggtgggcgcactctttgtggggaggaggggacccccctcactcttccggggcggggtggcagacacatctgtgtggggcaccacattttcccctagcaggggagatttatttagggcgctctaggggcgagaaatctatacacaccttctccagcgctgctttctgtgggtgtgtaaccaacacggcgctatattgttggtcggcgtggagacaatgtcggcacccggggatgattttgagcataccggagccgcagtagtataatctcaataacgcgggctagtcaaggtgagcaggaccgagctagagcaatacagcgtgtcgttagctacgccgactccactatgacagcacgctgtcatat

SEQ ID NO: 567113 - DNA, 389 bp, Homo sapiens
actcaaaggacctggcggagcttcatatccctctaaaggagcctggtttgtactctataaacccctatcaacctcaccacgtttagctcaacctatataccgccatttccagcaaaccctgatgaaggctacgagttaaccacaagttcccacgaaaagacgttaggtcaaggcgtaacccatgaggtggcaccaaatggactccttttgctaccccggaaaactaccatagcccttataaaacttaggggtctaaggcggattcatcagtaaactgaaagtagagtgcttacttgatcagggccctgaagcgcgtacacaccgtaccgtcaccttcctcaagtatccttggaaggacatttaactaaaacccctgactcctgaaactg

SEQ ID NO: 567114 - DNA, 93 bp, Homo sapiens
cggcacgaggggatcacttgaccccaggaatttgaggttatagtgagctacgattgtaccattgcacttcagcctgggtgagaccttgtctca

SEQ ID NO: 567115 - DNA, 328 bp, Homo sapiens
ttggactactagtacggtaactttactaacaactcggggttacacctttgacaacaagtgacttattactggattctaaacctctgtagaccttaaaaaacttcctcagtagtcaatttactgacgtcttttcttcacatattctaccatttagtgtctagcttagaaaggcctcttactcaatgagattatagaggaattctcccatattttcttttactactttaacttcttttttttggcatttaaatctttaatccatctggaatttatttgggtttaaggagggaggtgaggatctagctttattttttaccagatggccagc

SEQ ID NO: 567116 - DNA, 164 bp, Homo sapiens
aggctccccaagcttttaccgctcacaacatagatcctgctgccactcaccctgtgaaatgctggatgtgacaccaccaattggagtgtacagacctgcagtctgggatcacctcaactcacaagcacagtgggttcctaatcttgaggtgccataaaacaaat

SEQ ID NO: 567117 - DNA, 212 bp, Homo sapiens
tactaccagacaaccttagccacaccctttacccaaataaagtataggcgatagaaattgaaacctcggcgcaatagatatagtaccccaaggaaagatgaaaaattataaccacgataatatagaacggcctaaccccctatacctcctccataatgaattactacgaaatacctctcgaacggagacccaccgttaagccccccgcaacc

SEQ ID NO: 567118 - DNA, 211 bp, Homo sapiens
aggttacagattctagagtttcagtctgcgactttagttgttcctggatagcaccatggaacaactgaaaagtagcaactgaaactctagacatttgtacccttcgcaataccagatgaatgcaagtgggcccatgcatggtacatgtgttccagcgtgtgcttaaagatcactattcactttacaatacatttggccagagactcacagc

SEQ ID NO: 567119 - DNA, 1126 bp, Homo sapiens
  misc_feature (32)..(32): n is a, c, g, or t
  misc_feature (66)..(66): n is a, c, g, or t
  misc_feature (68)..(68): n is a, c, g, or t
  misc_feature (574)..(574): n is a, c, g, or t
  misc_feature (785)..(785): n is a, c, g, or t
  misc_feature (836)..(837): n is a, c, g, or t
  misc_feature (862)..(862): n is a, c, g, or t
  misc_feature (865)..(865): n is a, c, g, or t
  misc_feature (898)..(898): n is a, c, g, or t
  misc_feature (909)..(909): n is a, c, g, or t
  misc_feature (1024)..(1025): n is a, c, g, or t
  misc_feature (1030)..(1031): n is a, c, g, or t
ccaccagtccttactgagcagcgatgatcaantttttatttatgagacagctggagtgctgatgtnantagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacaggacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggcaaattcaagatacaggtatccccgtttttacaacagatgttcatgcccctgcttcatgcaattcctngaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaanacatgttttatcatcctctcaaaagttggtagaactctggggaggtaaagnntggaccagtgggatttgctgatttngtntataagcacattgtccccgcagtgtttcctagncaccttttaanacaaaccttgtgacctggctgatgcacaaacagtattggcttactctgagtgtgcagtgaccactgaaaacacttcatctcaaacggggccagcactgtgtcagaatcttcacannaatanntgcctccttgcaagttgactccagaaataattcacgagtttgccaacgcttacagcctgagcaagtttccaccattcttcaagggggcttccgaa

SEQ ID NO: 567120 - DNA, 824 bp, Homo sapiens
  misc_feature (32)..(32): n is a, c, g, or t
  misc_feature (66)..(66): n is a, c, g, or t
  misc_feature (68)..(68): n is a, c, g, or t
  misc_feature (574)..(574): n is a, c, g, or t
ccaccagtccttactgagcagcgatgatcaantttttatttatgagacagctggagtgctgatgtnantagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacaggacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggcaaattcaagatacaggtatccccgtttttacaacagatgttcatgcccctgcttcatgcaattcctngaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccacccaaccagcagcaccaccagacagcagcaccaccaggacagcagaccacgc

SEQ ID NO: 567121 - DNA, 856 bp, Homo sapiens
tgggcagaaatttaaatctcgctatcttctctggctggctcaaccatggaaggaccccaattttgaaaaaaaaagctttgtgaaacacaaaacaggcggaaaaatgtgagggcccggctggcccccaagtcccccccacccgtgcattgccgcgagggcctccccagttactccccagcggaagccatcgctcatctcgccaaacaaaacagacggggctcctgcaattacaacaccgtggtccacggaatgttccacctctaactaaaaaaaagacatagcacgagtgactttttatattcacctctttcaaaaaacgtactaacttcaaaaaacaacaagaggcgccgaggagtggggcaaaaaacgtagaatgcgctatacactccatcaaagaggacaggtccagagaaggcatgagagggtaaaaaactagagccgcgcgcaagcggcccacgagcccgaccacataaggagacgtgcggcgactacccagaggcgtgacagcgggaacacggcacatcacatcgagggtgcgtgcaacacagaggccggagcaaaaccgagtacaacaagtgaaacccgtgaaccaaagggaactatggggagcccagtgacggatcgggacgctgtatcaaacgccccggaggggttaacaactcgaacccgaggagcctgctgacaaaacaggaaagccacaggggaacccgactcaagggccaatggagacatgcagctggaaacaatgcaaatactccggggaaaacaaaacattggccaaaaaccacaatgaacggataacgacgggcaaacgcccacatctagagcacgggacacccgacccaacgagaggcgc

SEQ ID NO: 567122 - DNA, 329 bp, Homo sapiens
  misc_feature (1)..(1): n is a, c, g, or t
nttgcaacaggtcagcatgaaagataaaaactattttgacgtcattattattggaggtagctatgctggcctttccgctgcgatggcattgggacgttcgctgcgaaatgttttaatcattgatagtggattgccatgcaaccggcaaacaccccattcccataatttcattactcaggatggcgaaaaacctgaggcaattgcggaaaaggccaaagcacaggttttaacctataatacggttgaatttttaagcgacctggcacttagcgctcagaaaaatggaagtacttttaccattaccgccctctcgaggggtaccgagctcg

SEQ ID NO: 567123 - DNA, 377 bp, Homo sapiens
ccctgcctgcatgtggctattgagatgtgctgtatgatacacaccagactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggacaacaggttgatgggtgcagcaaaccaccatgacacatgtttatctatatagcacctacatgttctgcacttgtatcctggaacttaaaattaggaaaaaaaaaataataaaagccaacatggcattcattactgcca

SEQ ID NO: 567124 - DNA, 555 bp, Homo sapiens
gtacccttcgaccggttctcgttcactaaggtggtcctctagtgacaggtctgtactgcatggtagctcttttccaggattctacagccgtggagtaataagtcatgccaagctctctctgctatatcccaaagtctctgcgggttagcccccaagggccatgcagcttctgtctcccaacactaagttcacttcgtgtctctcacggcagagaggaaacttagtattccttggagacctgaagggatgcagtgagcttaagaattttcaagagcttatcaatcagtcagcccttgttcatccccgagtggatgtgtggtggtattgtggtggacctttactgggcactctgccaaataactagtgtggcacttgtgctttagtccatttggctatccctttcaccctggcatttcatcaaccaaaaaaaaaaagaaaaaggaaaaactcatgtcggccccagccctgaggctacctgaccttgacaaaactctttacactctgtgtccggaaagagacaaaattgcagttggagtttaacccaaatgtggggcc

SEQ ID NO: 567125 - DNA, 148 bp, Homo sapiens
tggcaaggcttctaccgtacaaggatataggcagatgtacagaactgaaattcgaagggcgaggatggcaagaaaagcgggcaacttctatgtaccggcagaaccttggggctcactccatggatacctcggattctgatgacaaagg

SEQ ID NO: 567126 - DNA, 673 bp, Homo sapiens
  misc_feature (549)..(549): n is a, c, g, or t
tgcttgtttttgttttattttaatatttggggggggggtgcacccattttctgctagaaaaaccccaaacccacgcaacccaccagggggaggtccgtccaaaccccccccccaccccgccgggaataaaaaagaggaggccaccccgcccctggaacccgggcgaagcccaacaaagaaacacacctcgccgggccccaaacaacacccaccttaaaaaaaaaaaaggagaggcccaaagtcgaaaacaaaaaaatggcacgcttgagaaatgggcggggggggggttcccgggagggggtatgtccaggcaccacctttaaaaacacaagccaaaacaaacccctccttttgcatgaaaaaaactgcccacctctgtttgatgggggccaccacccaaatgagaaaaaaaagactacgccaatttgaagggcgggggggcgcggaatttaaccgcccctaacgtcgccccgagccatgggccaaaaagacgccacttttacccggcgagggggggagccaacacagataacaggtttcaattcaccnggcagcgccaccctggccttcttttcttatccaacccggcctcacagcggacaaagcccgccccccccaaaaaaaaaaactaaattttaattgggtccggcgggctcctcttacaccccacccc

SEQ ID NO: 567127 - DNA, 194 bp, Homo sapiens
tatgccacacctggatccacccaagtgacatcaagccatcgtcggcacagggaatgccatatggctatcgaggaggctggaaagacagttggccccagaacacagcagctgggtgcaggagctggtggcccattgctagaccagcacccacgaaaacagtgtccccgggcactgccagatcagtcggtgcacgg

SEQ ID NO: 567128 - DNA, 284 bp, Homo sapiens
actcggaataaagggtactttctcaagcttgataaagaacatcagccgggctcggtggctcacgcctgtaatcccagcactttgggaggctgaggcgggcggatcacgaagtcaggagatcgagaccatcctggctaatatggtgaaaccccatctctactaaaaatacaaaaaattagccgggcgtggtggccagtgcctgtagtcccagctactcgggaggctgaggcaggagaatagcgtgaacccgggaggctgagcttgcagtaagctgagatcgcgcc

SEQ ID NO: 567129 - DNA, 461 bp, Homo sapiens
  misc_feature (377)..(377): n is a, c, g, or t
  misc_feature (382)..(382): n is a, c, g, or t
  misc_feature (424)..(424): n is a, c, g, or t
ccattctggacatttcacacagtgcaatattataatacagggccttctgtgtctgacttctttcacatagcataatgtattcaagggtcatccacgtcatagaatgttactagcacttcatttcttttttatggctgaataatattccattgtatggatatacaacattttgtttatctgttcatcagttgatggacatttgggttgtttctgctttgttggctattataagtaatgctactttgaacattcatgtacaagttttgtgtgtacatatgttttcaatactcttgggtatacctaggagtagaattgctgggttatatggtaaccctgtgtttaactttttgaggagttgtcaaactattttccatagncagcngtaaccattttgcatttcccaccagcatgtatgagggttccnatttcttttttatctttcccaacacttgttttgcctt

SEQ ID NO: 567130 - DNA, 1301 bp, Homo sapiens
  misc_feature (430)..(430): n is a, c, g, or t
agcggaggcgtcggggctgcgccggtacaaggttccggctgtgaagatggcggtttcctagtgagtcggaggctgatcttagaaggaggtatcaggcttacaggtagagtccgaaggggaggattctggggttcccgctgttccgagtaccatctagaccaccacaggaaaccatggaaaggtgggcgagagcgccgcaggcagcctcgcacatgaatgatggacggaggacggaaagaggagcactcgaagctgagcctcggacacggactcggctcgaagtcctagaacggggctaagagcgaaccgaggcatgtgaagcgaggactacacgagcctagacagtgaggcaggactccgcagctgagggggtagacgaggttgaagagctctgctctagtaagctgagattgatgtggggatagtcctncgtaacacctgtacaaggacgccggggcctgaaggtacctaggacaagggatgctcgccactgggcgaggaccccgtgggacggctcccgaaaagtggcggcgcagcgaacacgaacgggggtcagacgtggtgcgcaacggagaaaagaaggtggagttaagtgcttgggcgtgagagcacatgtgccaggaggggacaaattgatacgacctggtcccagagaggactggaacgttccgggtatgccaaaacggaggggtactcgaaaaatactcgaaagcgaccactcgaattgttcgtacccgagcaaaaggaatgactgtagaagtacttggtttacggttgcgggaaccaaaaagacacaaaggattcgaacaatagaagccaacgaggttttggcacatggatggttgggtgaaaccgaatggaccaccgggccctggctggtcatgggaccttggaaccctttccggaaacccccccgggagaaaggccttcctgattaaggcttgggcccttccttaattggaaattcctgggacagaacgggggccctttcccagtggtttgcacaacccattttacaaatttccttgggacaacgggacacttttcttcaagggcccttcatatcccaacggcctaagaaaaaacatcgttggaagcctttcacggggctccaccaaaggaacgaaaccggttggcaagaaccgggaattgtccccaagcagcccacttattggtgtgtggtcccggcacccaatcacttggggtcattacgacggctcggtcacaactctttatggcacaaggcacacaaagatttcctcccattggaacgggtgacgcccctatggataagagcacta

SEQ ID NO: 567131 - DNA, 879 bp, Homo sapiens
  misc_feature (456)..(456): n is a, c, g, or t
agactcgatcggcaggacttgtacaccttgaggagtactgcaacctgaattcggatcgcctttgcaggctcgaacgctagtgcacgatgagcctgatttccaggcatggactcacctagggactagagctctagacgcatgacgctagtgttgacccgcagaatagaagttcagtagggcaaatagatccactggaagagccttgcgcggcagaattaggataatagtagcgctacagggcatcgcatgatggattgatatcgacggcatggtatagctggacctcaatctggtattcctttcggtgcactcactgtacttgtcgtacgtactctaagcgaatagcgggaagtcagagctccccatgctagaaggacacccccgaaatcacgtggtgaggtgccctaaggacacgtcctaaaaggacgcacacccagctcatatggtagcgcatantagtgggcaggatccataagtgatagaggcggatcatacatattggtgaggcctatggaggggtaagcatgagcagtccagggatacaatgtcgtgaccgctattcagactggtacctattgtgccccccgagaaaccgtctgaagtccccttggtaaattggcacagctgctatgttccagttgatggatacacgaggtactctgcgttcactatgggaacctaatcttggcgtgggagtctggaatttaatcactccatagtaggccaagggtgcggtcacctttgaagtaaatacgttcaatgttcaaggagccaatactggagaaatcccaagtataatggactcctgacctgcgaatttggcagggatctttgccttttggaaaaccaatggggggtattcacctgtaccgaatgcgc

SEQ ID NO: 567132 - DNA, 526 bp, Homo sapiens
  misc_feature (251)..(251): n is a, c, g, or t
gctcctgcccctcctaagctgtagcccaagcgaaggcttttataggcccagaaggcacgtgttgaaaggtgtccccagcccccaaaagaagaagatccgcacgtcagcccccctttccggcggccgaagacaactgcgactccggagacagccccaatatcctcggagagagcgctccccggagaaacacagcttgacccctatgctatcatcaagtttctcgctgacccctgagtctgcccctgaagaangatagaagacacaccaacacacattgtgttccattgtgggatgttataagccccaccagcgacccagatttaaccggctgtgaagaagctgtatgaccattgatgtggcccaggtcccacaccctgattcggcctgatggagagaagaaggcatatgttcgactggctcctgattacgatgctttggatgttgcccaccaaattggggtcatctaaactgagtcccgctgcctaattctgaaaataaaaaaaaatatatcttttcacccaatata

SEQ ID NO: 567133 - DNA, 136 bp, Homo sapiens
  misc_feature (75)..(76): n is a, c, g, or t
  misc_feature (108)..(108): n is a, c, g, or t
caattacctcattaagccataaataaaattataacaaacctgagaacaaaatgaacgattatctgttgcttcatnnatgcccccgcaatcctaggcataccgccgcantactgatcattctatttccccctctatt

SEQ ID NO: 567134 - DNA, 319 bp, Homo sapiens
  misc_feature (18)..(18): n is a, c, g, or t
  misc_feature (229)..(229): n is a, c, g, or t
ggtccgggagttccaagncccagccctggcccaaccatggtgaaaccccccatcctcctacctaaaaatacaaacaattaactgagccatagtggtgggcaccctataatacccagctactccggaggctgaggcaggagaatcgcttgaacccaggaggcagaggttgcagtgagctgagatcgcgccactgcactctagccggagtgacagagtaagactctgtctnaaaaataaataaataaataaataaataaataaataaataaataaataaataaaaaataataatacaagttttcataagcacaaaaaaaaa

SEQ ID NO: 567135 - DNA, 148 bp, Homo sapiens
tcgcggtgctgctggcatgccagatcattcctcagttctacctggatattttaccctcacttctgcttagagtagcagcaaacgaaagccttgtagaggaaactgaatgtctataaaaagcatctatgggttaaacttcccctactgg

SEQ ID NO: 567136 - DNA, 125 bp, Homo sapiens
atgatattctattcgctacacattctccgatccgtcctacaactaggaggcgtccttgccttttctttccatctcacctgcatatcccatcctccttttccaacaacaaggctaattttggccct

SEQ ID NO: 567137 - DNA, 417 bp, Homo sapiens
ctgactctagagatctgtcacagctgcgatggtctgagatgcgcacgaggaggaattgttagtcacatcagagctctgactgtgtagctaacatgggatcgtcaccggggtgggggaatcgattccattctgctatttggaaattctgccgatggatgtcctctaacataatgccttctcctgatgtcatgaccagccttcggcccatactctctgtagtccacgggcttcacgtccatcacagtggccttaattcgagactcgtcgttgtaggtctccactttgaccctgactctgaatatgaaagatcggaagttggcatactggaaaacttcttcaaatgcctgttcattcttgtcttttaattccccaagataagcagcattttgtccaagtgatagctttcaggcagaactc

SEQ ID NO: 567138 - DNA, 853 bp, Homo sapiens
  misc_feature (3)..(4): n is a, c, g, or t
  misc_feature (6)..(6): n is a, c, g, or t
  misc_feature (82)..(82): n is a, c, g, or t
  misc_feature (123)..(123): n is a, c, g, or t
  misc_feature (409)..(409): n is a, c, g, or t
  misc_feature (731)..(731): n is a, c, g, or t
  misc_feature (777)..(777): n is a, c, g, or t
  misc_feature (815)..(815): n is a, c, g, or t
  misc_feature (853)..(853): n is a, c, g, or t
tcnncncgagagaacgtgagaacttcaatggtccccgctgcgctcgcgtacgtcgatcgcgagccacaggggcgcgcagagnggacgtagagaccatgacgcgacaggagacagccgagcgantaaagagagaagtgggagataggactcgtactgagccgagagtaacagagccgggaatgagttagtgatgtgtatcttagagcatcaatgcgccaacatcgatcgcagtagccggaacagcagaactgtacttcgaactacataatgaacccacaatacacctggacactacgatacatacctcgaacatgaaaatggaaataagaaagagagtatatagaagagagaacataagaaacgcaatgcatccgcgtcccacctttttctccccccgcccccgccgatnggtcgtgttgacaagaggtgagtctcatcacgtaacaccacatccgcagaaacccgaacaaacgacccctccgacccgcaccaacccgctactcccgcgcgctgacgcactggagctatgcacactacgacgtgatgtactcgacctgagtgtgtgcagcgctacaatccgggagcggtaagcgctcggagagtgatgatattatatagaaggagaagacatgacgatgaatgagtagtagaggtgaggataggagtgtgaaggttgagagagagagaaggggtactgtaaatatataatacgtatctaggtgaatggttantgatcgatataaatcagtatataatacgcgtccgtactaagcgcgnatgcgatgacagagcgcctcagctgtcccatctacacncacgcacgcacaccgaagacaccaggagaagatgaagn

SEQ ID NO: 567139 - DNA, 900 bp, Homo sapiens
aatggcagtgatgagtggagctcagacctccaccgtccacagctcaagagcaagatgacgttctcgatagttgattcagatgaatgtaagattctgtcccggtaatgccgacgatcagtgagagacatacgagaagccgcgaagaaggaaataagactgatgcatacagagcaatctcaggtgacatgagagggtccacgctactagtaacagtagaggcacaggagcttgcactgatgctcagtacgcgaggtaaggaatgtgatagcagtacatagtggcccctcgtaagagctagcagaacctctcaattagcgtaatctgtagatctatatgtcttggggctcatgtataccctaaggactgtgagttagtgggatcccatttctgatgttacgcggattgggggcgagagatgacacatttgtagctacacgggcgatgatctgtaccactcatgtagtgccaacacgttggaggtcgatcgatgacgcctacgacgcgagattctttggaataggaaagcccatcttgtccagtatcgtctcgtggccggtaccgaaatcagtggctgtaggtcacacatcaatttctggcctgatggctacgttcgccgagtggcgaatttatcggaacacaccgggtcaaggtgacctgtaacttaggcttcgttgtgtagaaaagacgacgtgccgccttgtctggaaccaagccaggaccatgggtggagtggataggtctaccctaaagtgcgccatgggctccaagtggcaaggcactttacgatgcaaaccaacacacagaacacagcttgccaacttggctttgagccccttatgtagtctagacagtggggttacagaacataacctcccccggattaggggggttatcttcaaa

SEQ ID NO: 567140 - DNA, 86 bp, Homo sapiens
gcttggcgaaaacccccccaaggctgggaatgtatgtttttataatttgtttttttaaatattaaaaataaaatgttaaactttca

SEQ ID NO: 567141 - DNA, 513 bp, Homo sapiens
ccgctaaacgtatagaacacagattatttattttttatcttatttttagaatgagtgttttttatttttattttttgagacagagtctggctctgtagcccaggctggaatgcagtggcgtaatctcagctctctgcaacctccacctcctgggctcaagccatcctcccacctcagcctcccaagtagctgggactacaggcatgcaccaccaccccggctaatttttgtatttttagtagagatggggtttctccatgttggtcaggctgatctcgaactgccagccacaggtgatctgcccgtcttggcctcccaaactgttgggattacaggcatgagccaccatgcccggcctatttttctaatttctactttgcattattgctggtctttttccctctgtatgaagtagattctattttcagagcccttcttcctttatctaaactgtttcatgtccaattcaatttttacctcctcaatgaaatttttgcattctgcacctcctgt

SEQ ID NO: 567142 - DNA, 98 bp, Homo sapiens
tcgagctcgcacccctaggtagactaacccatgtagacctccaggttaagccatgcagttacaaagtagttagaaatctctgaaggggtgtgagagtt

SEQ ID NO: 567143 - DNA, 594 bp, Homo sapiens
gggtggcaccaccctgagttgctggcagtgagtctgttccaagttccagtgagggaggcatccacccacttggggcttctgtccaaggtaaggagcacctgtgagtctaactgccaggctctgatgggggtctcgtctctgtgggactagaaagtcccaacaatctgaccaaggtaataagagtcagacaagaaaaagagttaaagaaacatgaggctgacaaagacagagaccagagtcagaatcagagctgtgctgtgagacagaaagataaaaaaaataaaatgctggccacaaaagtcaggaaaatcagaaaacttaaatagtacctggcaacaaaagaaagcttttggctgaagatcaatgtgttaaagagataacaaaaggggtgctaacacagaagctgagtccttaaaagagtccggtggcctacctgttgaagcagctaaaaaagagactgtgtttcatactcctccaccgaccagtgcaaaacaagctaaaaagttcctgggcactgcgggcttttgcagattgtggattccagttttgctgagttaaagagataaacagcccttcgtatagaagaaaaaaaaa

SEQ ID NO: 567144 - DNA, 1071 bp, Homo sapiens
ccttcattgacctcaactacatggtttacatgtaccaatatgattccacccatggcaaattccatggcaccgacaaggctgagaacgggaagcttgatcatcaactggaaatcacatcaccatcttccagagagcgagatcccatccaaaatcacgatggggcagatgctgacgctgagtacgtcgtggagtccaactggacgtctatacaacaccatggcagataggctggagagactccattatgacacgggagggagacacaacagcagggatcactcaatctctgcacacccatcatgcctgatgcacacaccatgattacgtccatgcggatgatgaaccaccatgagcacagtatgaccacaacagccctccacagcactcattgagacaactgccactaccatgcaacgacaacacaaaaacatgcatataagccaacccccctgagcccacaaggatacatcgcagatgaacaaagctataggctacttcgctgagaaaggcactccaatgcacccaacaaagactacaaatgtgcccaattcaatcagatgtcaccacccgcacagaaaaagtcaacatggctggagaaattgagaccacctattccatctggtaaacacactatgatatacgcacgattaaagctgagccacggcagagcagacgccatcacaatcacaacagcaatacaaacatcaacatcaccacagatgaaaccatcataagcattgtgacagaccatggacaccccaaaagagaagagttgactacagcgggaccaaaaaagacgatcaccagtaccaacactagtctaaagaccactggacatataccggggagaaaacaagaaacatacaaaacgtagggacacacattgagcacaccctaatcacacgaactgaatcacccacaccacaagtatggaccacaacacgaaactatataataaccaacgaatagcagcatcaggcgacaccacaatggcaaaccccgatggaaccccgagaccgtcaactgacactacgaaaaaacaccaattggaccccacaagaaaacatgcaa

SEQ ID NO: 567145 - DNA, 671 bp, Homo sapiens
  misc_feature (583)..(583): n is a, c, g, or t
gggttaaaggggccatcatacatttattaccaacaacccttttaactccaaaattgggcccagggattaaaaataaaaattcattgcccttcttagtaaagcatttctagtaactttcataaaaaatgtccaaactttgttaaaaatttatcaagccttcaaaagattgggttcccgatatttataatacatacatttaaaactatttgttaactgatccaatggaatatgatttgagaaaatgactcagcaaatgattccaaaaaacacccctgtgagctttcacaatctgaaacggcaaaatggggtcaccaaatgtcccaacagggggacaaacaaacaggtttttaatgaaaaggccccaagataatttgggaaaaattttttcacaaggggggtggtagatctcatttcaaaatattctaagaggccccaatttaaaaattttaacccaaaacattttagaaaggttttaaaacttaattgccttcaccatttcaaaatttgttcaaaaatttaggcgcggaaatcctatttgggaacttggtccctggggggcctattttttttaggggtcggggtntaaaaaacacccaagatggcacttttgcgcaaaaaacaacccggaacccccacaaaaccccccgttgggtttaaatggtaaacccctt

SEQ ID NO: 567146 - DNA, 163 bp, Homo sapiens
tttttttccattgaaggtattatttatttgcagctcatcttaagtgacaaaattccatacagaagactataacagaaataatttataataaatatactcaatacttcatatagagatactatggatactcgtagtcggtgtgaggacaacgaatgcactgata

SEQ ID NO: 567147 - DNA, 268 bp, Homo sapiens
gctctagaggatctgtacactgggttcgagttcaggagttcgggatcagctgacaacgtgttgtggccccgtctctactaaaaatacaaaaattagccgggcatggtggcgcgctgctgtagtgccagctattcagtgaggctgaggcggaagaatagtttgaacccgggaggcggagtgctgcagtgagcccgggatcggtgccacctgcactccagcctgtgcaaacagagtgagactccaatctccgaaacacccaatcagtagc

SEQ ID NO: 567148 - DNA, 438 bp, Homo sapiens
tgactagaccgtgtattccgtgaacgaccgatcgaaggactcgaaagaaggcaacatggtgtctcattgacctgacttatgatccccgctaacgcttatcaacggaaagcccccgcctcaggtagtccagtcataccggatcaaaccaacgtacatatagatgtctcatgtctccctaaagcgtatttaaaaaaagctgtaccccgatcaccttgggcacctgtcgtcaggacctcctgaggctgtgtcacagccgcgtccttagccttggcaaaatgagacctgtcagatattttgggttcacaatacccacattctttggtaaaaagaatcaatatttttttaatgtatacattcaaacaaatcaggtaacctatcagtttcatgtgtgtgtgtgtgtgtgtgtgtgtgtcaatagtctctggaacactgcgtcct

SEQ ID NO: 567149 - DNA, 1042 bp, Homo sapiens
agtgcctgagagctgacatgtccccgtgctgtgctcagtgctggagctgtgcctgtgtgctgctgtttttcttgatgtcctgggggtggcctgtgcagcctgtgcctgatggactgaggtgtctggctgtgggtgcttgccccctgtggtttgtgtgccctgctcatgctggtgagcctggtgcggttgagtggagacctgctgttgtgcgctcctgcgagctgcttgcgttgctttgctttgcttgcctgcctggctggatcctgtgggaccctggggctcggtgctgtagtgcctggcgttggcctggctgctgtgctgtgggtgcctggggcttgccctggatgagctgtcattttgtggctgggtcaaactgcctggggttgagagactggctgcatttgttgggaacctgttgccactgtggattcgcacttttcgctgcaaatgggacccccgttttgagaaaggtggccctgtgagttgggtggccgtgatggccacttcaggaagcttattgtgcatttgagaaccttgccaaactctcttgctgatatccaaaaccccttgaggtgagccagaattccgtgtaatacaaaaactggatgctggggtcacaacatgatgtgatgacctttttgggcatagcgaaaatgttggcccaatcaaacagatggacgggggtggactaacggttgcttgggtctattgaaaattttggcagaagggtcataaagttttggcaacaatggtcccaagcaaaaaagggtaatttgggaatgtagctgattttgaatttgtgccacggtctgttggttggaagtgaattggggatattctttggaatcgatgtttggggcattagcaaagcatccacgattgagattttaacttaattagcatcaagaacaggggcaagctggagtgtccagggggcaaggtgtcccaccttcactgggaaactctacgcattgagttggccaggggttccatacaaatcccaaggttttgacgtctagtatgctggcaaatggttctgaca

SEQ ID NO: 567150 - DNA, 276 bp, Homo sapiens
gggggaccccctgggggggggtggggcccccttgggggttttttcccccccggggccgggggggcggggggggattttttttacccccgttaatttttttttaacggtttttttggggccccggttttggggaacccccgcccccctttttttttgggtttgtgggaaaaattttttttttgggggggaattttgggggggggggggggggggggggggtttttttttttttttttttcctttggggccgggccccataattggccccccctttta

SEQ ID NO: 567151 - DNA, 631 bp, Homo sapiens
  misc_feature (455)..(455): n is a, c, g, or t
  misc_feature (470)..(470): n is a, c, g, or t
  misc_feature (474)..(474): n is a, c, g, or t
  misc_feature (476)..(476): n is a, c, g, or t
  misc_feature (486)..(486): n is a, c, g, or t
  misc_feature (494)..(494): n is a, c, g, or t
  misc_feature (499)..(499): n is a, c, g, or t
  misc_feature (503)..(503): n is a, c, g, or t
  misc_feature (505)..(505): n is a, c, g, or t
  misc_feature (513)..(513): n is a, c, g, or t
  misc_feature (533)..(533): n is a, c, g, or t
  misc_feature (537)..(537): n is a, c, g, or t
gggccgccccctacaacctggaggccggccagggcgactacgcgtgcgcccgccgcctacgactacttccccgccgcgcccccgccgcatcgctacccctacctcgtcacagggataaccagccctcatcccagggtctacaaaatccaaagccggaccgttcaccggcaacttgccacctctatcctggttgtaagaggctttcccctcctccagggttgggtgcttgcagaattgctccacctcctggggatcttcctggccatcatccttctccccctttggtgtcatttgctgttttgccttgaggaagcgacgatgccccaactgtggagccaccttcgcttaaagggaacaccaggcccggctttcctacacccagctctctttttctaatgtaaatgttgtgtacaatagttttatttgattaagcttcaggactgttttgtaaagcnaggtgggaccgatgnggcncncgccagctgnggtttccnggagngtgnanaggcaggnctgctgctcccgcccgaggntcangacaactcaataaagccctgcttttattttttgcagttttcaatttgaaaaaggtgagaaataatgttttcaataaatgagattcatcccctta

SEQ ID NO: 567152 - DNA, 155 bp, Homo sapiens
  misc_feature (41)..(41): n is a, c, g, or t
  misc_feature (46)..(46): n is a, c, g, or t
  misc_feature (154)..(154): n is a, c, g, or t
catgagcatagaggtaaaaatctgcaacaaaatattagcanattanatccaacaatgcacacaaaaaaattaaacactgtgaccatgtggaatttattccaggaatgaagggatggttcattatttgaaaatctatcaggataatccaccacant

SEQ ID NO: 567153 - DNA, 888 bp, Homo sapiens
  misc_feature (888)..(888): n is a, c, g, or t
gaatgtgtggtcggggaattcatgtggaggtcagagtggtaaagcaagtgtgtgagagggtcccagctacgacggaaatgtggctgccacatcgtgtttgaggtccattgatcaagtttggctggccttatgtgttgcaggaggcgtggtgaactctgccttatataatgtggatgctgggcgcacgagctgtcatctttgaccgattccagtggaggtgcgggacattgtgagtaaggggaagggactcatatttctcatcccgtgttgtacatgaaagcaagttatctttgactgcctgtctcgaccacgtttactgtggcagtcatcagtggtagcaccgatgaactagaatgtcaacatcacactgcgccttcctcttccggactgtgtctgccagccagtttcctcgcatctgcaccaggatcggagaggactatgatgagcgtgtgctgccgtcgattagaaactgagatcctcatgtcagtggtggctcgctatgatgcgtggagaatgttaattgacccagagtgaggtgttctccaggcatggtgagcgaggatcgttacagagggagcgtccacctttgggctcaatctggtgacgtgtccttgaagtctgacttcggagggtcacagtagggcggaggcatcaatggttccgctggaattagagggcagtcggttggactgtggggcctgaaagggcgagtcctggggggaccaggaggtgtgtggcacctggccagcggaggcgttgacggcccggagagaagcgacgcgccctcggcacggaaaaaacgcggggaacccgcctggcaccgccgggtggcacgcaaactccgcgccattttgtgggtcaaaagccccggggtggcggcccggcacn

SEQ ID NO: 567154 - DNA, 894 bp, Homo sapiens
atgtaagcaataatttttccgtgtcttatgagtatggctagcgatatatttattacatgctagatgggttctttgcatgtgggttccatataggtgcaggaaatttcctcagccactggagggatttcgacctatatttgtcatttggatgagctgttattagattgaaatctagacatcatttcattaaaaattgtgccttagaaaacgcaaagctgttgcgcatggcgatgaattatggatgcagtacatggaagagagatgaagtcacttgcaagtttgcaagacttctcatggaggtgtttgctgttttacaggaaaaaataaaaatagagaggaatgaaaggaagatgaaagttagaaagacaaattgtttgaaaagtgtacagatcaagtccaatatttgattatccaggcctgcatgtttgtattagatattttgatgatgtggatgtgtacacgttgcatgatatgagcagagtaccactagtaatggcaaaaggatgtacaatatggtcattcataagcgatttgatagaatactttttacatgtgcattccatccgttatgtaaggattacgtgaattttggcatcccttctggtttcacgaacccattatacatattcttagtgaaggctcatgtccatgtttggaggtgaatcgagtcagaaattaggcccatttccagggaagtgctttcctaatgaactagttcagcgatagtccacattctcaatctaatggacagtcattattggtttcctggggcggacagggtggcggaaactgtgtcaaggaagagggacctcaattggcgcaaaatcgccgattatttaaggggtgggcaattccacacaatgtcctcattacgtgtgcaaatactaccatccg

SEQ ID NO: 567155 - DNA, 437 bp, Homo sapiens
ggtctaaaaaccccggtgccaaagtccttcttaactgaggtaaaaccttaacaaatagggaatttggcagggaacacacctgggtaattcagaaccctatttatatccggttaaaatttaaggtcctgtagtttatataaaagtcggatgttaaaatattatatttcagtactagaagcttctttgcagtcattaacatgccaaattaagtaataaatataaaagtgattgtccataaattatcattgaatttttgtgtttatttggaagtgttcggtatttatctgccctttgggtatatatccccccatacatatgccaacatgtaaataacctcatgtttattcctaatttaaattgccccaatatttttaaggtatggttaccctgtgttttaaattcctttaaaaataaactttgtaagcagattttaattt

SEQ ID NO: 567156 - DNA, 243 bp, Homo sapiens
atcgaccagtgcactgacgatgccagtcacggggccacaaggtatgctgacctgtggtcctcacatgacaaagatgctggacaacccctcaaaggacagggatgtgaggttacaaaatcattaaacacggagagtaaccgagcagagggtaggataggagctgatgcctcggagaatcaacgccagccgagacagttaggaggccctaggctctgaattaaatacaatactcttgaggggtac

SEQ ID NO: 567157 - DNA, 241 bp, Homo sapiens
tgaattctgcatgtcgattcctagagtatccccgcgatggataccttcactatgtaatcccagcactttttgggaggcagaggccggttggatcacaaggtcatgacttcgagaaccctttgcgctaacatggcgaaaccccgtctctaaaaaataaaaaaattagccaggcgtggtggtgggtgcctgtagtcccagctactcgggaggctgaggtaggagaatggtgtgaacccacgag

SEQ ID NO: 567158 - DNA, 724 bp, Homo sapiens
cactctgttcttccgtcgctccgccgttcgcgtttctctgccggatcggaatggagagaagagatcgccgacgctggtcattgacaatggctccggcatgtgcaaagctggttttgctggggactgacgactccccgagcgcgtgtttccttccatcgtcgggcgccccagatcaaccaggggcgtcatggttgggctatgggcttcataaaggactcctacgtgggctgacgaggcaccagtagcaagcgtggctatccatgaccctgtaagtaccccattgagcatggctatcgtctaacaacttgggactgactatggagaagatctggcactacacctttctacaacgatgctgtcgcgtggatcccggaggagcatcccagtgctgctgaccgagggaccccctgaaccgccaaggacaacagagagaagatgactcatgattatgttctcgagaccttcaatcaacccgtgacatgttacgtggtccatcgcagtgccgtgctgtctctctacgtccatctgggcgcaccaacatggcattgtctatggtactctggagacggggtcatgcgcacatcggtgtcgccatctactgagggctacgcccatccccacacgccatcctgtcgtctggtagctggctgggcgggagctgaacgactaccgtcatgaagatcctcactgagcgaggctacagcgttcatctacacgagcgagc

SEQ ID NO: 567159 - DNA, 318 bp, Homo sapiens
caaactttccctcatctttctgtcttcttctgagccctccaaactgttccaacttctgcctgttacccagttccaaagttactttcacattttcagaaatatttatagcaattgcccactccctctaccaattttctgtattagtctgttctcacattgctatgaactaactgaaactgggtaatttatttaaaaaggcttaattggctcattgtactggggctgtacaagcttctgcttctgggtaagcctcaggaaacttacaatcatggttgaaggtgaaagggaaacaagtacatattcacatggccatcagga

SEQ ID NO: 567160 - DNA, 151 bp, Homo sapiens
gtgataggcctgccgtggcttagaggggcgctgtattccaggacgtcgagttagtcagcccaccctcctctgcctcaaggctgtcctggcttgcatcaccagtctccagcatgcgccaggtgttctgccagatgcaggaacttccacaact

SEQ ID NO: 567161 - DNA, 256 bp, Homo sapiens
gcgcaataacatgtcaacccgctgccgcatcgtgccgcggccggaggcgaccgccccgtgattttcctgcatggattgggagatactgggcacggatggccgaagcttttgcaggtatcagaggtgcacatatcaaatatatctgccgcatgcgcttgttaggcctgttacattaaatatgaacgtggctatccttcatggtttgatatatgggctttcacagatcacagaggataatctggattaacagcagcag

SEQ ID NO: 567162 - DNA, 268 bp, Homo sapiens
ggctctaacggcggcagattgaagacccagaggactagcttatcgtggctcgttgaagtcacactttgcaattcttgttgttgctgtcgcatactgggcctgtctcgggggacatttactctgtattgtccccgtctttcccatcgtctagcgtttggggaggaacaggcagagagcttcggggcgtctgtctccgtgctctcctgtctccaccgtcttggttttgcttcctgctggatgctgggctcctgttgcgacccgggctgtg

SEQ ID NO: 567163 - DNA, 179 bp, Homo sapiens
ctccacactacgggcctgtttgtgcctcatattactgatctactggagtgactgtggattctctgatgctacatagtgccttagcttcttcgtgctttagttccctctgtgtgcagacaaaaatctcatccctcacctcctgatttattaagttctccaggaatattttcctgatgtta

SEQ ID NO: 567164 - DNA, 959 bp, Homo sapiens
gggcccgggaaccgagtagaagaaagcatcaaaatcccccagtgatgtaaacatttctgctcaagcagctctattcaaattttataagtccagttagaacctgaagtatttaatagtttggttaagaatcatgaaagacgtccagaaaaatactgtgaaagttttatattcatgaagaagaagagagtgtgctctgtaaaggaaataaaggaatatcttatcaaattaggcaatacagaatgtcatcctgaacagtatttggaaagaagatcaaaattagataaactattgagttattattcaaaatgaagacattgcaggtttcattcacaagatacctggcttggtgactttaacagaagctcccctgtgttagttttgctggtgtcgatagcctggatgatgttaaaaatcatacatacaatgaattatttgtatctggaggttttatcgtatctgatgaatcaatgctaaacccagaggtggtcacagttgagaaccttaaaaattttgtgacattccttgaggaacttagtactccagaaggaacagatggcaatggaaagtccactgtaaatttcagaagaacataaaggaagtaggcagattgaatggctaaagctctaagtctgttgacgcttctgaatgtctaatcagcaagacaacatctggtcgacaatccgtcataccacaattgggattcccaaaactcgaaatgctccagaattggctcgccttatcagacttcagggtcagcacatacagcaacgacacagtagcctttaacagacggaagaactcgcggaaggccaccaggtatacggatcacggagaacggagttgacccggctggcgcccgccggcacaagcctcgaaacccgggggccatcccacctcccacgcaaaaaactcaccaaccagcgcacagcaaactgcgacaccgcaacgccacgacccac

SEQ ID NO: 567165 - DNA, 181 bp, Homo sapiens
  misc_feature (10)..(10): n is a, c, g, or t
  misc_feature (23)..(23): n is a, c, g, or t
  misc_feature (59)..(59): n is a, c, g, or t
  misc_feature (71)..(71): n is a, c, g, or t
agaaatgtgnattaatatatacnacttactgctataaaatataaacccctggaggaaanaaagttagcccncaggagttttcactttccccagcagttctagatattaaaagagggtttatggaacacgttttttgtgttttgttttgtttttttttttgagacagagcaagactctgtct

SEQ ID NO: 567166 - DNA, 257 bp, Homo sapiens
gatacacattctgggataaccctcagtacctgatcaagctggaggaggaggattaggacgaggaggatggggagagcggctgcaccttcctggttggggctcattcagaagcaccgagcggacggcagaggaagcatgggcgatgcacatgcacaccatcgtgctttggcatctatgtaggttccacgaggagttaagtggcgctgaccaacatccactctcagcaagtgacttcttcctgcacgagatcgcgccag

SEQ ID NO: 567167 - DNA, 1367 bp, Homo sapiens
tttgaaaataaagctgttatgggtgtcattcaggaaaaaaacaacaacaacaacaacaacaacaaaaaaaaaaaaaaaaaaaaaaaaaaacaacaacaaaaaaaaaacacagaccaacacaacaagcaacacacgaaaaacagaaaacacaaagaacgagaaaacagacacgacaacacaacaacccagaggaaacaacgacatgaagcgccacgggaaacacgaagtgagcagagaagacaaaaaaaaaaaccagccccacagacacgacacgcacaacacgcagacaccacagacagaaagaaggagaaaaggaaccacaccaccgaaagacgagagcggagccggccgggtggagacaaacggagggagaaggcgcgggagaccaaggcgaagagaggggccgagccgaccgcaagcacgaccgacgaagaagagaaaaaaaaggaaagaagggagcggcgggacagaacaagcggaagagcagaagaagggagagacaaaaacgcgcaggcgaagcagcggcacagagcacgaacggaagaccgcaaaacaacaacaggaggaacgaaaagaaacccacgaacacgagaaacaggcacgagaagcgaagaggagacacgaagagaagaacacagacgagaacaaaagcgagaagaaaagaaggagaagagaggacgaggggaagagaggcaagaggcaggacgaagaagggcagaacgcgcggaggagacggaagcacagcaccccgcaggtaccaaacgggaagccgagagcaagagagaggcacagagcacacgcacccaacaagacagctgcagcggagaggcgcacccggagcgcggagcaagaagggaggaggagggcaagaaaggccagaggaggcgaggcgcaagaggaggagagagacagcaaaagagcgcagagaagaccagaaagcgaagcggcgcgggcggagggcagggcaagagcgacacgacaggagggacggagcggcggaggcaggaaagcgacgagcaccggagcgagcgacagagaagggggcgagaacggggcagggacaacagcacgacacagcggaaggggcgagagcagggcgcgagcgagaggggcacggcgaggaacagcggccgaaagagacgcgtagacgagggagagcgagcggccagggacgaccaggagaagaggggcagaggaagaagacagaggcagccgagcgcgcacagcgagcacggcaggcggcggagcagaagaaagcgacgacacacgagaaacggaagacggccagaagggaagagacgcacacggagcgcacaacacgcacgccaaacagcacacgaacgagggcgagacagagaacagagcaa

SEQ ID NO: 567168 - DNA, 439 bp, Homo sapiens
ccaagggttctggaggtgcttgcgtaatacatgagtcattcttggctcaaacaaactccttgttttgtttggttttttttactagagacaaggtctctcactcacatcacccaggcgggaaggcaggggcatcatcacagctcacggcagcctcaacttcccaggtgcagggtgattctctcacctcagcctcccaagtagctggggacgacaggcatgcagaaccaggcccggctacttcttggtagagaccggatttgggcatgttgcccaggcggttcttgaactccggggctcaaatgatctgtccagcttggtctcccaaagggtggggatcccagatgtgacgccatggtgccggctccaactctttaatatttaactatccctaggtaaatctctaaaggatcctaaattctttcccctatattagacccca

SEQ ID NO: 567169 - DNA, 898 bp, Homo sapiens
cttgtagtggttgttcgtagaggatctgttcatttgttcggtccgtggggggctgagttgtcgtcctcgtggtgttgtatgcgcttgtcccccccgcgttgtccctcagttctcatctggctggcggtgggttggtttgactcccttgagtcgtcgctcgcagatgtgccagggggcagcgcgtttcgtcttctcgcgtgtcaccggggtgagtttctctcgtgcacccgccctcgtgggtgccggccttgcttctgtgcggagaagcctcgctgtggcgccctggggatgtgtcgcgcgccggttttgggtaacaacggccggtttgttcccctctgcacccatggggtgtccccccttttctgctctcccttttttgcggaggtgtgttcttcctcctgaggtgtcttgggctcccgagggggcgtcctttctcatgaacggttggccccaccgttggggcagtcgttttctgttagagagtaggtctgctgcttctcgcactgtctgctggtgaacagtctggtcgcgcccgccggagttggttctcgtcttctgctgcacacgcccgccaggtacatgatgtgggcgtcgcctcgctctcttgctgcagcaccggttggtgtcgctgtcgcctttcttcctcacaattgtgtaaatggtgccctatctccctgctcccgtggatttccgccccacccgcccttcgcttgttttaaccctaccgggccagtcgactctgtaagtgcggatctcacatatagcgcgcggtgacggtggctccacgccgacgctgagccgcgcgcggcgaactccagctggagacgctggagcgcggccgccactaaacattcgctattggcagacaccacccgagttcacaaaccaccatcatgca

SEQ ID NO: 567170 - DNA, 146 bp, Homo sapiens
  misc_feature (60)..(60): n is a, c, g, or t
aaaattatgctgagtgctacaacttctcagtgatggagacactgcagcactgagtccagntggcatggtgactgtcattgatggagacacgggggagaatgccaggtgcagctctcagtggagcaggacacacggtgacttctgtt

SEQ ID NO: 567171 - DNA, 111 bp, Homo sapiens
acacttgattttattctgtgacactgagttgctgaaacccccccatttcctgggcagaggagggcagaagggcccaccctccaggggggtctgcctcccagcaggactggg

SEQ ID NO: 567172 - DNA, 209 bp, Homo sapiens
caggtcgtgtactatcagcactttgggaggcaaggcaggcggatcacttgaggcaggagtttgagaacagcctagcaacaatacagaaatacaaaaattacgcaagcgtagtggtgcacgcctgtggtagaggatgacacatcgcttgtaacccaggaacctgggatgggtacccgagctcgaaattccgtcattccatgggtcatagc

SEQ ID NO: 567173 - DNA, 119 bp, Homo sapiens
gaggattcgttggctgccgtccccgctgctgtccattgggttaaaaacgacaccaacatcagccatttaaaatccaagttgcagcagtacttgcccaagcatcatcaattaaggtgtta

SEQ ID NO: 567174 - DNA, 339 bp, Homo sapiens
accatatccgctttcttctatctttgttaatctcttaagcaaaggtgtccctgtgctacatccttggttttctctcctgtgaatgcgctttccttccttactatattgcaaactatgagtttttcaagttgttctgctctattcctcttttctctagcagtttacaataagaaattagaagcaaccacacaacattctgagaactttgttatgtaaaatttcttctgccagatatcctagttcatcactcttaagtttggccttccacaaacccctcaggcatggtcacagttcagccaagttcttggccagtttatagcaaggatggcccttgcttcc

SEQ ID NO: 567175 - DNA, 806 bp, Homo sapiens
gagcggtgcgggcggttgggtcgtggtgggggcggcggccgcggaaggccaggccggtgccctgcggggacgcccagcgcagcccagccccgcgcagcccagccctgccctgccctgcccatgcgccatgaccctgcgcccggcggcgcgcccacctgcgccgcatccatgttctgacagcacacacccaaatctggccaggagacacagccaaagcagctccccagtcgtccgagaaaacggactgcagcatccatgccacccacagccgtgccccacactagagccaagagaccaaggcaccacttcggtggacggaacgggactcacgagtacggctccgtcatggacgacacgggtagggagtagccctggtgaccacgccaggcacaccgagacggcgctaggagcacgcccaggaaacattcactcacatgcacacacagaaacgaacagatcgcacgcagctgtgtacactgtactgcctgatgaccccgacgttagtacagccaagacggtaactgacggcactttcgcgcgaaacatgttccagcaggacctacccccgaagacacagacacgcctccattggtggcattactccctgacgacccatgtcagcgtgaagcatccctgctaccaggggcgcgacctcctaacactactcctgaagaacgttggactctagccttcctacagccagatacatcttcgcagctggagagaaccactgaatctccaatcccagatgaaaggacactggcatggtctgacgaaagggagcacgacaggcgcaagctgatcac

SEQ ID NO: 567176 - DNA, 273 bp, Homo sapiens
agtactgatatggggctagattatgtcatgtaagtcatcgtaggcctgcttgtagtgaaatgccttgggttacttctgggactcagaagtggaaaggtgagagtcctagttttatggctagggccaagggttattatggtaattgctactgggttgactattttggtaatggtcccattggccagcacatcatcaggcaggttaatgcatgcatggctattcattagtatcatggaggctgtggcttgtgttcggaacatatttggtggggtc

SEQ ID NO: 567177 - DNA, 925 bp, Homo sapiens
tcgcggtcgtggttccccttcggggggggttatttacggttttgtggcagcgtgtttgtttaccgggggcggccgcggttccagttgatggaagacacgggggtctgacagagcgaggggatgaggtctttagagtttagagggagtagctgttctctgtaatgcgggggcgccgtgggtgtcggggacgttggacagagaactgaaagtgtcaacgcctcagggtttgaaatctcggcgttcacagttttttggggggaaaggccggtttaccccacagccggtggggccccgagggatatttctggggcccgcccacatgtgattatgggcccccgctggttgttttttgtgagtctgtcgggatttattcgccataggccggatgttcccttccctccccaggggcccgcgatttgcgtatactgaggaagtgtccctttacccggggttggtaatcccggcggccaccttcgatcgccgccatatgtagcccaatttgtggaaaccaccggcccatttgggagagttctgttattttggagcaccgctgtttcgccccagcattatattcattaggttggactttgcagaatctaccaatgaggtcttgccaccgaactccccgcccttgtacactttttcccccaactttagccaagtagatatcttgagacccctaaacttcttgggctgttctttttaacatccccaagcggatatagaaaaccctttcagatttttcatctgaaatgttcttgcagcattgcttcttctatccaataccctattttaccctacagaaatttgttgcacaggcagataatccgttatttagtaccccttttatttccattcttttaaactgccaaacccatctgtttcatgtccccacgactttaaattaatttacaagtttttttga

SEQ ID NO: 567178 - DNA, 403 bp, Homo sapiens
gcagagtaagggctccccctcatcatagtacttatcacaccacattgtaattacccatttccctatctgtttcttcctctacatcaagtgcatctcagcgtcaaggaccacgttaggccgcttctgcattcctagcgtctagcacagtgcttggtgtgtgaaaatgcaccgagctatgcccttagggcgtgcacacattcctgtctgctgaatgagtgtggactgggcacggtgttgtcccgtggttgcggaggacatacaggggaagagggggccaggaggaccgacaggtgccactccttccactgctgccactccttccactgctggagcccccagtcctgttgccctgggtgcccctttccctccatcctctctgctaaggcgccccctaagtggcaga

SEQ ID NO: 567179 - DNA, 897 bp, Homo sapiens
gtagccacccaccaaaaggaataatggctgaaaaagcggtgtctacagttttcagcacgcatgtctggttccatagtccttctcctgatgggctgggctgtgggctgcatcataatgattgatagtttgtctgctctctgaggaaagggcaagaggaagatgatcatgatggagatacccatagtaggaacgaattgattgtagaagtattggaacgatgtactggatggatctatagattgtcctgcaggtatcaatagccgaatgtcgggatgttgtgaccatcgattggttacaaaacatgtgggtctataaaggggcacttgggtatgcatagaagaatttgtgtccaggacaagtaaggaaaatttatggagtgaatttcgtcattgatattctgagcgtggagagagagatggtttgagattggtggagtgaaacaatggcatgtccattgacaggaacaaggtttgtatagaagtgtttgatgcactgtttgactttgaatatattgatcgccgccgtgttccctctgtaataaagaggtaatagcagaaaggtgtggcgtgtagggctgtggcaagggtgggtgttcatggccttggtagtgcgcaggtaatttgtgaggatccctttgagcccgaggaaatgggggcgatcattgcctaggtgatagaagaggagaaacggattctctatgactgagatgcacttttgtcagaggtggtttggcgcaatcatgggttgagtaacgaaatgaggagttcgtggaaaagaatctgggttgtgagtttgctattgttcatggcttgtgtgcagggggggaggtgtgattcaaatggcggggggcattggggtcttttcagggggaagggtaggcgggggcaataataagaa

SEQ ID NO: 567180 - DNA, 1881 bp, Homo sapiens
ctacctgccttctgtgtcgctcgccaatcctatagccaccagtcgaactagacaagctgagactgacgttcatgtgcctcgtttgtctagcttgtcgtctgttcttctgcttttcttctgtgcttgcctgcctctgtaggcgttgcaccattgaggtgctgtgctgccgctgtgttgcgtggtggtgtgctcgtcccccagctctctcttctgtgtgtgggatgtgctttcgtctcctctatcggtctggttgacctaccttccttgttagattcacgctgttcttcgtgtcgggcagcctttctctcccagcgctcgtcctccagggggtgatcgctctctcgtgcgcctgctcgtaggcgtccgtccttcgttcgttcgctcctctattatgttggtgtgtcgtgggcgtccactctctcagtagagcgcggtgggtgcctcagcaaacctcggtgggtttttttctcgtgcgacgtactcaccgctaagtgttacccccggcgggcttggtcctcttgcacctagcgattctccctatgacgagggtttcgcttccccccccccttgggggcggcctcccgtgccctccttcgtgtgtgggttgctcctaggctttccttgctttctctcctcctcgccccctatggggcgtccccaactgtaagctcccgctcgtttgtgatcccgtgccgggggtctctcccacctatcgcactgggggggcgcctgcaccgccgtggggccccaccgcctgtgtccgcagcagcgcacaaatatgtgtggtgggttgtctcgtccactcctcaccgcggggttgttttccgtccccgaggtgcttctgaggggcccccccgttcgccactatcgggcccccccccggcccccaagaaatgcgcttgtttttttgaccggcgaggtctcccactgccaccggagatgtctgcgggtttgcccaattttgtgcgcctggccacaatggtggcggtttatatattgcgtaggtagaaataatagggaggattatttgtggcgtccccccactacgggcaccaaatatatcgcgcacagcacacacccctcgtcgtcacatgtggctactggcccgctctcatccggaggacaccttcttcgtgtagaaatcaatactgccgccccgtttcgtcgcagaaaatacaataaaacaatgttggcgtccctcctctgagagagcgctctgagtatattcgtcgaattatattgcacgcacactcttcgtgagattcgtgtaagaagacacatctcgtgtttgttgctcgagatgttgtggaaccccctcgatatatgtgagaaggtctaaaaacgtcgggttgtcccccacactgggtgatatgtagaacacgcgcggttatcacggggcgctcgtaagtatgtctttctcggcgagtttttctctttatagagaggctcggccccacagagatcccacactgtgtgtgttgttgtgtgtgtggcgggagtgtcttttgtcacagacgtcttgggagaaagttcctcactcgcccgctgttggacacccccactggtgtgtctctcttttgtgtatagctgtgagtgtttgtctctttgggcccgagacaacccgctggggctctgttaacttgcttttgagagttggagaacgcgtgttgcactttaacgcctcgtgtaatgtgagtgtgcacctattctgtgaaattataggtgaaaggtgtttttttggtgaaccgccatttcttcgagtttctttgaaagaagatagacccaccaattttggttttttactgttatgtgagacacctttaggcccccagccacacgtccttgtgtaagggaaaattaaagatgcttccgtaaccccaa

SEQ ID NO: 567181 - DNA, 198 bp, Homo sapiens
ccaagcattctgcaccacgtcaaggctcctgcaggcagggtccccagcgtcacctgttgcggagagaagaaaggcggttcagaggctggtactcccctacagctagccttgggtcattcggccctctaggagtgaccctagtgacttcccctgggagccgcattttcaatatctggaaaatgggctcaatgcaaaggt

SEQ ID NO: 567182 - DNA, 947 bp, Homo sapiens
ctcagctctctgatcctgctctttcttcatgatacttagtctgcaggcatattaagatcatcccagaggttcaggcagtcctgtcatctctgaaaaaactggggatatgaaatcttccccctacccacttaatgcgtcgcgatatgatcttttcaacagaatgcttcatgcccaaaataccagcctgtcttagcagtgtctacacttgtttgatctgcgggcactttgttgcattgcttggccccaatattcagggctccatgactaagactggtctcctcagatgccctgctttacacttcaggggccactctcatggctcccacaggggcgtcactgctcgcgccttgcagcaccctaacctcacttggaactccagagcagcgcaatccgttgcgaaaaaccaaagatgctaaactaccgcctaaagccccttattttcatgtcctgaagataaaccctggtcttcgatacccatatcctccagagacgaaacactatctctgcgcgcaaggaggcacgcaacatttgttcccttgcctcctcccaccccttggaagcacatggcagcacggccacacagcctcggccttgccatgtggccacgcgtcgcctcaggtccgtctgatggtgtcggcgccgggacatcaccgggttgctaccctccctccttgggagctctgattccgtgagtccgctggctccccgctctgccgtacggtgcccccggcactcgggtctcctttccgagccactcatccttccgcgcggcacacgtgtgtccggccgcacgagccactcctctttccgatatctcctcaccccgaacaggtttcttcgctcccccgtgtgtacgccctttcccgtgctcctgcacccgactctccctgcgagcgccccacaccgcgcgtagggtattctgcggccggggacggcccggcctgtag

SEQ ID NO: 567183 - DNA, 921 bp, Homo sapiens
tgcgtgttggcaagaacccaggacgttgttctgggtggttcccaggtacaacccccccaatgatggaggaaacccccgggggggcccaaaacaagcctgcccggcagggagcgcccaccccggcagggcggtcctggaccgcccgcagtttggcccccaacgcaggggagcccccatagctttgatgcccttggatgctgcggagaaaacagatgaccaagtggtgtgcgcacccgccgggaggaagcaagccgcagatcacgcaccaccccgtgggcacccccgcggcatgttgagccacccgggtggctttctctctccgccgaagagtggccactccgcggcgtcattgtttgggccaggacaccaaggagggctccgcacgcacgcacgcctatagcggagctcattccagcacgggagagcgcacacccaccgctgcaacacacgaccgcatagtgtggtggggagacacacagcagagccgccgcctggtgggtactcacccactaagaccgcctcctccagggcggtggggtgcagggccacaccagcggcgcctcgaacaggctacacgtagttctgcggagaatgtacgggaggagagaatacagtctctccggtgagagcatgacggggagatacgcacagagcgattcatcgcgctttacaccaacgcccccacggcgcgagccccgcacccgcgcggcaccgcacacccgcctgcagcgccgggtcagtgcagggacgcaccacaacgagtgctgtgggtgccaacacgcgcaggcccaccgcacggggggcgagctgggagggcggcgcgggagcaccacagggcgcacccgaccaagcaatgcttcatgggcgcgcgcggccttgccagaagaaaagaagaagagaaccggggagaatcaatgaaca

SEQ ID NO: 567184 - DNA, 154 bp, Homo sapiens
gacgttctctacaaaccacaacgacattgcatcaccataccaattattctgcgcttgagctgtattcctaggcacagcactatacttccttattcgagccgatctgggccagccaggcaaccttctaggtaacgaccacatctacaacgttatc

SEQ ID NO: 567185 - DNA, 631 bp, Homo sapiens
actacttatgtatctctgcctgtttacatggtgtttcggaaactccttccttcatttgttctttcactcatcaagtaattattgatctctgctatatgcctaggtattatactagatgcttccaagtttgcttagacctttctgtctccctctctccttcctgctcctccatggtttggtagctaaactggccctagagaaacaagatgctgtcacctacttgactaaaagtcttgtcactgctcagatactctgaatactgctgatggtatggaactgctcatagtatttatcttctttgatatgactactacctgggttggatccaagttaatgccatgtcttcaaacactcatctgtaagtagtggccattctctctgagtggcaacccttttccacattagtcacctggcttcttctagtcctgttacaatccctatttgtaaggcccacattaaactcccagtaagcagctgattatgaccattccattcatttctgaatctccatgtcattaccctcatcaaaacagggctgactacaaaaaggataaaaaagtctcacgtgaggttttgaaggcaaatttctgtactaaagcttctctacagtcttaaagtcccaatgcttaaa

SEQ ID NO: 567186 - DNA, 385 bp, Homo sapiens
  misc_feature (274)..(274): n is a, c, g, or t
  misc_feature (330)..(331): n is a, c, g, or t
tgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttaagtagagagtgggtttcactatgttggccaggctggtctggaacgcctgacctcaagtgatccgtccgcctcggccttccaaagttctgggattacaggcgtgacaaccngccgcccggccctgagtgagtcttaatcccgtggccatctgcgttcctgcaggctnncatctggccctaatggtcccctggcatcatggctgccctcagattcctttgtga

SEQ ID NO: 567187 - DNA, 150 bp, Homo sapiens
  misc_feature (50)..(50): n is a, c, g, or t
tgtattctcaatagttggattggttggaaacaattgaaccattgacaggnctttatcatggcgaggtggctgtgcaaagagaaacaacaggcatactatgtttggtaatgaagtataaagtcgttgtaggggtactcgaagtctcgcaat

SEQ ID NO: 567188 - DNA, 270 bp, Homo sapiens
ctacacatctacagatatgcaatattccaatacgaatgtgggaattactcatgagacaacagaatatcttaattatgcagagtgctggttccagcaacatgatagatagatgctttaagttgcactctgacgaaagctggcctctgaaatcttaatgcagaattgggctgcaaccatggacgaccttacaagggtaaaagagaccctagataataattctgtgacttctccacttcaagctcttcaacagagaacatggctcattcagtg

SEQ ID NO: 567189 - DNA, 859 bp, Homo sapiens
ggcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgcttt

SEQ ID NO: 567190 - DNA, 391 bp, Homo sapiens
  misc_feature (84)..(84): n is a, c, g, or t
  misc_feature (103)..(103): n is a, c, g, or t
  misc_feature (160)..(160): n is a, c, g, or t
aaaatatttttcataaatgaataaatctggtcatattccatcttctttctttaatgtagttctcttattattttttgtttgccntcctcttttcccactgctncctctctcctgcttattggcatcgcttctgcctatgtaatcatgctatagaccaaancatgtattcttttatactttgtatttaccctcagataatcatatacggatgtgaatgcatatacacatattaacatattggtgtataataaaatgttctaggccgggcgcggtggttcacacctgtaatcccagcactttgcggggcagaggcgggcggatcacgaggtcaggagatggagaccatcctggctaacatggtgaaaccccgtctctactaaaaatacaacaa

SEQ ID NO: 567191 - DNA, 1274 bp, Homo sapiens
cgcccggccaggtggaggcgggtgcggcgacctggccggctcctagaggcgcagcgggagaggaagtgtcagtttgtgaacctgcagcggcccctggcctggcccctggccgggcgggcggggacctcgcagcgccgggcgagccaggtggcagggagaggacaggcattcagaccgcatcccctgcccgggagcctgtgcgctctgcgctggagaaaaaggagatgggagtgggggtggagaaggtcgtggccacgccaccatctggggagccgagacccctgcagtgcctggctcgccccagggccccgcacatacttagcttcacacactccctggcacaatgccgtagacatcatcctgcccagtctcacaggagtacacacacgcaccacacagaaacaggcactggactctctccctgtgaacagatagtcacaacaccaggtgcccagcgccatggccacaaggaggagacccgagtaggcccgcggggaaagagagaggctgtgtgtggctgtagtggagagcatgtggagggacttggagccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgcttt

SEQ ID NO: 567192 - DNA, 1310 bp, Homo sapiens
ggcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgcaaaaaaaaaaaaaacaaaaaaaaaaaaaaaataggtggggcgcgcgcgcccgcgggcccctcggaagaagagcttttctcagagaacccactgcgcgtggtggggcgcgcgcggggcaccccagtgggtgtatagggtgacaagtggggccaaaacgcgcgggttccccaaagagagaagactccgggggccactggagacaaaagggcgcgggggagatctctccccccaatatataaaaaagagccccgcggggggggcaaaaacccgcagagagcgcgtctcccgtgaaacaaacactctccgagagagggggagttcgctggagggggcgctcaacatcgcagcggggagacctccatactcaaccaggaggagagtctccacagaggggaaagcccgcgaattacccaaaaattagagcgcc

SEQ ID NO: 567193 - DNA, 307 bp, Homo sapiens
ccgcaggctggggcttggcacgccatcccatcaccaacgctcacagtgctggaggaggatgaacagaagcctggtgccctgcgagtcccataacagctcagagacctgtggcctcccccctctggtccagacctatgtgctccccggggacccacgagcagtttccatccccgcccctatcccagtctggcaccagcgatcaggtcctttgtgggcggctccctgtgcagccccacgagcccgggcccagggcactatctccgctgtgactccgctctgcccctcttggcgggcctcaccccccgcc

SEQ ID NO: 567194 - DNA, 173 bp, Homo sapiens
ctaggttaccacacactactttttgattgggaatgctgaaccatttgagaggagatgttcggcttctgatttcgcaaaggcaaaaaaaaataggataggcttcccttgtgcagagggagaaatggctttgatcttgccaagcctttaaatggagccctgaggcatgagctatt

SEQ ID NO: 567195 - DNA, 299 bp, Homo sapiens
aatgtgttagaaaaatgttaagagcaactcacatttttatcattttctgtggttttagccaagatggcttttatgtttctgaagcatgtccacaaggtccaagattgaagtttttggaggcaagtgcactcaaggcactctggtagtcatcaggttatgtttcagagatatactccagtcacactgcttacccatatctacctttctgaaatttacctagttgaatcttcacacttctgaatctttccataacccccaagttcaggtgtggtgtagtattttttaaaaaggaacactaa

SEQ ID NO: 567196 - DNA, 1117 bp, Homo sapiens
ccacgcgtcggacagcacatggcggatggcaagaacaagcgcctacgaaaggcggcaaaaagggagccaagaagaaagtggttgatccattttctaagcaacagcattggtcatgcatgtgaacagcacctgctcatgttcaatcataagcaacatcattggacagcacgctcgtcaccaggcacccaaggaaccaaacattgcatctgcatggtctcatagggtcgtgtgtttgcaagtgcagtcttgctgcatttgccagcaatgcatgcacagtagccatttcagcacaacaattccaagctgcattcactgcaagcatgcttccagggtcaacacaacctgccatgactcacactttccatggacatggaatcttacccagtgacaaaactgtgattcaccatggctcaaaacaatggacagacacactgcattgaacagctcacgtatgcatgtcaagacgtaccgactggttaacttgccctcgatcctgatacatgactgataggaataatacatcacaacacacacggccaacaacactcaggaataacgagacagcagcaacctataatgacctcacgaagaaccacacaaggataccgcacaagaatccaggccagacagcttgcattggggaacacatcccagtgaacccccgaaagcacaggatgacaacgcaccaaccacgcaaccttgcgcacaaaagaacaagctgaggatcacattacaacatagggaaatctcccgagacacgcagatcactccggaggaacacaagcacccatcagccaaacgaacgaggccatcagcgccacagagacctagagtaacaagtcaccattcgatacataccggaacttgactccttcccggattcaggaacacaacagcgtacgacacgaatcggcccggaaacgcacaactcccccacaaggcatcctcacccaactggacgggcaccaagcctccaaacggccacgacagtcccaaaacgtagcggacaccgcggccacggcatgagaaaccaaggtggaacgcaccaggccgcgacctggggcgacacaacaacgcaacacggaagtgcgataaaaaaggtactgcacaacacgag

SEQ ID NO: 567197 - DNA, 192 bp, Homo sapiens
  misc_feature (20)..(20): n is a, c, g, or t
agtctaaaggatccccccgncccggtgttgcgctcacacaacacacacacgagcacacagcacacaaacgcacagcacacgcacacacatgcacacacagcacactagcacacagcacacacacaaagacacagcacacacatgcacacacagcacacacacgcgaacacagcacacacgagcgcaacaccg

SEQ ID NO: 567198 - DNA, 120 bp, Homo sapiens
ggactgcgttctaacacggacgaccagtgtcttcccatcaggccttgcgctgggcctcagtgaccctggagtctctggttcgagcccacagctgcacctcggaccgctaggtgtacccca

SEQ ID NO: 567199 - DNA, 239 bp, Homo sapiens
tttgacagaaagcgagacagtggaacgatctcggctcactgcatcctctgccacctaggatcaagcaattatcctgcctcagcctggggagaagctgggaatacaggcacatgccaccatgcctggctacttttttgtatttttaggagagatggcatttcaccatgttggacaggctggtcttgaactcctgaccaccacgcccggacaagaagcaaataattttggaatctgtagtc

SEQ ID NO: 567200 - DNA, 728 bp, Homo sapiens
ggcggcacagagcctgttgttgcgctcagtatgtcgtgggaatccgggccgggccaggtctaggttcccaggggatggatctcgatgtggagtgcgtggtacggaaagtgcgttaacagggcaagggtcgttgccactctcggaccacggcatcgtggtcgacatggctcaggagggccgagatgggagcaggtgacggttaatctgtaactgtgacgagcgcataaggttgcagcggtacgcgcttaaccgcatcacggtgtggaggagcatggtcaggcaagcgaactccctctgggcagttggcgtatctactagctagacctgatacgcgtgtcaagctcttggatgtaactggtaggcttgggcactgatgaacttagactgctctatggcatggcattggtcaggtttgtgaactcttatctcgagcagacgacagacaagaagttgccaaggtccccctccaaggtgtctggacatcaagagggtagactattccggacttggcattggtgaacctatggcacatgtgagtggaccaacaagggaaaatgggccccataatacattgcacggcggacaaaggagcgaaccttgtgccctggattgggctcccagaaagacctatttggcgccgacacctggagaaccgactgacagagcactggagagtagggaggagtacaggaaacgggaaagcggcagaggaccacaagggacaaaaa

SEQ ID NO: 567201 - DNA, 901 bp, Homo sapiens
ctctttgttcgcctttcgtttgtacttgtgcgggcctatgctatgcttgtttgtggaagtggttgcgcgtgttgccccccgggggacccccctgtggggtcccggtgtgttcgccgcccggcgctgtagtcgtgttatcgccgcgttccccttggagagtccccgggaacctgcgggccttgcggaaattttggacagggccgccctgtgtcccggggacctggggggagaagccccccctgcttgtttttttcgtaagcccccgtccttttactgaactaagccctgtggttacttgcagatccagtttcgagagttccccaaaaataaaggttgggaagaattgtccctatggcccctgaagcaccctgctttttttcaaaggagaatctttcccacgtccacagctatgggcagggcttccccccctgtctatatggtatgaaagacgaccgccgccccaccaacatgggtttttctcaacagagggcagccgtcctactagcgacatagttgattcaccgaaggccgtaacattattgaacaccaaatgggggggatcgtaagcagtacggaggaggccccaagaatattttacgggagcacatttgttacccgccgtctataaattcaaatttcaggggggtggtctttggagtccccaggtaaacacgccgttttcagcggttgtacacacggtccacaatgccctcggtgaatacaattctagggtcgaccaacgcttttctgttcaccccagcccaccgcctgtataagtcatattgtacaagcctccccacaagcggagacttaggaggtaatcggaggaaaaactgattattttgcggaggattagaaatacttttcaaagcaaaaaaaacgacaccccccccacaaaaca

SEQ ID NO: 567202 - DNA, 347 bp, Homo sapiens
gtcgacgtagaatattacctccctgttcttaaaaagtaactatgttctggccagtgcggtggctcacgcctgtaataccagcactttgggaggccgaggcgggtggatcacgaggtcaggagatcgagaccatcctggctaacacggtgaaaccccgtctctgctaaaaatacaaaaaattagccgggcgtggtggcagacgattgtagcgccagctactcgggaagctgaggcaggagaatggcatgaacctgggaggtggagcttgcagtgagccgagatcgcaccacggcactccagcctatgcgacagagcgagactgggtctcaaaaaaaaaaaagtcgacg

SEQ ID NO: 567203 - DNA, 120 bp, Homo sapiens
acacaagttggtcagtatgtgatttaacacgtctagagatttcttccttaaactgctggacggagctattctcgggcacggcgaattcctccttattcttcggggtcttcacggtgactt

SEQ ID NO: 567204 - DNA, 449 bp, Homo sapiens
gtttgcgggcctttccagaaataaagaaatcatacagtgacaacacagaagtacaatggatcatgagagactattatgaacaattatatgccaaaaactgaattacctagaagaaatggatatattcctacacacatacaacctgccaagactgaatcatgaagaaatagaaaatctgagcaaaccaataatgagtgaggaaattgaatcattaatacaaagtatctcaccaaagaaaagcccaggaacagatggcttcactgctgaattctaccaaacatttaaagaagaactaatatcagttctcctacaaactgtctccagaacaaaacacaaacaaacaaaaaaacgacagggagagaatactttcaaatcccttaccaggaccaggcattacccctaataccaaacgccacacaagccacatcacaagcaaacgcacaacctac

SEQ ID NO: 567205 - DNA, 1128 bp, Homo sapiens
agcgtgcgtgggtacttggaacaagcaaacgaggcagcgagctgaaggacgggagccgtgacctgggccccgtggaacgtccagcctgcggccatctacgtcacggcacagcgctctggctgctgcgaatccgcagcatattaacgaatattctgcgattttgaccttgcattaacggcacctttatcctagcactttaagcaatgccaaccgcacgcacgttgcggcaggtccaacgtctggcactacatcccaccgccaagactggtaggcctggcggcctgtggacaagctggcgtaactttggcacgccttctcattttcgcacttcgggacatttcattcttacttgcaattttccccaaaactcaactttactgggtcgtatctttccacaacgaccgacttcgcaaccgcgtcactaatctcgcagttgacccaacgcaacccatgccgcaacagctgctccactcggccttattccttcccactaaactggtccgccgcctggtccactggctacttgcgctcgacccagcggctcccctaatctccaggccacgcctcattcccctgggctggcgcaccttacccctttcctggcgcccccgcctcccgctcacttacgcttcacttggacctccggccgcgcgcgctggcacctggccttgcgcttccacggggccctggcttcggccctctcgccactttggccccggccgccttttccctcatcacccttgcgttacacacgcccgcccgcctcagcccggcgcaccgacttcctcgaccgcttccctggtccatctgcgcgccaggtctccccatcccgcgcccgcgggctccctctggagccggcccttctcgcaccctcttcccaacaccttgcgctcacactttctccaacgacccttccgtgcaaccccccagctggcacctcgggcgccaacacgcctcattctcctccgttaacccaagctcgaacggcgccggaaaccccgacttctgcgaccacccacacacgcgtccaccctatgggcaccccacatgacgcccacaaggacaaggacgcccatgtagatggctatctccgccatccgtgtgcgtaacccatccctgtgggaaacc

SEQ ID NO: 567206 - DNA, 242 bp, Homo sapiens
accccccaaaaaaaaaaagcccggggggttttttggccccttatgtttaaaacaaatttttagatttgggggagccccgcccttgtttttttttaaaaacccttttgaagggaccccttgggtttttaaaatggtttgggaatttttccgccaaacagggtttttggggggggtttgttttgtttaaaaataaaaaatttaggggtttttttttgctttaattaaaatgtcaagaatgccca

SEQ ID NO: 567207 - DNA, 137 bp, Homo sapiens
atgcacctatgcgcgatatttccagcagttcgcagtcgtatcgccgaaattaccaccctgatcaacggtattgccttccaaaccaatatcctggctgctcaacgccgcggtggaagcggcgcgcgccggcgaacagg

SEQ ID NO: 567208 - DNA, 358 bp, Homo sapiens
tcacgtagtgtgctctgcactatcaacatagggaagggaagccctatctcattattctacttaccagacattgtcctggcaatgccggggggcatgtttaccttaccctgccctgtgatgtcgccatgccgttgtcttctaatgcaagagtaaggtacgtcttcccatccagtcacgtctatttgatttgactttgcattacacggagggctgggctgggtcagtctgacctcggaatctagttgtcctcattccatgccatatggcatgtggtgaggacgcaggggaagagccaagccaaggggcgtcggctcagaatagagccaggtctacttcaatgatcttgatcttgtacctc

SEQ ID NO: 567209 - DNA, 277 bp, Homo sapiens
  misc_feature (42)..(42): n is a, c, g, or t
  misc_feature (97)..(97): n is a, c, g, or t
  misc_feature (99)..(99): n is a, c, g, or t
  misc_feature (145)..(145): n is a, c, g, or t
  misc_feature (159)..(160): n is a, c, g, or t
  misc_feature (187)..(187): n is a, c, g, or t
  misc_feature (189)..(189): n is a, c, g, or t
  misc_feature (264)..(264): n is a, c, g, or t
  misc_feature (269)..(269): n is a, c, g, or t
  misc_feature (276)..(276): n is a, c, g, or t
cgctggacagggccgcgcaggggcagaaggcgggggtggagncgcgccgctcagacggatcttgagttgcaggttgttggcgacaaagtgggtaagngntccgtggcggctcactgtgccttcgagctccaggggactggagatngtggcgctcgcgcnncgccggactcggcactccctgaggacncngcgccaccgcacgcctcgctcacccgtccaggctgcggctgtcctgaagacggctggagaactgtaggccggctnctctncccggtnc

SEQ ID NO: 567210 - DNA, 536 bp, Homo sapiens
tacaccccatcgtctactcaatacaaaaattagctgggcgtgatgcatacacctgtactcccagctactgaggaggctgagtcatgagacatgcttgaatccgggagtcaaaggttgcagtgagctgtgatcatgccactgcgctccagcctgggcgacagagcgagaccctgtctcgaaacaaccaagcaagcaaccagagaagctgaattgtgacgtttgaggcagcagtaagggcagcagaggtgacatgccatggaggcagctatatatggcacagagctagcctttgcttgggtctctttaagagaacaagggcatgacagatggttagactttgttgcctttcagacttttctacatctctgcttaaggtcaggcagccataagttggcgtatgagtaaaacttgtccattttcagctctgcacatgtgttctcttcatagtcatccggtactcacaggttgactgcagaggagacggaccaagctatacttgaccttaaagcagcaggatggtcggacttcagtgagag

SEQ ID NO: 567211 - DNA, 328 bp, Homo sapiens
gctcggtaccacagcatatactattaaaatacacattttagggaaaaaaaaacctagaaaatattaggaccttagaaaaagcaagtcatacacataaaaaacacggtagcagatgacagaaggagaagcatagtttacccacttacaggtttgaattaagacacagacagagaaaagtacacatacaaggacactatgcttcagtagggagcaaggtaaactgaagtgaacgagacttactggggtagatggtggtagaacaagaaagttaggactatagaaagaactgacttagactaagatagaggactgcaatagtttatgctgt

SEQ ID NO: 567212 - DNA, 220 bp, Homo sapiens
caatatcaaggtgtcagttgacctcagtgaattctgtgatgtttctgagatgcagaatcccgtgtagttctagattcctggtccatggatgacaccacccgcccatgcctcctcgaattagcgtttcctaccctgcagcgcctttaaacttccactacagcgattcttttctgcctcatctgcaaaacaaaaaaaacacaacacaaaaacaaaaaaacac

SEQ ID NO: 567213 - DNA, 386 bp, Homo sapiens
  misc_feature (350)..(350): n is a, c, g, or t
gggaagggtccttggtgactcccttcttccaggatcgcgtccctgccacttcgtgctgtgtgatctttggcgatcactgcctctctgggcctgtgtcttaggctctgcaagatcaaccgagcaaagcacacggcctgcagagaggcagcgctctgcccttactcggccccgttttcatcggagacctccggggagcggtgggggtggaggaatggtttctccccttttctgaactgaatactaagaccctttttttttctttgtcctttcctgacagcaaaaccaaagaagttatcttcagtgtggggtgagtgggggagatgggggaagggctcggtgggaagctttgnttgtttgggggtaacaggctggagccagaggtcatt

SEQ ID NO: 567214 - DNA, 120 bp, Homo sapiens
  misc_feature (51)..(51): n is a, c, g, or t
tgactctagagcgatctataacacgcactctccctaaatggattattttanaagaactgccttcaagttcagaaactcttctgcctgatctagtctattattagaagttctccattttat

SEQ ID NO: 567215 - DNA, 201 bp, Homo sapiens
tattatacacagctctagtttatttttatttttgtctttttagggccacacccacggtatatggaggttcccaggctaggggtcaaattggaactgtagcccccagcctacatcacagccacaacaatgccagatctgagctgtgtctgcaacctacaccacagctcacaacaatgctggatccttaacccactgagcgag

SEQ ID NO: 567216 - DNA, 638 bp, Homo sapiens
  misc_feature (228)..(228): n is a, c, g, or t
  misc_feature (238)..(238): n is a, c, g, or t
  misc_feature (240)..(240): n is a, c, g, or t
tatacccagctttccatattacatctcttttatataaaaatatgtgccccaatccgcgatatatatgtcttatatgtgatatagtaggcggaaatattatagagaatattatataacacgtcgttgcaaagatattttttgttctcttaaaatatgtagatatcttcttgttgtctctgggcccctcttgatatttttgatatcactcttaagagttatagagagatntatatatatntnttagaggagaatacactctttctctagacacacgcttgtgtgaagattttgtgggttgcctatatatataggagagagaaaaccacccgctttacataggatatatatactccccagagatatatataacaccaccctcgtgtttctttgagatagtgaatattatatttatttagcgttacaaaataaacaacaccaaactgctcttcacagagttggtcgccctgttaaccctaaaccatgaaatatatttattcaaccatcgccaaaatatttcgttagccccttttaacgccgtaatgttttatctgaatggatatttgtttctatatcctgataattatttaaattgttactttccatctggaagaaaaaataaacccttaatattgaaacta

SEQ ID NO: 567217 - DNA, 264 bp, Homo sapiens
cacacagcctgggcgacagagcgagacttcatctcaaaaaaaaaaaaaaaaaagggggaaggattattcttccttttcggggaaaggcaccgggagggcagaggttttgtatagcaaaacaattttggaggcttaagggggactttataatgtgggggctaattaagggggaaaaaacaaaaaacaagggttcataattgggaaaacatcaggttggtttggtaaagggaaaataaagtttttttaaaacacttgcaacccggg

SEQ ID NO: 567218 - DNA, 145 bp, Homo sapiens
caatcctttaccacttacactgttgcctttttcattttagccagttctatgttatgaagtgatttaatttagcatttcctgcaggacaaagtaggttgaacactttttaaatagtttattcatgattagggagcggtggaagctt

SEQ ID NO: 567219 - DNA, 342 bp, Homo sapiens
gcggccgcctactactactaaattcgcggccgcgtcgacgaacccagacaccccttgatcagtttctctgaggcgtgagcctcccaagaagccacctgtggacctgtgtgaagctgactctgaaagaggactgcggaggcctggatgccagttctcattgtccctgtcagcttgtcaccgtggagacgagaaccacgtcaggcagggacgcagcactcacagagtccgtcacatgctgtgtgacgtgcagtggagtgtcccgccatgagcggctgggccaacctacttatcacttccatatttgggataccttaaataatacaatcacagccgtcgacgcgg

SEQ ID NO: 567220 - DNA, 126 bp, Homo sapiens
gcagggtacattagcatgtttccaaccctgcctagcctctcatttccaaccactcaacttgactgttctgtatttttaggccaggatacactagggctaaatttctgtaactcaggatgcttcttg

SEQ ID NO: 567221 - DNA, 720 bp, Homo sapiens
gctgatctcgaactcctggcctcaagtgatccgcccgtgcttggcgctcccaaagtttctgggattacagttccgggagaacatcctaggaggatgtgctatctgcgctgaccagatccggtgatgactacttcctcctgcgctggctccgattgaaagagggccccaaggcccaccaaggggcatgcccagggcaatcaaggagccgtgtgatccagtgttccctggtgtctccgtgatatcatcagctctattgtggcttccctcgggtcaaagaacaaggcccatctggcctcagtgagctttgaccatgtcgagaaactcagaggagatgcttgagtgaaggtgaggttgacaccatcgcgcccatgcactagccctggtcactgtgtcgctagtcgcccagaagtctgaggcacaaaatgtattcagttgcgattcatccagtccagttcattcgattcatggaatgacccattcattgaaactggaaggtaaacctggtctgggtgctaggcgctggggagatctgccgtgatggcgatagagagcaacacaagaacactccaggaggcatgcacgagaagacaacgttcctgagaaatggacctgtaccagtgagaagcatggatactcagggaagcgagcggacagagtaggtccacggacagttcagaggcacgggacatgggatgtcccaaatgggaaccgaaggatagg

SEQ ID NO: 567222 - DNA, 213 bp, Homo sapiens
agaatggaccgataaatagcaggagtcaagaatcagattgggtacatggccagactctgtctcaagattggataatccatcctgaaggacccattatcgagcccagggagcaagtgtaggctcctcaggttcttggtcctcaggttcttggtcttcaggaatcgaatagaattcctgaggtgtactactgtctcattcaggagctcattgtcc

SEQ ID NO: 567223 - DNA, 776 bp, Homo sapiens
ggaaagaggtagatcgcggagggttcatcgagtccctccctgcctaaggaagctaaagagcatggcccgtggtggccctccctgcctcctagcgcgaggcgagtggagagggctacaaaggaggacaagatcctctcaggctgtcccaatgctcacaagagcttccaggagctcgtgacccacagtctccaagtcaggtggggtggagtcccagagctgcacagggtttggcccaagtaactaagggaggcacttcctccccgtacagcccatcagtgccagcccctgctggactaggtgcctgagcccctcagacagacccctgtcccctgcaggcctgccttctcacgggacttctgcgtgggcctgaggcaagccatggagtgagacccaaggagccggacgacttctcaggaaatggcttttcccaagccccagcccccaccggtggttcttcctgttctgtgactgtgtatagtgccacacagcttatggcatctcattgaggacaaagaaactgcacaataaaaccaagccgtcctggcaaatctgagaaaacacacaccacacaaaaacaccccggagggcctcaaagagacggcggatcgcgcacaaaagcgaggcacctccgaataggggacatggggcacatacggaggcccccagaccccgagatacacaaggaccaaccggggaaaacaccgagccggccccacatgcaccaaacacaacaatataaatatcgaaacgcggcgggctacacgcgaactaaccgc

SEQ ID NO: 567224 - DNA, 1009 bp, Homo sapiens
gcggaagcccacactggcggcctacggaacagagtccctcacccccaccacgctgtctctgaacggtctggatggatgcagaccgaacaagatcccgacttctgaggaacacataagccttgtgcctgcctgctcatctctctctctggtcctgttttatctctcagtgctctgagatcaatgacccttcatctgcctctactgtgaaatggttccagtggcattccacttggtctggtacccctagtcgcaactgagatgcaacccagggtgcgtggtgtatctgcgtggcagagtggcattgaccgtgggcttgtccaagagcaccatgcgctaaagagcccttttgggcgtcctcaagagcaggagcgagtgacatgctaggcacatcgcatcatggagatgcatgacgtagagaatttgggacagtagactgatcttgcctgtgatgagtaggaagagaagcgcgccatgccgccacaagataggacaccaggaacgacgcagattgatccggtaccattgattgttagaaccctatatcgaaattttgctctacacctgagcgtcacatttgggcgtcacaggggatgatgggagagccaggcatggattgggactttgcccatgagccacgggtagcactctgtacatgtcacccggactgaggatccaaggtcaagcctgaagataggccactcgaagactacatttctagggggcgcttcaataggtctcctgatttaactggcaaactgcgtctccttgtccatgtcgttagaatatccccgcaatttgcatgtctgtccgtagccccgtgcaagcaaaatggctggccgcccttacccagtatgtcccgtcccgtgtgtcctcccagtggattctcatgggaaccccatctgttctcccccctaattctggcgttaatcaggtgtcctcaagcaagggcttgggggggggctgggtcgtcctgctcttacgtccgctcctggggcctttggcccccttc

SEQ ID NO: 567225 - DNA, 1073 bp, Homo sapiens
gggggaggatcccccgcccttgggcgacgctttgcgggggtgcccgcccttctctcctgtaaagtgggtactttttgtcgccgcccgcccgtgtgattgtgtttgttcgtcccacagctgttgactcacaggttttcttgtgggcagcacagaagtcgacaagtggtgttgtgccacacaacggaaaataaggggggggaccaccttatttggtgttgatacgacgcaccttttggtccccccctgggggaaagacctggcgaatatctataattggggatgcggggtcttccataacagcgattatatgtaatgtaatccgctctcttgaatgtttgttctctccccagacgtatgccgttcgcccctctgctacaaagacgtctggtgaaacaatcttctgtcgagtccctttctttttctcccgaaaggccgcttggaagggggggacacacacaactgtttttgcggtggtggcaatcgaaactatccctctgtaacggtgcccctgttgtctttccctttctttccaaaggttgtgctggggaatgggaaggaggcgtattattctgggaaccctctcttcttaacaccacctcccttcggcgcgatagtaatctttttctgtctctcccctccgagttctgccctccctccaatgagcgtgggactcaattttcgggtcccgtttctaccttggggtccgaggaaccttgggggaaaaggaaaggaagtgcacattttttgggacactggcacttatactggagacctataatggttttaaccgccctttgaccacccacgcactccctgcctgctccgcccacggtgtaaatgtgagggtgtcttgtgtgaactggccactccagagctccagtgccacctcgaggagtcagactaccctgacatcgtagggaaagaggggagatttttttgtagcttttaaattgggcgtttgggagggggcgcgggaagttttttataaactgtatcattttttctgagggtggaatgtcccaacctttttatcaaggtgattgtgattttgactaataaaaaagaatttgtta

SEQ ID NO: 567226 - DNA, 841 bp, Homo sapiens
gcgtcctttgtttctttttttgagggtggagtctcgactcaggttgcccagaattcaagttgcaagggccacgtttgggctcactgcaacctcggcctcccaggttcaagcgatatctccctgtcctgggcctcccgaggtagctgggatctgacaggcgaactgccaaccacgcgcagctaatgtgtcgtatcttattagatagacacgggggtttcaccatgtgggccaggctggtttcaaactccgtgacattaggtgatccacctgcctcggctcccaaagtgctgggattacaggcatgagccaccgtgccaagccaagcgccttggctaatttttaaaaataattttttggcagagacagagtttcactatgttgcccaggcggtcttgaactcctgtggcctcaagtgatcctcccacctacagcctcccaaagcatgggggttacaggcgtgagccactgcaccgtggccctgtttcatggcttttatttcctttcatcccacacatttgtctgcagtactagacatgtttaacaaattcaacaagtttacacaagtatatgcagctgggtttggggggacaaggagacccaaagatatgcatattactagtgtggaattcgtgcctctaaaattgtgttcctaaggtctctaaggtgaccctttaatctacttcacgatggggccagagaaaggggcctggtttccagattattggggcctatgtccaacgtcccattttctcttacaaaataggggtctcctcttgtctggcttccgaaaaactcaacacaacaaggggggtaagatacccaggggccggtttgaaccctt

SEQ ID NO: 567227 - DNA, 225 bp, Homo sapiens
ttaacatctgaatacatctcaatcttactgacccctaccaccaccaccaatcctgcctcagcagagttgcggctaatctgtacctccacaaatggcagggtagatagaagtcaaatttcccaaactccatcccccagcaggaagaccaaaagtgcttgtattgcctatgagataaatcctgatatttgcacatgtctaatgaaacacctgtggaagaataccttt

SEQ ID NO: 567228 - DNA, 1213 bp, Homo sapiens
ggcctcgtgccccgatggacgccgctgttcctcctcgtcctcgggctgtatggcccagagcctctgcctgtcttatgtggggttcctgtgatggacgtgaggcccaccaccctgtaccccatgtgctgcctggtgcgcctgacctgagcctgcgtgctggaggtgcttgggtcatcccccctgatcagctgtatcctgagaaccacaatgctgtctcccactacccccctgtgttcagatcaatgtcggaccaacgcatgcatgcttggtgcatgctgtcaatctacatgcactccagtgtgaccctggctgttggacttgaaggatgcccctggaggcctgtcattactactatcagaaccaagttcaccagtggcaaggtcttcctcaaattgccattgcgtggcacctgcgcagaagcacttgcatctgctttccagtgctaaaagcagcgtctagcccttggaaccttggtgagagatccagaccttggactgtgaccacacactgcgacgcttgcgagaatttgtcacgtatgtgcgatcaagacatgacaaaacctgggcccaggccattcccttgcaaggagggctgtatcactgggccagccgttgctgagagtggtgcaggacccacaggcaaccatactgctgaacccaggggccacgacggccaacagactgccccgaacgacacccggagacaggaacaacggcagggccggagggacacaccatacctggcacccgcggcagaccccgacgctcctcacgacatcaacagaagctccacacggcagaagcataccgacaccaagaagacaagcatgcgaagcgtgggacccagagaacgggaggagaccgcgcagtgacaccaactacgtgaacacacgacaagaagagcggaacaacaaacggaggacggcactacgaacccacggacgcggcccaccacccaacccgatcatgaccccgcgcaaaaggacccgacgacccaggacagcaaaccacggagccaacgaaggcgaagcgaaaagccacgaagcccagcaagacgaagaaccgaaacagaaacagagaagcacaaaagaaagaaaagaaaaaaaagcgccaaacaagaagaaaaaagaagaagaaaaaaaaacagcgagaacagaagaagcgaacaaacagaaaaaagaagacaaaaaaacaacaaacgcgcaaggaaatgc

SEQ ID NO: 567229 - DNA, 931 bp, Homo sapiens
  misc_feature (291)..(291): n is a, c, g, or t
cgtcttatatttggtgtgggcttcgttctcatatttattaacgggggggggtctcctcttcttcttttgtgttggtggcggtcgtcctctcctcctccccccccgctgcttgtgtgtgtgttgttcctgctgtttgttattgtgcgattttttttgtgacgtgtcccttcccacaacacggatattttgggttgtttgtttatgtcttcccccccccgctccggcttttgttgtttttactcattgacgcgcggacgcgcgcgtgggtgtgttgctcgacaacctgttgtnttctggtcgcgtcggagatgctaatcaatcggtgatatgttattttttcgttcgcaataatggtttgttcactccccggctggctagtattgtagctgatggatgtctaggtattgttgtataacaaaaaaaaatagcatgcacgcgcaggcttgttgttgtttgttcgttcctcacgacagaaaacgtgtacttgtataaagatagtatatttgtgagagagagagactgtctttctctctccccttatatatatgtatttagttagtgctgtgtgcgccgtcggcgtcggccacctcgctcggctgtgtattgttttcattcctcgtcagagatttttgttaatcattttttctctcctccccccccaccatgacccagccgcgtttttttaaaaaaaaagcgggggggatactgccatagttgtttgtcagtcagctcgcaccgcagctggtggtgtgattattatgtttttggtgatacgatgttgttagatgaagtcgcaccagcagacttttttatatataatatgcgggcggggggggattttttttttttagataaataattttggtgtttttttttaggcgcaggagaagttttgtttttttttggtgagaacccccccctttttttatga

SEQ ID NO: 567230 - DNA, 258 bp, Homo sapiens
gcctgtgacctctctcaggtacagaacctgtgttgttttcaagtgctctcagtttttatggtgaggtttttaccatcacaagtgatgattcaatccgggttgggcctttgcgcccatttttcgcaaagctattcccactcctagctccttcatgtattcatcaaagcctttgctgtccaccaggcgccatcttccttccagctgctgaactgtggccatggtgggtgcgggcgggctggcgtgcagagagggtccagg

SEQ ID NO: 567231 - DNA, 268 bp, Homo sapiens
ctggcatttgttgctaacagagaagagtgggagtgctgtgcacacacttaggctgactgttttatcctgaagatttcagtgactgaaagtcagacatcacttggtatttatcattagaaacttaagacttgatagcaagtgagtagtttcaatatggatcttaagtattagggaggcaattgcatagtgcaggcctgtacgtgtctggcttgctgcttctcaatttcgtcgcctacaactagagctctgcctatacttatctatcaca

SEQ ID NO: 567232 - DNA, 470 bp, Homo sapiens
atgtgtacttttcacattttatctatgagacaggtttgctctctcacctaggctggagtgctgtggtgttaacacggctcactgcgacctctgtctcccgggtttaagcgattctcctggcctcttactctgtcactcaggctggagtgcagtggcgcgatctcggcacgctgcaacctccacctcctgggttcaagtgatgatcctgcctcagtctccctagtagctgggattacaagtgcatgccaacacgcccggctaagttttgttgttgttttcattgtcattgttgttttctgagacagcgttttgctctattgcccaggctggagtgcagtagcatgatcttggctcactgcaacctctgtctcccaggctggtctcaaacgcctgacctcgggtgatccacctgcctcggcctcccaaggtgctgggattacaggcatgagccaccgttcccggctggttgt

SEQ ID NO: 567233 - DNA, 559 bp, Homo sapiens
agcgggtctgtctgcctggtctccgtactgtcccagacggtgctgttgtgggcttgggatcctcctggtgaccatctcccgtctaaggtcactcagccactctagccgacaagatgtggccgtgcggctggccgtgatacccacctgcgccacgacggcaagaatggggagcgcgaatgaaccacatggaaggagaaggaactgcgatgagctgactgaagcgagtggtggctatggatggaccacagagctgtccttggatgagctgggcctggaatataccaagtggacctgtccagatgtcctcaccaagcagcgggtctcagtgacagtactgaggatcgagatgggcccaatgcccgtcagaagactagccatccccactaacactccatggagtgtgggtcagagttctgaccgagcaagtttgatccgggccggttcatccattccttgctgctggagttggtggtctactccttcttgcattgctggcactaacggtagttcattgactgccaatggcacggatgaaccaatctcaaggacaatctatatc

SEQ ID NO: 567234 - DNA, 287 bp, Homo sapiens
tgaagaacagatctggagctctctacagctggacagtgggcctgcccgaggaggtgacaatcgcagaggcctaccagatgctaaagaagcaggggattgtaaagtccgaccccaagcttccagatgacactaccttccccttcctcctccacggccaacctgaaagaatgtgatctttgaagatgaggagaaatcctaagatgctggcccgcctgctgaaaaaagagctcccatcccgaagacctccgcgcagccaataagctcattcaaagagatggtgcaggagg

SEQ ID NO: 567235 - DNA, 113 bp, Homo sapiens
gctgtagtgtggtgcggcaggctgggccgtgaccggggtctcctcactcacctccaagctgatccgttcgcacccaaccactgcccccccccaacggtgaccggcgacttcgc

SEQ ID NO: 567236 - DNA, 399 bp, Homo sapiens
gatgcattcttaaaagatttcactgactgttcaatttccatgtaacccctgttttcttccaaggtgtcatcagactcgtcgtcgtccctggggcccgtggtccagtcatagtctggttctccataatcgccattgtctagagtgtctttggctgtggatggagaactgttcagcatgcgaagatcctcctcctctatactaggatcttcattgttatcagcttcctcttgagacagaggagtagccgcgggatgagggaccacagatgctcctcttcttttgttggtactcctcctgggcgggggggtcgtgctgatttgagaggtagaacatttcgtctggttctcggtatgttacaacgttcagatttgggatacacatctctgagatggggaaaag

SEQ ID NO: 567237 - DNA, 215 bp, Homo sapiens
ccggtccaattcagcgtaacaaagatctatctcatatgaacagaatctgtgattaattttccttagtaaaattcaatgctttttgtttttttgtttttgagacggagtcactcttgtctcctgggctggcatgacctcggctcactgcaacctccgcctcccaggttcaagtgattcttgtgcctcagcctcctgagtacgctggaatggaattg

SEQ ID NO: 567238 - DNA, 118 bp, Homo sapiens
catacagttccccacagatgtcacgtcctatttttgctcttatgagcttagtcctgcagctaaataatgctggcatgggaatctctgtagcatgttgatgcaagtactctacgcagtg

SEQ ID NO: 567239 - DNA, 705 bp, Homo sapiens
cgggagcctgcgagccgctggtgggaccctgatgctgcactgcagtgtgctgcggcgacggctgtgggtgctagtctgtggctgcgtgagtgctggccgtcgggagtgcggagcgcctcggacgaggtgtccaaccgccggcaggcaccatgagggcacggctggctcgtgcactgggagtgggcccggctgctcgctagcccccctactgcccagagaggatgcggtgcgccctgagagcctgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgacactgcttgagcagccagctgccagctctgccctgcatcccggcacctggccgtctacctgcgtggaccacttcatggatccgctacaactgtcaacacctccaagcagctctacacctgtgtgcccgtctccttgccttccttgcttgcaaagcggagtttcggctctttatcggcccaggcttgacagttgcaagtgggcattgatcttcagcatcatttgcaacccttccaccttcccaaggattccaagcaaatttcttccttgctatcaagcgccccaaaatccca

SEQ ID NO: 567240 - DNA, 381 bp, Homo sapiens
ccgttactgggcgtatggtgagaggcaagcatgaccatggatccatgagggccaacgggaacagcatgggcctcaccgtcttctgatgagtttctttctttgcaccaaagacatcagtcgtcgcaacatgtttctgtggcagttgtttgattcagccataaatctcccaggtgacaatgatcgcaatagttttttactatctcttaggtggctctgggaagtgggacgaggggtatgatgtacaggggtagtaatgttttaggaaccaggcgtatctgagatgaagctgtatgattgattgtcattatgtttgtatgcgaagattaaatgtgtcattggaagacattccttctgttagatttcatactgcccaggtgagcg

SEQ ID NO: 567241 - DNA, 866 bp, Homo sapiens
  misc_feature (26)..(27): n is a, c, g, or t
  misc_feature (31)..(31): n is a, c, g, or t
  misc_feature (33)..(33): n is a, c, g, or t
  misc_feature (64)..(65): n is a, c, g, or t
  misc_feature (67)..(67): n is a, c, g, or t
  misc_feature (70)..(70): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (86)..(86): n is a, c, g, or t
  misc_feature (88)..(88): n is a, c, g, or t
  misc_feature (90)..(90): n is a, c, g, or t
  misc_feature (116)..(116): n is a, c, g, or t
  misc_feature (140)..(140): n is a, c, g, or t
  misc_feature (142)..(142): n is a, c, g, or t
  misc_feature (156)..(156): n is a, c, g, or t
  misc_feature (184)..(184): n is a, c, g, or t
  misc_feature (188)..(188): n is a, c, g, or t
  misc_feature (203)..(203): n is a, c, g, or t
  misc_feature (214)..(214): n is a, c, g, or t
  misc_feature (218)..(218): n is a, c, g, or t
  misc_feature (221)..(221): n is a, c, g, or t
  misc_feature (227)..(227): n is a, c, g, or t
  misc_feature (230)..(230): n is a, c, g, or t
  misc_feature (261)..(261): n is a, c, g, or t
  misc_feature (276)..(276): n is a, c, g, or t
  misc_feature (278)..(278): n is a, c, g, or t
  misc_feature (297)..(297): n is a, c, g, or t
  misc_feature (312)..(312): n is a, c, g, or t
  misc_feature (322)..(322): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (391)..(391): n is a, c, g, or t
  misc_feature (405)..(405): n is a, c, g, or t
  misc_feature (408)..(408): n is a, c, g, or t
  misc_feature (416)..(416): n is a, c, g, or t
  misc_feature (429)..(429): n is a, c, g, or t
  misc_feature (444)..(444): n is a, c, g, or t
  misc_feature (449)..(449): n is a, c, g, or t
  misc_feature (452)..(452): n is a, c, g, or t
  misc_feature (456)..(456): n is a, c, g, or t
  misc_feature (458)..(458): n is a, c, g, or t
  misc_feature (466)..(466): n is a, c, g, or t
  misc_feature (495)..(495): n is a, c, g, or t
  misc_feature (498)..(498): n is a, c, g, or t
  misc_feature (556)..(556): n is a, c, g, or t
  misc_feature (560)..(560): n is a, c, g, or t
  misc_feature (588)..(588): n is a, c, g, or t
  misc_feature (610)..(610): n is a, c, g, or t
  misc_feature (620)..(620): n is a, c, g, or t
  misc_feature (627)..(627): n is a, c, g, or t
  misc_feature (647)..(647): n is a, c, g, or t
  misc_feature (668)..(668): n is a, c, g, or t
  misc_feature (671)..(671): n is a, c, g, or t
  misc_feature (757)..(757): n is a, c, g, or t
  misc_feature (761)..(761): n is a, c, g, or t
  misc_feature (773)..(773): n is a, c, g, or t
  misc_feature (787)..(787): n is a, c, g, or t
  misc_feature (803)..(803): n is a, c, g, or t
  misc_feature (862)..(862): n is a, c, g, or t
tgcaagaaaaaaatttttatttttcnncatnancaaacagcattaaagaaaaaaaaacccgtcnngnggntncaaancngagaaancnanggcaagtttaaaaaaagtacattgancaagggacaatttttaacattaananacacatcccaaaancccacccatttaacattaacacaggccntggntggggttattttttnccccccacaanattnccngacccnggnggacagggggccccagggggggggggacccngtcccccaggggcancnggcaacacccggcaaaacngggggggtcacaggngagggacgcngcccaccaccccgcaatgcacagcncanaccccnccacagggggtttacccagcccaaatgtcaacagngtaaagtttaagcnacncttaccgngggggacccaatncccattttatgaacnccccngtncccncnggaattcngaaaacacagactttgccaacggggaaanacnatttacaagaagattcaacctaatcaatatcacttatcaaaagcagtggctgactgtnagtntcaacatgtttccagaatgaataaaccncacaatcaactcagaatgatanaaattagggnccatatnatttaatttcccttgaaccngccctgctagtttaatctgcnaanatgaaagttaattaagactgttttgaaggggcgagaaaatagtttcctttgcacatttttctgaactatgagaaaaatttaatganacanaaagcacctggnaaatagcaagtccnctgcaagtgccccggnaatgtttatcacagcctactaaaaacacagagtttcactcatttgttcaaatttcccanaagt

SEQ ID NO: 567242 - DNA, 212 bp, Homo sapiens
gcgcacgaggctgggccgaggtgcactacacagaaggcgcggagtcttgtggactcggtgctggacgttgtgagaaaggaggctgagagctgtcactgcctgtcgtgattcccagtcttacccactccctgcggtgtgggtgactggtgtctgtggatgggtacccttcctcattcagcgagacccgggcaggatgtacccagacagcgtat

SEQ ID NO: 567243 - DNA, 136 bp, Homo sapiens
ctagaggatccccattccatttgcctgaaaatgcgcttgagacaattctcgtgaacgtttagctaggtcaaccgaagtagtctggcttgctcctcccatggccgcagctactgaaaaggctgcgcagccttttcag

SEQ ID NO: 567244 - DNA, 448 bp, Homo sapiens
gtatatttagaaatgatagtcatatatgtaacagcattatatataacctcacagatttatcagtaagcttattgaacacctctaatatacaagggctatgataagatctatggcgatagagggtaaaaaaaaagaataggacacagatatagaactgtgatcatgagatggtatgtgaggaagatcctgttctgaggccatacagtaattaggatttgtaaggactaaatacaggtacctagaggggacgagaggatgtataatgtggaaaaaatagccatggggcttttgaacaatagaggtgaactatttatttaataaccttcgtatctatcttccaaagcatctctaaaaatacattatataggcttgcaatataaatttactgcaggtctcaattacagttacacaaacaaagagcagtaatgtgctcagtgtatactgtaat

SEQ ID NO: 567245 - DNA, 423 bp, Homo sapiens
tcgatctagaggatcagcacactgggttcgagtcctgacggctctcatttgaaagactccaatttatttccttacgtgttagtcgtctgttttcccctaccttctttgttcggttgttgatttaaatactgtgaggactaagggagaagactaagtcaaggacgatcccccaagtttctggtttgggcaactgggtggaagatagtgccattcactgagatggggaacagatttgggactgacagagggaagatgatgagctctgttcagggtacctacctgatgtaaggtacctgtggggcattgagaaagagatattagtaaatgactggatgcgaaggaagcactgctctggattggtgacttgtagagagggtaactgaagccacagggttcatactaaagaaagtagagaacaagaag

SEQ ID NO: 567246 - DNA, 1420 bp, Homo sapiens
tggtggtgatcccatttatatgaaatgtccaaaacagggaaaacctattttaaacacacagagacccaaagctcgactcagcagtggccaggggaggaggaagacgggaggggaaagtgatggctctcacagggggagtgacagaagtgtcccggaacggtgacacgagggtgggtgccatacacaacttccgtgggagtggtactcataaatgtggccgctgtgcatgtgtgcgtctcactttctcacagtgttatgtgtgatgttctttaggcggtatactgtgtgaattttctcatctcctctacattatacaacacacacccacaacactagcggctaacactgtggctctccgcgcgcccagctctctcgagccccccgcgcgagctcgagacagcggtgcgccagctcacgcgtgtgtgagagagcgagtgctgtgagagccccccccccgcgcagctcctctctctctctcgcgcgcgcgcccctttctcccgtgggagactcttctctctctctgctctctgtgtgtgccccctctgttatacatctcccccactctctgtgggcgcccgaggtcctcactgttgctgcccctgtgtgtgttgtctacatctcgcctctaacgctgtgggcccccggcaactcgtctctctctcttctgctccacactctcatgtgtcctccctgttggggggggtgcaaaacacccatcttccctataaaaggagacgggacacaagctgtattacccatcttctacgaagagacaaaaaatattctccagccatattatttctctcacacctcctctctaatttatgagcgccccgctcataacacacccgcggtgggccctcccatctttcttaaggggaaaaaggcccccaatgtgctgctgtctccaacaccccacgaaggtgcgcggcaagacacccggggaatgtagctcctcctgtggggtgacccccgcgtgctgttctcccacagcggggcataattacaacgccgggggtgtgggccccaaggtgtgtcccctgaaggcgagccagacgcttataacaccccaaaatactacaagcccgcgcccgagtgtgggtagacactcaacaaacggggggcacctccaggcgacaaaacaacgccggcatcggcgccagccacacggtctgggcgccccaagccgcgcttggtcaccagagcgccccccagggtcatcccgcgagaaaacccgtcgaccccccaaagggagcggcactcacccggggaaccttttcccacctttccgtgagggcccccccggggctacccttggggaccggcgaccaacagagacagcgcttccacagacaagggctcacacacgcggcgcgggacagaaaccacccccccagagaaaacccacaccttggcccac

SEQ ID NO: 567247 - DNA, 408 bp, Homo sapiens
gtcctatccataggggctgtatttgccctcataggagggttcattccctgatttcccctattttcagggtaccccctaggccaaacctacgccaaaatccctttccctatcatatttatggggggaaatttaacttttttcccccaaccctttttcggcctatccggaatgccccggggttactcgggataccccgatggaaaccccccatggaacatcctatcatttgtagggtcattcatttctttaacagcaggaatattaataattttcatggtttgggaagccttcgctttgaagcgaaaagtccttatagtagaagaaccccccctaaacctgggggggctatatgggtgcccccccccctcccccccatttgaagaacccggttacataaaattttggcca

SEQ ID NO: 567248 - DNA, 493 bp, Homo sapiens
  misc_feature (469)..(469): n is a, c, g, or t
taactgcagatgacacattctattcacagctcatggaattttctccaagatagaccatatgataggccataaagcgagcctcaataaatttaagaaaattgaaattatatcaagcactctctctggccacaatggaataaaactggaaatcaactccaaaagggaccttcaaaaccatgcaaatacaagaaaatttgaataacctgctcctgaatgagcattgggtcaaaaatgaaatcaagatggaaattttaaaattctttgaactgaatgaccataatgacacaacctatcaaaacctctgggatacagcaaaggcagtgctaagaggaaagttcatagcctacatcaaaaagactgaaagagcacaaactgacactctaaggtcacacctcaaggaactagagaagcaagaacaaaccaaacccaaacccagcagaagaaaggaaataacaaagatcagaccagnactaaatgagccgggtcctctaag

SEQ ID NO: 567249 - DNA, 186 bp, Homo sapiens
tcgagctcggtacctaatggactttcttcaataggagctgtatttgccaatcataggaggcttcatatcactgtatttcccgatattctcaggctacgccctagtaccaaacctacgccaatatccatgtcatctatcatattcatcgggcgcttatctaactttcttcccacaatactttctcgg

SEQ ID NO: 567250 - DNA, 690 bp, Homo sapiens
  misc_feature (290)..(290): n is a, c, g, or t
ggataacgctttataatacaaattctgggggaccttagtgaagtccctcgttaaacccgttttctttgggtatacaccagaaaccaacacatggtaaaatatttgtcgacccgcggcctcgggttaccaagccacccgccatcttataagtgttttaatataaaagtcccccacaatgggtatatatgctttactgcgacaaaatgtgagttttggtaactatataatgatatgttctcttcaaatgttagattaatacaaattgttgcaaccagttcctcccacaagangatttgcccccttttgtttgtaaagtggtatatcagtattaaatcttccccccatatccctgtccccgcggaccccaccataatttggaataattgtgccctttacataataccaccaccctttgttttatcccccccttttctggcctttttgcctcacatagttactttccctgcgttattcccctgattactagtggataaccgtaattatcctccttacgccgaaataaaatcgacggccagatagatttctggtaaatagcgatctccccctactagagagcagactaagtcttctccacaagtccggatacgaacacgaggcccaacaggtcgattcagacagaggaacgaccgcatcaacatagaatagcatacattatacgaaaattaatca

SEQ ID NO: 567251 - DNA, 147 bp, Homo sapiens
ctacctcggcctcccaaatttctggtatcacaggcatgagccaccacacccagccctgatggtggagtcatgataccattctctgcctaaaattttcataacactaacagagccatctagtagcacaacgaggtactccttgtctcc

SEQ ID NO: 567252 - DNA, 453 bp, Homo sapiens
gggcgtcatggcacacgaatgtaatcccagctactcgggagtcccagacaggaggatcgcttgaacctgggagttggaggctacagcgagccaagattgcaccactgcactctgctctgggcaacagagtaagagtccatctgaaaaaaaagaagcactccagactgggcaacagagcgagactccatctcaaaaaaaaaaaaaaaaaaagaccagcctgtcgaaaccccatcagtactaaatatacaaagaaattagctgagcgtggtggcacacgattgtaatcccagctactcgggaggcccaggcaggaggatcgcttgaacccgggagttagaggctgcagccagccaagattgcaccactgcactgaaccctggacaacagagtgacactccatctgaaaaaaaagaagaactccaaccagggcaatggagcgagactccatatcag

SEQ ID NO: 567253 - DNA, 935 bp, Homo sapiens
  misc_feature (62)..(62): n is a, c, g, or t
  misc_feature (724)..(724): n is a, c, g, or t
  misc_feature (804)..(805): n is a, c, g, or t
  misc_feature (808)..(808): n is a, c, g, or t
gggagtgtgggaagtctggcggttggaggggtgggtggggggcagtgggggctggggggggnagttctggggtaggaagtggtcccgggagattttggatggaaaagtcaggaggattgacagcagacttgcagaattacatagagaaattaggaacccccaaatttcatgtcaattgatctattccccctcttgtttcttggggcatttttccttttttttttttttttgtggttttttttttataccccttcctttagcttatagtgcgcctcagaaaaccaaatttaaaccccccccccatgtgtaacagggggggcagtggacaaaaggcaaagaacggcacgaagccagcctgggagagaccaccaggttccgtgccccccgccattatatcgcccgtgattgggatttggggttttcccatctgctcccgtgtgcgctgggggttggagcttgagggtgggacgccctccgtggggggcactgggccaggtgagcccccttgggagaagttcaagaggggattggagaagaaggccatcttgtccggccgggctttctgggggacaggtggctgtgtccccagaattcctgagggcggaggggggggtggggcagggtctcctcggtgtcaggagggtgctcgggaggccacaggagggggctccgtggctggcctgaggcttgcccggaggggaaggggctacccggttttgtaacnccggagggttccatcaggctggggcagggggtggccgccttccgcacatcttgggggaagcctcccctctccctggggannttntggcccgccctgcaagcctggctgttctcggaggtctgaagtctgtggggacttgggggacagggggtaaggcgggaaggaccagcgggtctgaccaaagaactggcgtttcaccgtttggccggca

SEQ ID NO: 567254 - DNA, 315 bp, Homo sapiens
  misc_feature (20)..(20): n is a, c, g, or t
atccacctacgacctcaggncatcagaccgaccagcccaagaaacatctcaccaatttcaaatctggcacccactggaaatcagactgcccagctcgcccgacagccactcctggagcccctaaagctctagcccaaggctctctgactccttcccagatctattcggcttagcgactgaagattgacgctgcccgatcgcctcggaagtcccctgggcccatcacagaagccgagcttcggggtaactcttcacagtgggaggggtaagtccatcccctgttttaatcgatacggggggcttacccactttcca

SEQ ID NO: 567255 - DNA, 145 bp, Homo sapiens
ctctagaggatcttactgggtgcatgcatgtggtccaggtacttaggaggcgaggtgggagatttgttgagcccagaaggttgagactacggtgtgctgtgatcgtgcactccatcctgggggacagagtcaggccctgtctcag

SEQ ID NO: 567256 - DNA, 131 bp, Homo sapiens
ccaccacctgagtcatacagaggtgtgctctcaaatgcacacacacatacacacacacacacacacacacacacacacatatatattgtgaagtatgtgagggggatcttatgcaggactcaggtggtgtg

SEQ ID NO: 567257 - DNA, 424 bp, Homo sapiens
tccgcttaaacattggaaggtgggcccggggcaaaaagtaggtattgtaggtataggcggcttggggcacatgggtattaaaattgcgagagcgatgggcgctcatgttgttgtttttactacgtctcttgccaaaacagaagatgctaaacgtttaggtgcggatgaagttgttttatctactgatcctgaacaaatgaatagacatgcgaaaagtttgcattttattttggattgtgtatctgcacaacataatatagatgcttatttaaacctgcttagggtagacggtacattgacacttgttggtgcaccaatggatccgctgccggttacttctttcagccttattttaggaagaagaaattttgccggttccccaatcggcggtattgcggtcgacgcggccgcgaatttagtagta

SEQ ID NO: 567258 - DNA, 490 bp, Homo sapiens
  misc_feature (355)..(355): n is a, c, g, or t
atactttgtatgatttctatgaattttgtcaagatactatttttattatggtaaaaaaaaagtggataacacaaaatttaccatcttaagcatttttaagcttaccattctgggttttttttgttttttgggttggtttgtttttgtttttgagacagggtcttgctctgttatccaagctgtagtgaagtggcatgatctcggctcactgcaacctccacctcccaagttcaagcgattctcctgtctcagcctcctgagtagctgggattacaggcatgcgccaccatgcctggctaatttttatatctttagtagagacggggtttcaccatgttggtcaggctggtctcgnactccttaacctctacttctacctacgcctaatctactccacctcaatcacactactccccatatctaacaacgtattcacaaaaaacaatagcctcatcatccccaccatcatagccaccatcaccctccttaa

SEQ ID NO: 567259 - DNA, 1009 bp, Homo sapiens
gccagcttcggtagctcagtggttctggtggtatggcaacaaggaaaagataccgcaagtatgtggaatttatgaacagataattaccctcctaaatttcagacatatgaagaatcttggaccactatttacagcaaaatattttactgccgaaccatgtgggacagatatttcttcagcgcactctgagtgccaaagtacagttggtcttaacgttgccaagacatcatgaaggctttaccttgtgggggtcagaatattcgtggaactggaatgccataaatgagcggccgtccacagagggaccattgtcaaccgacatcgttgaggtagccattagcgaacaggaactgacctgcagtacggactgtactataccctttttgaatggtttcatccgctctctccttgtaggatgaatccacctctcaattaccgatatagcggtaattctccagtttctaagacattgccagagctctatgaattagtagaaacaactatgcagtcctgacggttctggagcctcgtaatggtgacggatgactctcggatcaacttagtgcgtagcagtccaggacttctttgagtctggctcatataactgaatggtcagtctctgtgccccgacaagtcacacaatgatctggagggagagctggtagctaatactgtcaagcatcgaggtatctgatgctgcagtgatcgttataacccaggacatccttttgccacattagagtgggaaaactgcctgggcaatagacaagcctggtcctgggggctatagcgagggggaagtggactcctctggactattttcaatggaaggaatggggaacgcactgtaaagacaggctcctgttgaggaaaccttgggaactggcccactgaaaggccttgtctttggggaggtggggtggctttcgcgtctggaattataacagggagccaaattcacacttggaacccaaaatctctagcgaagttgcaactgcaaattcgcgat

SEQ ID NO: 567260 - DNA, 143 bp, Homo sapiens
  misc_feature (28)..(28): n is a, c, g, or t
  misc_feature (33)..(33): n is a, c, g, or t
  misc_feature (52)..(53): n is a, c, g, or t
gtcagttatcgagtgtgaccgccgccgnccagngttctctctgtggcaaganngtcctccgtgccagtagcgcaacatgtctcagatactctacttcaggcagctctcggatgactactcgcaaaattgctgcgagcttgcct

SEQ ID NO: 567261 - DNA, 1087 bp, Homo sapiens
ggggcggctccggcgccgtctgtccgccgattctgaactcgctcgctccccgtgtctggagtcgggcatcatggatgtactcgcagaagcaaatggaacctttgccttaaaccttttgagaacgctgggtaaagacaactcgaagaatgtgttctgctcagccatgagcatgtcctgtgtgcctgtgccattgtgtctagcatggagggcacaatgggacaacatgcgtcctgcacaagatggtccagatagctttctttcaataaaagtggcgtgtggtggagacatccactcagaggcgatccagtctcttcatcgacccgaaagatgaacacagactgggccacgcaggacttgccttaaggattgcgccaacagggcttcctgttgcgggaaggacgtcgttgtagagtattctcatcctccatcgtttgtgagagattcccttgccaataaattctactcagtggcatgatgatggaaggacgcttggaggtttgagtcaagcgccgtaagagagatgtccacgaaaatactatcatttaacatacccttgggggtatgcactgaaccaggacgagagaaggttaacatagttgcgggagggttgcgtacgtcgtaccgaggcctcaaggtgggggatccccaatatggtacgaacatggtccttgtgcgcaccgtgggggttgggaacgctgtcgtgatcctaggctaatcgaggacgaggaaagagcgtaggggaaatgcacaccggggttgctgcaccaaacgggaaggagacagcccgaaggggagcaggaccttgtatcataaagacggctcaggcacaaatggatactggagaggaaatgacacaccgccatggttgaccgatagtgcaattgcttagcaaaggacacactgtgagcgttttccaaagggaaagggaaaccgctaattagttaggaggaaggacaacaataatttttcaccctcaggagagtcttatggagtgcataacgcgattatttgttctggggcaaaccgggacacttggtacatactcggagtcaatacatggaggtttcctgagaactaaagtacccag

SEQ ID NO: 567262 - DNA, 250 bp, Homo sapiens
  misc_feature (3)..(3): n is a, c, g, or t
  misc_feature (204)..(204): n is a, c, g, or t
  misc_feature (218)..(218): n is a, c, g, or t
ccnagcgtccggcagacgtcgctgggtgcgaagaatcaaattggaaattatggaatttgtgaatttcctgaagaatcccaagcagtatcaggacttaggagcaaaaattccaaagggagccatgctcactggtcctcctggtaccggttttacccttcttgccaaagcttctggaggggaggccactgttttttttttcactgngaacgggtctgagntcctggaaatgggggggggggttgggccaccc

SEQ ID NO: 567263 - DNA, 837 bp, Homo sapiens
cgcatggtgacacaccatggagaattcgtacgcgaggtgggggagccagccgaccgagaagtcgttgcgttccctgagtagagacgtttcgctggatttgacgccgcccctgtgggtgggcaccctctttcctccagcgtgttacggggcgctgcagggtaaacatgccgcttactctaccgcacgcgcgggggttcgctctagcaggcgcatctcggttgtcccaacgcccccctcttctgcaggggcccccccctggatagtgttttgccattggctcgtgcgaggcctcaccgcctcgctgtttattaaagggaaacggtcattggctcccccgcacggaggtgaggttataataaatagaaaaggggcccgtcatgttaagcgcgcgtagccacactcggtaggttaggcctctctatggaggcaccacttatcggtagttgctcccccccactactgtggggtacacaaaaaattgcacgatgctacgctcacggtattatgtgttcacacatcacggctcggcgcttgtccgggtactaaccaacacgccctaagcacactgggctagtacgggcaccccctggggcgcggacaaacgcacgttggacctgagcccctgacgcgtgttatagagacgctatgggaggggagtgaatcatgtcgacacgtgagccacttcggtctcctaggcgcactaccacgagcgccgtaaaaattgacgtttctggacgacgaatatttttacgtagctccctcacctagcgacgctggtgaaacgcctcgttttactagcccactgccccccgaagggttatccccgcggacaagaca

SEQ ID NO: 567264 - DNA, 1794 bp, Homo sapiens
  misc_feature (1)..(1): n is a, c, g, or t
  misc_feature (200)..(200): n is a, c, g, or t
  misc_feature (454)..(454): n is a, c, g, or t
  misc_feature (461)..(461): n is a, c, g, or t
  misc_feature (795)..(795): n is a, c, g, or t
ngaaacaccacgggggcgccgcctcgggtggaataccccccccccacgacgaggggtgtatcacaaaaagaagggtggacaccagtcctccctcggtggccagcaaaccgctcctcgacttaatataaccccgtggtggcacgaagagaagaaggcggcgtggcgaatgaatctataataggaaacgcgtcttcacgacngccgtgtacaccacccacacatcacgaagaaaggggggggagaatgttgctccccccccccccgtcccgctcacaaatagtagactttagacacacccgcgtgtgtgcttctgcacacgagaagaaaccacttcgtccgcgagcacagagggagggcgacaataggtgcgttacccaatcaccacgctgcttcctgcttccctccctcgccgcgcgtcccatgataggagaatgctgtttggtgcctccgcgcncaagagnaagttcttctcctgacacatctgttgtttacgataggatcgcccgtcccctccctctctatgagcgctggttttatgaagtcgtccctccgccccgccccgcacggagaaccaccatgttgggtgtaagaccgggagtgcttatccatccaattggtggacacaccagccccccgcttgtttctgttttactttcactaaagaccagcgggtttgtgtcgttcgccgccctgtgtccacagcgtggccgtgttggtggcaacgccacaacaattttgtccccgcccgccgacctctttttgtataagtcgtcaaaacacctcctcttcttcttnttggggaagaagaattattttccttcctctggggcgaagaataaaaattaaaaacgcccactataattgttcctccgggagtagtggaggattattaattataaccccccaccaacagggcgccacacactttttgtggaggaaaggaatagttgaagaccttttcttttgttggggggagaaaattattccgcccgcggaagaaagagtatcccgcagacccctccttccctacagagaggacatctctcaccaactcggcgcctgctgagtagtatgagtagttacttttttgcaaccaccacacagcacttgtgtgcttctcctgctgctgggttggggggctcctccgccgttgcgttgtctctggttttcttcttctctcaacgctggtggtctgcggggtgaccaacagacgacaacaaaccggcttctgtcaacacacagaagagagacaccgacatgtggcctctgagagaggcgccacacacagcacccgctcatagagagtgtctcttataacgacgagagagacacagaggagggcttgttcacacacacgacccgacacaaaatagtgtgtgtgtgagattgggggagatatagtgagacactctctatataagaatgtgataatacacctcattgaaagagagttataatgggcgccacacacactcgtataggccacacacatataattgttatacaaatttcacagagatatattgcacatttatatacccaccactctgttttatatatataggtgaaatttttagtcaccacaaaccacgtgaccacctcttcctcgagaaatcaaagcctcggtgaaacaccctcgaatgtttaataatgagatatattcacgtaaggaacttttatccctatctgagattttactggagggcttttgaaagtttgtttttataataaattatataaaattagtaatgaatgtaaaaaaagtatttgataccctccaagtttaataattga

SEQ ID NO: 567265 - DNA, 1124 bp, Homo sapiens
gctcctcctctccaattcgcctccccccacttgtgagcgggcagctgtgaactgtgccaccccgcgccttcctaatgtgctcgcctgctggtagcctggcctgactgctgccagcattcccctggtgcgcctgctatgctccgaatcctgggcagccgacggggagcaggagccacgcgcctcagagtccccgagcccgccgctggcttctcgcctattcccgagacaccatgccccctgccccgggccctgcagtatgaatctcctggaccccttcatgaagatgacctgactgagcaggagaagggcctgtcctggcgccccacagccccaccatgtccgaggactccgcagggctcgaccatgcccgtcgggctccgtgctcggacaccgagaacacgcggacccaggagaacacgttccccaagggcgagcccgatctgaagaaggagagcgaggacggacaagtatccccgtgtgcatccgcgaggcggtcagacaggtgctcaaaggctacgacgtggacgctggtgcccatgcctggtagcgtgtcaactggtccagaaagaacaagcctgacgtcaagcggcccatgaacgccttcatggtgtgggcgcaggcggagcgcacgacgctcgcggaccagtacccggacttgcacaacgccgagctcagccagacgctgggcaagctctggcgactactgaacgagagcgacgagcgggccttcgtgagcgcagcggccggatgagcggtggctggtcaccatgaagtgacacaacccgggattaaacgctaccagaccgcgataggtaggaacagctgtctcaaaatcgtggacacataggccggtcacactgataggacacagtgtatgcagagatggagaagtttatcgccacacaaggacacattacaacagtagctggaaacgcagactcaggccagaactaccatcctcccggaattgcaccaggcgctattacccgtgagaactccctggagccaagcagcggcccgcccagaacacaaacaaagcacacgaaagccaatgtactccatcgacgggaaataccaacgaactccacaatcagcagcgaaccaccctaatccccagacgtact

SEQ ID NO: 567266 - DNA, 559 bp, Homo sapiens
ttcgacggtgtctgaacttttcgcgtgcaacaggttcatcaggtggacctttggccccttctgcagagaaaagccagatgatctgctgggctggaagcgctggctgttaacagacacctgaggatctggtgggcctggaagcgctggctgttaacagacacctgagcaggccatttgctgtcctctccggattgacaggagtcaaaacatgagatcggtttagcttcagtttcgtcatggattaaccacctccaaggtgtcaactccaaaatgtcaagaattggtcacagtctcacttgcagattcctgctctgcagctgggcagcttggactgcgcccacagtccaaaaaaaggaaagactttctcatcattgagattctcctcattccagtagattgtttaataactggtatgtcagaagcacaaacatggtttctccaaaagggctggccgagactaacttcaacatgatggctcgaggagcttcactgaccttctcagagagtaatgagcagtcccaaaacgccatttagagagacttaggaaatggtgctatgg

SEQ ID NO: 567267 - DNA, 126 bp, Homo sapiens
agcgtatgcagcccactatgagtgtggaccataatgcaggccaccatctatggcatactgagggagggaagctcagcaaagtgaacacctactgtgaggaggaaggttagttaaggttgctggagc

SEQ ID NO: 567268 - DNA, 1082 bp, Homo sapiens
agcgggccacactcgctccgggggtcgcatggcggctctgaagacgccggcgcccgccgccttgaggagccgctgctcgcccgccttcccgtaatatggggcgaacaactgaccactaggcgataagatccctcttgcgtcgaccaggtttgcgtgtgtcccatgtgttgcagggacgctcctcgacgtcagagaattcgggaggaggagactgccaggcatatggctccagtgagataagaggatgtccatgcgaggagactgagccagtaacaacgaatcatcaattcagtgggtacgacatgtggatacgcagggacatagagtggacagactaaaggcattgaagtacgggacgcaaagtttgcctgtcttccacgtggggagaccctgtgtgccgctaaccctttagagaatgtgacagtgaggttacctcgttgtagcgctaaagagggaagcaccgcaggtcaccgccaggggtaacccacgccaggtaaaaaggggcaatgcacgcaagtcccttaggccaggtaattactcactttggcagaacctagttaacctagccatttacagcggcttctccgtgaggaaaggcccaacggttgggcacaggcggatttgcaggcacgcaacggatggaaactcactttcggaccaacgtgaattttggagcgagaaagagaaccgcctcggatcagaccaacgcgttgatcttgggataggaaacgccgtcgaacagagtgcacgagcgacgggccagtgtcaccgaccgttccataataagagtcccttcggtcgtgtcgcaatctattaccagcgccaatctttggatcggtatatcacccagcaattccaagcaccaatatgtgggagagaacgaaattcgcaacagcaccgtggactgatatattgattggctcccgttgtatatatgctcgcctgttggcacaattccctcatagagctacggagaaatgtgcactcgctctgagagactgtgataaaaggagtacatcgagcggaatcgaacacctccgttaggtcgcttcgcaatataaggcatacagttatacgccacg

SEQ ID NO: 567269 - DNA, 792 bp, Homo sapiens
gcaaagattacgagcgcggcactctggttttgtaaatttcaattgacgggggctggcgctttcgatgctagattactggtccttggttttacaattcaacacgcgactcttcgatagaaccgcagctaggccagcctagtgccgtggagaacatcgacaaaaacactgcagacgccatcaccgcggagggcttcaccgacattgacctggacacgctaggtaggctgtacctaggagcgcgacacactgggcatccgtgaggtagcggctgtatcaatagccgttagtccgctggtccgaggccgagtgtcagcggcagcagctgcaggtgacgccagagaacaggcggaaggtatctagggcaaggccctagggcctacatatacgcttacccgctacatagaccatcgaggagtatacagctagcaggtacccgcacagtacgggcatacctaggtggacccgcgaggtaggtacagcctacttacctagcactatacaccgtacaaccccaagccacgagtaggagtaacatatgaccggccccgctagctgcctagcgtaggggaaggagtgcagcatcaaccgcttccagcaggtggagagtcgctggggctaacagcgggaccagtgaccgcatcaggttctcagtacaacaagcgcatcttcgaggtgggatttgggctgtatggatccatccacgggcccaccgactaccaaggtgaacatccagattatacacaccgatagcaacaccgtcttgggccaaaacgacccgggctacagctgcga

SEQ ID NO: 567270 - DNA, 174 bp, Homo sapiens
cccctccaggccccaggttaggaaaattggtgggagaaagggaaaagggttgggcctccccgctcccagcaattaaaaggacaaccctttttggagcccccccctgaaaggggggcaggcatgggggggacccaaactgattttttttttggtcaaaaaaactgtttagcccca

SEQ ID NO: 567271 - DNA, 1204 bp, Homo sapiens
  misc_feature (331)..(331): n is a, c, g, or t
  misc_feature (386)..(386): n is a, c, g, or t
  misc_feature (399)..(399): n is a, c, g, or t
  misc_feature (632)..(632): n is a, c, g, or t
  misc_feature (1051)..(1051): n is a, c, g, or t
gcaggtcgccgatcgctatggcgtggctcaccgtgaaggcgctaccttactgggacaaggaggacagcggggcgtcgagattcgccggttcagctactgctgcagccccaaggcctggaaggcgtgatagaccgcaggcatgtcggcgcggtccgcgtgactccctaagctggagactggctgactgagctcggcgcgtggccggactcgcttgtgtccgcgacgcgcattgcgtgccatggccgagatatctctagcgcgacaacttgacctgcggaagtgaaggcacgggggacttagtgttggacctttatccaagtgtgactgaggnaacttgaggaagtgggaggcatgtacgctacgctagaagaggatagagcattctntaccgatagtctnatctatataagacggagtagagaagacagagtgtcctggacgtggactcgacacgggcacactcggatgtggcttcagggaggtcgacccacgcaatagcatggttgtccaccacccaactgtggtgaactctgccgagaatgagatggtgaccagatagggcgatgcgtgctgtggttgaaggacaaaccgcggattaaccagagattgcagagtcgtgtgctgtgtgcccnagtgagctaagcgaaagctttgcgtgagtagtcggatcggtgggccgaattgggcgcaccaggggggcgtatcgcccaccacaggtggggtgtctcaccacttcaaaaggaacatacttgcgcaattttgcgcacgcaaagttcccctcgtgttcagaggtctaacctctgggtactttagaacggaggcctttgcttacaggccaagcgaggcccatggccttggcgtttcactgcggaaggtgtttgaaagaactagcgggggcaaccaccatttcctgggcggttggggccctgatgcggcacatagggggcgaaagcaggtggggtggtatcccctaagcgcccaatggaggcaaaagagcgcatttggggcacaggcccgccgaacgcgaggttaactccctacttcctgtcgngattttggcaccacctgagggggtggacagagggcgccccggattcggcttttgggggtgtcgcgccccaagctgggcggccaaggaaaaaaattcctaaagggcttttaaccttgggttctccaatttgcggcggaaacggagaattcccgg

SEQ ID NO: 567272 - DNA, 268 bp, Homo sapiens; identical to SEQ ID NO: 511833
  misc_feature (172)..(172): n is a, c, g, or t

SEQ ID NO: 567273 - DNA, 117 bp, Homo sapiens
cccggggggggttttttttccgccccttttttggggggggggcgggtttttttttttcccccccccaaaaggttttgggggccttttgggggccccctttttttttcccccccccca

SEQ ID NO: 567274 - DNA, 624 bp, Homo sapiens
  misc_feature (624)..(624): n is a, c, g, or t
gactagttctagatcgcgagcggcgcccttttttttttttcagatggaaaaattaaaataaatcctactatctaaaaaaaaaaaaaaaaaaaaaaaaaaaaaaaaaaaaaaaaaaaaaaaaaaaaaaaaaaaaaaaaaaaaaaaaaaaaaaagggggggggggcaaccgggggcccaatcaacagcagccaccccccacttttgattgtaaaaaggcgggcccccataatggcggaggccgagtaaataaaaaacagacagccagcgggcggcgctgtacaaaaaacacacgcggcgcgagcgggaggagaaaaagccggcgcacgggagggatcatcctgtgtgggggaaagagcaccccccaacctgctggcgggggggcggcacccactagggcggggcacacacacactccccatccaagagattatattaagcgctcctgcgagggagcaaacctataaaaccccgctggagggcgcgtagtcatgggggcggtaaccaccccacgcccagtattatgttcgtctgcgcggacaggaaaaagttgcgtccacaggtcagttattatttgtgaagcaacaattatttacccgcgggaggttatataaataataaacgggn

SEQ ID NO: 567275 - DNA, 222 bp, Homo sapiens
  misc_feature (12)..(12): n is a, c, g, or t
gtgaggtgttangttttcattgagagtgcacctaaaagatttgctaactgttgtctataagattgagcacagagcctggcgttggatggtacgcctttaatcccagcactcgggaggcagaggcaggcagatttctcagttcgaggccaggccagcctggtctacagagtgagttccaggacagccagagctccctatctcgaaaaacaaaaacaaaaacaa

SEQ ID NO: 567276 - DNA, 188 bp, Homo sapiens
tgtctgctggtggctcccgcttggtcgtccccgtcactcttgggactctgaggcgtgtgtggctcattctgaggtcatgcgttcgagctcctccctggctaagcgaggttcgcccctgtctcttctactctctccacgccttagctgtccgctgtgctatccagtgtcccgcgctctgaattcgtaat

SEQ ID NO: 567277 - DNA, 380 bp, Homo sapiens
  misc_feature (1)..(1): n is a, c, g, or t
nattgtcatctttacctgaatatttcctttctattgatcccaagtctttagataaactcaaccaattgtcaaccagaaaatgtttaaatttacctatagcctggaagcccctgctttgagttgtcccacctttctgaaccaaaccaatgtatttgattgatgtctcatgcctccctaaaatacatataccaagctgtaccccaaccaccttgggcacatgttctgaggaccctcctaagggctgtgtcatgggccacagccactcatatttagctcagaataaatctcttcaaatattttacaaagtctgactcttttcatcaacagaggctattttctagatcttataggtgtacttcattattttttttttgtgtctc

SEQ ID NO: 567278 - DNA, 140 bp, Homo sapiens
ccatgtttggtctcggaggcagaagcacaacatagttctcgccgtctcatgagcagtggggggaaatggaacgaacagggactggccaagggaaactgtctggattaggattgtcgacggttttcgcttttgtaaagctt

SEQ ID NO: 567279 - DNA, 135 bp, Homo sapiens
ccggagacgatcatgggttgctgctgttggtgcgagaagcggacacagacacccactctgaggtggttctcatcctgtacggtgtgtttgcacacccccctgaggttattccatagtcgcgtaatcttttatctc

SEQ ID NO: 567280 - DNA, 786 bp, Homo sapiens
agcggaaaagaaatcaagctgcatttttaagtataggagtcaatttaaaaccaacaggaaactcgcaattcttccctattacggcacaattgaaaacactgattaataaatattactgtgctgtatcctgtcacaaaggtcgtgttgaaggcactgtaccgtttggcgtagtaaggttccacagcaaccctcacgcaggcacagcctcccccgctagaacgaacaaacccaacgaccagcaagcaatcgaacaaaggcgtagcgaagataaataggaagaaaacagccacaaaacctcaggaaaaagacacgagtcgttgcacagtgagagtgcaggaccgaggaggcgacacggtgacgtgaacaccccaaccgcatacaccgatcaggaggggaacatcacacgagcaacagcgagccgccctaaaaggagggacagacacacgagaagacgcacccgtcggaaccaggcatacacaaatcaagcaaagcaccccaatggacattcgccacaacgacacgagacgcaaagtggacgccgcaacaagtcgaccgaccgacagaaaccaccacacagcaaggaccaaacggcccaacagacaacacaggatacgaggccacacaaaagttgcatccgcaacgtgaaggaccaggatgacaagataccagaggagcaagcagcaggcacgcacgcacacgaacgcgacatgacacacgcaacacaacatcgaccacgcgacgaggtccgatgccgcgagagcagatagccaaggatctgaagcacta

SEQ ID NO: 567281 - DNA, 828 bp, Homo sapiens
tgcccaggctggtcgcgaactcctgagctcaggcaatccacctgccttggcctccccaagtgccgggattacaggcatggaccatcgcacctggcctattcttcttactaataatttttctttttctttttcttttcttttttttttttgagacagttgggctcttgttgcccaggctggagtgcaatggtgcaatctcggctcaccgcaatctcggctcaccggaacctccgcctccgtgggttcaagtgattctcctgactcagcctcccaagtagctgggattacaggcatgcgccaccacactgtggctaattttttttaagtagagacagggtttctgcatgtggtcaggagggtctcaaactcccgacctcaggtgatccacccgccttggcctcccaaagtgctgggattacaggcgtgagccaccatgcctcgccaatttttctttttaagaattaaatttacctggtatatttagctgtcataaaagttgtttttcaattaaacatgtaaagtttaaaaaacaaaaaaaaaaaaaaaaaaaaaaaaaaggggggggggtcaaaaaaattttccctcggggggcccagttttcgcttccccggtttttttgtaacagaggtgcccccaatggaagcggtataaaaagcaaagaccggggccgcggttaacacgctctgccttggaaactcgctccctggctcctttggcgagggaccttcttcggtggtggacttttgccaccccctcagatattaaagctcaggtaattaactcaggtttatgtttacaaccgatttgcgctgaattgtccgttgtgaa

SEQ ID NO: 567282 - DNA, 107 bp, Homo sapiens
gtgatcagaatgtcacccggcagacgcacgatctacatcttacacatcgtaagcgaggtgctgcgatagaggagaaactgaatttcaccttcatcttataccttgga

SEQ ID NO: 567283 - DNA, 617 bp, Homo sapiens
tgaacatgttaagaaacccaaggctttaatatccttcaatatattttaaaaaatagaaagtgatgaaaaaagccttttcagaggagaaaaccctcaagccataaacagctgcaagatgctcagactcatcagtgatcaattcgctcatcaataaaaaaggctgatgctgctaaatattgcaaggccatgaatcagtggggaatgtccctacccatttggtggaagtgcaaaattgcacagccatttggaaagcagtttgggagatctgttttaaaatgtaaaattaagatactctgtggcccaggaatttaacttctgggggtctgacctttctcatgtgcacatagagacacataaaaagatgtttgcttcagtagtctaatgtcaaaaaaaagaaagacattaataagaatgcttatgattaaataaagtctagtacctccataatatggaatactatggcagcaattaagaaaaatgaggtagatgtatatatactaatatggaagtactccagagcatattgatatgtggaaaaagcaaaatccatgaaatatacaaaagttggttccttgggattaataaaattgataaatgcctggatacctgataagaaa

SEQ ID NO: 567284 - DNA, 627 bp, Homo sapiens
  misc_feature (92)..(92): n is a, c, g, or t
ttgcttaatgagccatactcgtcgtggtcaagtttagcgagcttcggaatctagcatagcatagtcaaggagtttcggggcataaacgtagnaatgtcattgtcaatgacataggaaggcaaactctgcctgccgctcagagttcatgcaacccagagtgtatcccgtcgacattatgcgtcaggttcacgtactcatgtgagtccagataggccttgagcatggaccggtcacttaggcgcgcttcatatgctgagagcaggtcaaacgcatccagatagccaggggctagaacctcatgtatgagcagctagtccaccaggttgtagtcagagaagtagatctggtctcccacaatgatggtctcgcatccatggttctgggacagcagggtctcaataggcttcagttgcctgatcagtgcctgcacatagtcatccttgctggcctcatagttggtgtagatgagggagatgaatttccactgcaggtcctttacgccgtcaatcaccatgtctactgtgggtgcctcgtggtggtccttcccatagagcccaagggttcgacacaggtgacacaggatggtattgtactggtacagggtcaggtcaccgttctggaacttag

SEQ ID NO: 567285 - DNA, 393 bp, Homo sapiens
agtaggacagtgttcttccctcaacctgatctttttgatagggaagggtgagtgagggagtagagtgaagggaggttcacttggcagagtggaagattcttcaagagtagagctgggggagatgacagggagatataatgctgacacttccttgaagctgagatgggcaatggacatacttagaaattttagtgactttaaatagcctggatttccctctccaaaacttttagaatggaaaatcccatcccccatcttttctttactcccaaaataagaattgacaccccgtgactctggacgtggtgtatacttggcacatcgagtgtttgaagtcagtcccccagagggagaggggaaacccatcctccatacttttgttggaacaatctc

SEQ ID NO: 567286 - DNA, 130 bp, Homo sapiens
cgttctcctgcttcatcttgggcttctctgtcgagtatgccacacagtacccgagtgcagttggcagcccgtggctccaggtcttgggatcacaaggtggctcagaagactgctctccaggtggccccgg

SEQ ID NO: 567287 - DNA, 156 bp, Homo sapiens
tcttgctgttgtcttctttctcctgagggagtagtactctccgtatatcgggtagatgtttgccttgtcactgccgcggaatatttcctgagggctggcgtataattggtcagtctttattgaggcagtgtggctcttctggagtgtaagatgggc

SEQ ID NO: 567288 - DNA, 260 bp, Homo sapiens
  misc_feature (50)..(50): n is a, c, g, or t
  misc_feature (56)..(56): n is a, c, g, or t
gtgttgcttccttgacagcctgcgtcggttccttgacgctgttgcgacangcgctngtgtcctgtggagaacgcggtgcacgaagtagcgtctccgagcaggcgcttgatgtagtggaagtgagtgacagatgcaggcgaggtgcccactgtatgccgactggacgtaaagtcatatttgtagccatagatgaagggcactcggaagtagaagagcaggtagatgaaaaggggccccgcgtactctgcaaggaacccacg

SEQ ID NO: 567289 - DNA, 169 bp, Homo sapiens
gttcatcaattgtctgtatatctctatattttatccatgtactcttttgatgtatagaagtagtttgaactcattgtttccttgtggtaagtacccagatgctgccacaagacctagacacttatgaatggtctatattggcttcacatgctccttgcgaggtagctct

SEQ ID NO: 567290 - DNA, 662 bp, Homo sapiens
ggggacgacggctcatgcctgtattcggagaaattggccagactctacgagtcgcctgcatcgagatcggcatgttaggccatgacaggctgacagggataatctcgtactttcttaacagaacactcacgtagtacctattagcgaacgtcgccagcacgacagacgaatctatagcagtcgcgggagtagtctgactaccacgacagactgatacacgaggccttaaatttaatgtcatgctactctttgttctgagacagcgtcaacgtagttcacgtactactgtgagacaaagccatgacaagcgacttcgtactacgctccctagacgtgaacatggtcaacgcgtacttttactacacacgcaaagacatcctcggatcaatgctcttgcgttccacccacaatacatttaaagtagaaggccatgaccttttcggtagcgcagtgactttatacagtaatcaaagtataagacattcctgctacagacggcctgaagtgggctcataatgctgcaacgtcttcagcacgacctagacaatagcagtgcatggatttaataggcctggtcaccagaagccttccataaccaatgtagggtagttggcaaggcccccagcttaaggcactaattagacgtcatcaaccgcgggcct

SEQ ID NO: 567291 - DNA, 334 bp, Homo sapiens
gtatgaggcaatccatagcccttcccaaaaaccacacaccgcagcactaatacccccaaaccaaacgccccatacctataagcggcggggagctccgctaccaaggagcgcgcaacccacagcttagccggcccctcctcgatcgtatccgcctctacagcagcaaaacgtcacgtgtacccacattccgtacaagcttctacctcattatgccaatttctcagtcgacaacgttatcaatcgggggaccccacccacaagggtctcagaatgagccacctatattagtactactccaatcaatacctcgtcagccagcgtagtcccctccgtg

SEQ ID NO: 567292 - DNA, 172 bp, Homo sapiens
  misc_feature (50)..(50): n is a, c, g, or t
ggtgtcacggacctgatgaacttctacatatgaaccacagactttctgangtctaaatgtagcctttcatggcacatttcagtgatcagaatagatatccttttacacgcacaaaagcaatagattcattcagtggacaagttcctgtgtttaacatacacgagctataagt

SEQ ID NO: 567293 - DNA, 150 bp, Homo sapiens
  misc_feature (128)..(128): n is a, c, g, or t
gtgtatctagaggatcccgccacggtagattcacggtagattatagcaaatttttttctttttgtatttcctatgtttctcacttttttttttttcttgagagagtctcattctggtcacccaggctngaatgcaggtgggccatctcgg

SEQ ID NO: 567294 - DNA, 948 bp, Homo sapiens
ctgattgcccatctgtattacctattcgctcaactctagcttctacctgtaaattaccagtaccacctgctaatggctccatttggatgctattcaggatagtatcacggtcatcctagaggcatacccgaaattcgccaattggagtgcatagaatgagaaaagtgaaaagttgaatttggacctagttaagctacaagttatgcatgatactcagtcgaatcagagcagataatacaaactggatatcaacttagaatggagtcagagtaacagatacgtttacagatcaagaaaagcaacattactggatacaactacagaagttacaaaaaaggatactcataatccttatagtattatttcagagaccagtgaatgaagattgacgctcgaggattgctgtccttagacaacactgatggatatctatacagaacttgagacgaattcgttatcttgcagcttcagtgttttacgttgcctggcaactagcattgggattcttatagattctggaacgctagtattaagtgctcatcctgctgtggactgttggcttctgatgaacatccacaaccgggagagactttactttgcacattgtcagttgcagcaaaaatgttactacacaagattattcgaagtgtatacggactaaatagaggaagtgttttgagaatgagatagagatagctgtgtctttattcgtgtcgtgtgtgatgtgcaggtgtgtgtctttattatattgatcagctgtcactcagacctggtttgagatagaagagcattgttgtccttgttgatagttaatagaaatgtgtcacagagttttcgttatgtttgcttgaacagttgtgtaaatatacaggattttgtgggtattggttgaatagtttgtaaaccattccgtagcctacatatttaaaactgaagaactgtcctgat

SEQ ID NO: 567295 - DNA, 282 bp, Homo sapiens
tcaaagagccggagtcgagacagcctggcagctgaggcatgagaattgcttgcgcccccaggaggtgggggttgcagtgagccgagatcacaccagtatactccagcctgggtgacagagcaaaacttgtctcaaaaaaaaaaaaaaaaaaaaaaaaaaaaaaaaattaaaggatcggatttggggaatgggggaaaatttgggtttggacaatttggggcgcctcttctgggattgaggggggatctcttaataaagctgagcaccgtgagggatttgaag

SEQ ID NO: 567296 - DNA, 210 bp, Homo sapiens
acgttccttgggctaccccgatgcagcacaccacatgtaacctgctatgatacgcagctcattcagtgttctctaacagcagtaatattaataattttcatgatttgagaagccttgctccgaagcgaaaagtcctaatagcagatgatccctccatagacatagagtagactatatgcatgccccccaccctaccacacattcaacgaa

SEQ ID NO: 567297 - DNA, 379 bp, Homo sapiens
gaataggttcaccgcaattgacgatgtataagcttaactcacaggcctaactgtaatgtttaagtactgctactgactgagcacggactagagacagttatcagcgaaccactgtaccgaactcacacactctctggcagaacctgggtgtgaaacttgcccaccgtcagcacaaactagaacgggctctgttggtccttagtcatttccagcatgccttaaaggaactaatgagttggctgactcataccgaagagttgtaatgattgctcagagaccaatgtgtggagacccaatagtcattgacgttgagctctgcatcagtcacatgtcctaaaatgatgttttggttcatcatgccgcgttggcacactcttct

SEQ ID NO: 567298 - DNA, 1002 bp, Homo sapiens
ggcccccccctttaggtggtttataatgggggtgggtggcgccacccccctcccccatttcgttggtcggacacagaccccccttggttgctaccacccccaataatgaaattattatctattggggggggggagacccccccctctggtgggtgatgtgtcctcaacaaatagtggggcagacaccccctttgcttcgcgttggtgtggggcagacccactttttttgcggcaaccccccaaaaggttgtctctcctcccctggggtggggagacacgcctctctttgttgtaaatattcaggtagagagagtagtgggagagtgaccgccccctgtgtggacagtaaattacatacgctctcctcttcttgtcgacaacttacacggcgggagacacacaccagggggtggtgaatcacaccccctctataacgcaccacacacaaatagtgtgggagacacacacctctttaagaaatacacaccatctctcacaccccctattagactgctacggtctgtgggacgacacacacagagaggagagtggtgatacatcccacctgaagagagattgtgcgtgagaggatgattgtgagggataaatctttttgctatgtctggggccacaaccacctgttgtgcacaccctcgggggcatttataatcgtgggtggtgataaccttctctcacacatagtgtggaagtaatatttgcccgggctggttatttcttcatggttagaatagaatgataagaaatagtagcctgcatcctccacaacatcagaagaatatatccgcttgtgcagataagtatgaatgatgcggtgttgaaaccccccaacactaggtcttattcgggggcccaccccaacaaaaaggggggcaccattttttttttgggggcccccccccccccccgctttttttggggggcgcctttttttttgttgggtgttggtgggcccaagaagaaaaaaccccggggcccccctca

SEQ ID NO: 567299 - DNA, 941 bp, Homo sapiens
  misc_feature (242)..(242): n is a, c, g, or t
gggctagggacgcatgcgaggctgcaggaccgtgtcctccaccgagcgtgaccccgatagtggaatcagctcacccaaagctcaggcttctgaggcccgggcgggggactcgaaaacgtgctgcttcttggtagaaaacgggtgctaaatggctgttcgagtgctgaggtcttgatgtggagtgcaaggtccctgttcgcagaggacgagtgagccagtgcgtgagcgggtgggcagcaggngccctgtagcctctgggttggactcgtcagggtgaaggtcaggcgtgactcgcattaacataaagagcgggaacagcagattacctaaaacctcgggcagaagaggagaggaggatagcagcagaagagaagaagcaagacatgatgaactcgaaacgggagttgccagcgcgaattggcagacgatgacagccctattcacggtgccgtgacccatgtgacctgactcttttggtagtcagcatcggctgagtcatatgcttcctgtgtcgttgtgacaacttgggacacggtaaaactgtgtactagacaagaaacttgcggggatacaacggggggtgcgggaaaaacatctattgctggggggcacctgagcatagacagggctgggcgggacccggatcataatgatccctgtggggaaaaaatgagcggcacccccccgtaaatacgtgcgggacgagcatgtatgcgctcaagacgggggtcacgcccgactatatggtaacgcggggcacaacaaagccggagacaaacaaccggccacgagcaagaagagacgggaggggacgcaagaggcacacaacaacggacgagcacaacagacaaaaccaagacgggccacaaaaagacacgcggcaacacagaccaacaacaaagaaccagcgcaaccgcaacgccgcagaaagaggaagacac

SEQ ID NO: 567300 - DNA, 328 bp, Homo sapiens
tggtaaaaatttcaatggagaaaaagcatcaagagggacagagaaggctgggcacggtggctcacacctgtaatcccagcactttgggaggccgaggcgggcagatcacgaggtcaggagattgagaccatcctggctaacatggtgaaaccccatctctgctaaaaatacaaaaaaattagctgggtgtggtgttgggcgcctgtagtcccagctacttggaaggctgaggcaggagaatggcgtggacccgggaggcggagcttgcagtgagccgaaagcgggccactgcactccagcctgggcgacagagcgagactccatctca

SEQ ID NO: 567301 - DNA, 424 bp, Homo sapiens
  misc_feature (7)..(7): n is a, c, g, or t
  misc_feature (55)..(55): n is a, c, g, or t
  misc_feature (91)..(91): n is a, c, g, or t
  misc_feature (186)..(186): n is a, c, g, or t
  misc_feature (201)..(201): n is a, c, g, or t
  misc_feature (278)..(278): n is a, c, g, or t
acccccnccccgaaaatatatataatccaaaaaccccccagtacccccaaaccancccccttaagccgttccagattgtaaagtgtgtccnttaaatccgccgggagggcccactgtccagccaggccagtgacccccccgtgcccccagtttgaagccacagtgtgtggagtatttgatgtaccnacagtacccatagcnattttggtctgttaagtaagttgcaatttgtgatgaaatgaagtggaaagtagtacctcataatgaacaaatttccntggttacatggtttttcttgtaaaacttaaagaaaaaaaaagaaaacttgaaattttatatatttggattttgtagtttttttttttttatttaatgcaacacaaggtaccaaaatcattaaataaagtacactgtggtcatttta

SEQ ID NO: 567302 - DNA, 316 bp, Homo sapiens
gctcggccccatagtgcactcttctatatctacatgtcatgggttttggttgtggtcttggctgttctgaaacaggctagtaaacgaaacgaatgtcagtgcgggacgaaagagatggtgaaataaggtcccacgagttagacaagagacaatgggattaatggcacagaggccatgattcgtttatgaagagaggaattcctccttctctgaacaaggtgtgcattggtgcagttcactatgattaattagagattgtgccaaggatctggcctacaaaggctctttgtggtagatattgaagagtgcacttttg

SEQ ID NO: 567303 - DNA, 118 bp, Homo sapiens
aggatctcctgtctttgggacggcgagcgggcggatacaggtcaggagatcacgacagtctgcgaacattgtgaaccctgttttactaaaaacacaaaactagcttagtgttgttgcc

SEQ ID NO: 567304 - DNA, 1286 bp, Homo sapiens
  misc_feature (333)..(333): n is a, c, g, or t
gaactggactgtgctctgacgaaagtgtgactcgtgattgtttagaattcctaagatacgaggaatcctgtgaatgctttgtaccattattactaggttagtcggagcgtgcaattgcactaactcaatcgtatgttagtcacgagacagtgatatagtgtcatcggttgtcatgtactagaaaagctatggaaaagctgtagcaactaggagatatcgtctggagcgttacaggcgtaatgtccgagctaagatattcacggcataaatgcggatagatctcttaatttccacataccatttcatatgacactaatgctctctcgtttgctnctagttgcttgttattgtgcattgatttttgccttttagaaggttgagtatctttgaatgaactagatatgaacgtgtcatgaggcatcacccaagatccatttagagtgaagcttgtattacacgctaatctatgtgatatctatatatcacagaacgattctggcgctatataatatccagaagaacgttctagagcaattgtttccctttctattcattcaaacggtacgacgttgcgtgaattacgaaagactgattgattggtctgtacgccaaatcttgtgtgcagactctcataagtcgcgttccgcccaaattcttgaatatctcggatgacaaggaaactctggtagaatttgtcaatttagaccctacgttgctccattacgtagaaaacttaattggaagaaaagccagcaatttagtgtggaacgttcaaaacttccaacttctccttcctaatggggaactgttccagatcaattattcccccttgcttaatatttccccaagggaaaacagacaatgcacattcccttgttacacccttgttatgaagagcaaaaatttatttagaggacaacccacactcactacaacttcacatgcttacctgtatagtaataaaccgaagtgcatttcatgggagcaaacctagaaccccaaagggcaccttaaggtccagaccctaaaaaaaaccttccaattatttctggacaatttcctcacacacacaggctgtcgagcgcattgtaattactttgtcgtgtagagttaccgcaagggcaaagtgaaccgaacaagctgtcgttcagaaatttcaacacaaatctgctctgttgtgaaacacacaacgttatttataccctcccccgaatttctataaatatggcacggcttcaagagacactttggcccagctcacacgaagtctgcacacttgcacactc

SEQ ID NO: 567305 - DNA, 129 bp, Homo sapiens
acctaacctaaccctactcgaatgcttaaaactaatcgtcccaacaattatattcctaccactgacatgacttttccagaaaacacacattatttgaatcaacacaactcacccacagactaattatta

SEQ ID NO: 567306 - DNA, 12620 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgcataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatga
